United States Patent 11,098,302 (IDENTIFICATION OF POLYNUCLEOTIDES ASSOCIATED WITH A SAMPLE) - sequence listing, part 67

SEQ ID NO: 229893 - DNA, 600 bp, Homo sapiens
  misc_feature: GYAE6OF02FR0UD.23.35.D02.1.454.CMB.1.raw
  modified_base (229)..(229): a, c, t, g, unknown or other
  misc_feature (229)..(229): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagctggagcagtctgggactggagcgtgaaggaagccgtggggccgnaggtggagggtctccgtgcaaggtctcgtggaaacacattcccctgattgatgatatactaagttgggtagcgacgacggccacgtggacctccggccttgagtggagtgggactactattacgacccgtaagttacggaggtacagttacggcggtaactagtcgacgaggaggtacgggttcggggcaagtacggtcctacgagtcgtaccggtggaaccacgtactccgactaccggtactacgtaccctatacgtagggaaggtcggtaacgggctggaagtacgttacgaacgtccgaacggttccgtttaccgttcggtcgtccgggacgggtggggcgtaggtagtaggttagttaagttcggg

SEQ ID NO: 229894 - DNA, 780 bp, Homo sapiens
  misc_feature: GYAE6OF02JDXUX.23.35.D02.1.454.CMB.1.raw
  modified_base (228)..(228): a, c, t, g, unknown or other
  misc_feature (228)..(228): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagccagctactaggttcccactcccaggtgcagctggacgcagtctgggactgagtctgaagagccgtggggccncagtggacgggtctccgtgctaaggtctcgtacggtaaaccaccgtacttccccgtgtaacttcggtaagtcgtaattacgtactaaacgttggggtacggccgtaacggccgggtaccgtaacgtcgggtacccgttaccgggtaccgtttagggtaacgggttcgggaacgttccggggtaaccttaaccgtaacgtttaccggtaacccccggtaaagtttacggaacggggttactaacgggtttccggacggttaacgtaacgttcggaccgtaagggtacggtacggggtttaccgggcgtaaaggtcggttctacccgtagtaccggtaaccgtcgggaactaccgtacgtcccgaacgtaccgtaacgggacctaccggtaacctgggtaacggtaacggtacggggaacggtcccggtagtaccgttaaggtttacccgtaacgggtaacggaccccggtttccggtttaaccgttcggtacggtaccggtacccggggtagggtacgtacgggttaacgttacgggtaagtttacggtaggg

SEQ ID NO: 229895 - DNA, 622 bp, Homo sapiens
  misc_feature: GYAE6OF02HE8CD.23.35.D02.1.454.CMB.1.raw
  modified_base (225)..(225): a, c, t, g, unknown or other
  misc_feature (225)..(225): n is a, c, g, or t
  modified_base (287)..(287): a, c, t, g, unknown or other
  misc_feature (287)..(287): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagctggagcagtctgggactgagctgaagaagccgtggggccncagtgagggtctcctgcaaggtctctggaaacacattccctgatgatgatatcaattgggtncgacaggccactggactcggtccttgagtggagtggctacattacgaccctaagttacgaggcagtgcgtgtactgtacgcgagacgggtacgggttaccgggacgtacggagtaccgtaccgtacgtcggtaccggtacgggactacgacctacccgaacgtaccgtaaccgtacgtacccttaacgaggttacggaagggtagggtaaccggggtctaggtaacgttacgttacgaacggtaaccgtacgggtttaaccccgttttacgttccgtacggtacccgggtcgggacggggtccggttaggtaacggttaggttaaggtttaacgg

SEQ ID NO: 229896 - DNA, 771 bp, Homo sapiens
  misc_feature: GYAE6OF02GZZYC.23.35.D02.1.454.CMB.1.raw
  modified_base (225)..(225): a, c, t, g, unknown or other
  misc_feature (225)..(225): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagctggagcagtctgggactgagctgaagaagccgtggggccncgagtggagggtcctccgtgcgaaggtctcgtaggaaacactacttccctgactgatgatatactaagttgggtgcggacgacggacctacgtcggacgtccggtccgttaggaggtggtacgtcgggtactaacgtacgttacgacccgtaaagttacggaacggtcgtaaggtacggaccgggtaacgttaacgtacggacggtaacgggtaacgggtaccgggggtttacccgggggacgtaacggggtaccggttacccgtacccgtacggttaccgggtacccggttacggggaaccctaaccgtaccgttaccccgaaacccgtaacccggtacccgaaccgtaccccgttaaacgtacggttaacggggtaacgggtacggggtaaccggggtaccgtaggtaacggttaacgtttaaccggaacggtaaccggtaccgggtttaacccgttttacgttaccggtcgggacccggggtacggggacgggggttcggttaacgggtacgggtttacggttaaggtttaaggttaacgggg

SEQ ID NO: 229897 - DNA, 598 bp, Homo sapiens
  misc_feature: GYAE6OF02F8RUU.23.35.D02.1.454.CMB.1.raw
  modified_base (226)..(226): a, c, t, g, unknown or other
  misc_feature (226)..(226): n is a, c, g, or t
  modified_base (273)..(273): a, c, t, g, unknown or other
  misc_feature (273)..(273): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagctggagcagtctgggactgagctgaagaagccgtggggccgnaggtggagggtcctccgtgcaaggtctcgtggaaacactacttcccngactgatgatatcgaagttgggtgcgacacggccacgtcggactcggccttgagtggagtcgggactacgtagttacgaccctaagttacggaggcgtagtcgacggtactagtcgcgaggaggtacgggttaccggggacgtacggtacgtcctaccgagtacgaccgtgggaaccacactacccacgacgtacacgtacctaacgagtacggaagtcggacgggtcctaggtaacgtagttacgacgtaccgtaccggtccgtttactcggtcggaccggtacgggtacggggtcgtaggtagtcggttaagttagttacggg

SEQ ID NO: 229898 - DNA, 749 bp, Homo sapiens
  misc_feature: GYAE6OF02IAOW8.23.35.D02.1.454.CMB.1.raw
  modified_base (255)..(255): a, c, t, g, unknown or other
  misc_feature (255)..(255): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatccttcttcttggtcggcagcagctactacggttcccaccgtcccaggtcgcagcgtggagcagtcgtggactgagctgaagaacgtcgcggggccgcgaggtggtagggtcctccgngcgaagtctcgtaggaaccacgtacttccgtagtactgtagtagtaatacttcgtaaaggtttgggacgaccggaacgtcggaccgtaacggtcggaccgttccggtacgtttcggaagggtcggagtcggtacgtacgtaacgtacgaccgtaaagtacggaacgtcgaagtcggtacgtactagtcggacgtaaggtacggtaacgggttccgggagtaacgggtacgttaccgtaccgtacggtacggtaccggtaggaaccgtaccgaaccgttcccaaacgttacgaaccgtaaccggtaaccttaacgacggttaacggtaacgggtacggtaccggttaccggtagtaacgtttaccgttaacgaaccggttcggtaaaccccgggtttcctttaacccgtttccgggtaaccggtccgggtcggggtaacgggggttccggtaaggtaaccggttttacgggttaaggtttaaccggttaacgggg

SEQ ID NO: 229899 - DNA, 702 bp, Homo sapiens
  misc_feature: GYAE6OF02IAETL.23.35.D02.1.454.CMB.1.raw
  modified_base (187)..(187): a, c, t, g, unknown or other
  misc_feature (187)..(187): n is a, c, g, or t
  modified_base (674)..(674): a, c, t, g, unknown or other
  misc_feature (674)..(674): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggaccgtggaggactcctcttcgttggtggcagcagctacgacggttcccactcccgaggtncgagtcgtggacgcgtaggtcgtacggatgagtctaggaaggacgcgtcggggaccgcgagtggacgggtctccgtgacgtacgtctacgtaacggaaacctacgtaccttccgtaggtatagtactagtaattacgttacgtaacggttcgggtcgaaccggaacgccggtaccgtcggtacgtaccggtccggtgtacggtaggtggtacggtcggtaacttaacgttaacgtaccgtaacgttaacggtaaggacggaacgtggtacggtacgtaagtgtcggacggtagggaccggggttacgggtccgggtaagtcgtacgttccgacgtaacgtaccggtacgtacgtaccgtaacctaccgtaacccgtaacgtaccgacgtacgtaccgtaacggtaggtacggtaggtaccggagtcgtaaaggtacttacggtagtacgtccggtacgttcgttccgtcgggaggtcggtaccgggngtaggtagtaggtagttacgtagtacgg

SEQ ID NO: 229900 - DNA, 620 bp, Homo sapiens
  misc_feature: GYAE6OF02IL7CW.23.35.D02.1.454.CMB.1.raw
tcagacgcgagtatcacgaccggtgctcgatttagcacacgatagttgggtttgggggagcatcactcaacaaccacatctgtcctctagagagaaccctgtgagcacagctcctcaccatggactggacctggaggatcctcttcttggtggcagcagctacaggttcccactcccaggtgcagcgtggagcagtcgtgggactgagctaggaagagccgtggggccgcaggtggagggtcctccgtgacgaaggtctcgtacggaaacactacttccgtagatgatgatatcgtaagttgggtagacgaacgcggacctacgtcggacgtccggtcgtaggagtggagtcggactatacgtaccgaccgtaagtaggacggacagtcggacggtactagtcgacgagacgggtacgggtacgggacgaggtacgtaccgtacacgtacgaccgtacggaccacgaccgtaccaacgtacgaacgacgtacctagacgtaggtacggacgggacggtcgagtacgtacgttacgacgtaacggtaccggttccgtttacttacggacggtaccggacggggtacgggtccgtagtaaggttagtacggttagtaacggg

SEQ ID NO: 229901 - DNA, 887 bp, Homo sapiens
  misc_feature: GYAE6OF02FWEBQ.23.35.D02.1.454.CMB.1.raw
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcgttggtggcagcagctacaggttcccactcccgaggtgcagctggacgcagtcttaggactgacgctagaagaacgccgtggggccgcaggtgacgggtcctccgtgacgtaaggtcctcgtacggaaacacgtacttccccgtagtacttggaacttaggtaattaacgtacgttaaacggtttcgggggttacgacccggtaaacggacgggtaccccgtaacggttacggggtaaccccgttccgggtacccgtttggtaacgggttagggttacggtcggggtaccttaacgtaacgtttaccggaaccccgttaaaggtttaacggacgggtacctaagggttccggaccgggtacgttacgtacggacgtaagggtaacgggtacgggggtttaccggggacgtaacgggtacgttacccgtacgtaagttaccggtaccgtacgggtaacctaccgtaaccgtacccgaaccggttaaccgttaaccgaaccggttacccgtaaacgtacgggttaacgggtaacgggttacggggtaaccgggggtaccgtttaaacgggtaaccgtttaacggttttaaccgggtaaaccggtaaccccgggttacccggggttttaacccgttttttaaccggttaccgggttacccgggtacccggggttaacggggggaacccggggttcgggttaacgggtacggtttaacgggtttaacggtttaaggtttaacgggg

SEQ ID NO: 229902 - DNA, 775 bp, Homo sapiens
  misc_feature: GYAE6OF02G5KZP.23.35.D02.1.454.CMB.1.raw
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagctggagcagtctgggactgagctagaagagccgtgggggccgcgaggtggagggtctccgtgcaaggtctcgtggaaacacattccctgatgatgatatcaagttgggtgcgacacggccacgtagggactcgggtccttggaggtggagtcgggcttaacgagttaacgacccgtaaagtttacgggaggtacgtaggttcgggaccgggtaaccttaagttggaccgaagggtaacgggtaccgggggtttaccccgggggacaacggggtacgtttacccgtacccgtaaggttacccggaacccggttagggggaaaccctaaccgtaccgttaccccgaaaccgtaacccggtaaccgtaaccgtacccgttaaacgaacgggttacggggtaaagggttacgggggtaaccgggggtacccgttagggtaacgtttaaccgtttaaccggaacgggttaacccggtaacccgggggtttaccccgtttttaaccgttcggttacggggacccgggtaacggggggtaccggggggtacggttacggtacgggtttaacgggttacggttttaaggttaaccgggg

SEQ ID NO: 229903 - DNA, 684 bp, Homo sapiens
  misc_feature: GYAE6OF02GQBEW.23.35.D02.1.454.CMB.1.raw
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagctggagcagtctgggactgagctgaagaagccgtggggccgcgagtggacgggtctccgtgcaggtctctggaaacactacttccgtgagtgatagatatctaagtgggtcgacgacgacggacctacgtggacgtccggccttggagtggagtcggactacaattacgaccgtaagttacggaggacgaggtacggaccgggtaacttacggtaggacggaagggtaacgggtacccgggggtttccgggggaaccgtaacgggtaccgttaccgttacccgtaggttaccggtacccggtacgggtacccgaaccgtacttacccgaacgtaacccgttaacgaaccgttaaccctaacgtacggttagggaacgggttgggaccggggtccgtaggtaacgtacgttacgaacgaccgtaccggttaccgtttaccgttcgtcggaccggtcgggaggggttaccggtaggtaggtaggtaacgttaggttaacggg

SEQ ID NO: 229904 - DNA, 728 bp, Homo sapiens
  misc_feature: GYAE6OF02JQ81H.23.35.D02.1.454.CMB.1.raw
  modified_base (199)..(199): a, c, t, g, unknown or other
  misc_feature (199)..(199): n is a, c, g, or t
  modified_base (215)..(215): a, c, t, g, unknown or other
  misc_feature (215)..(215): n is a, c, g, or t
  modified_base (234)..(234): a, c, t, g, unknown or other
  misc_feature (234)..(234): n is a, c, g, or t
  modified_base (289)..(289): a, c, t, g, unknown or other
  misc_feature (289)..(289): n is a, c, g, or t
  modified_base (305)..(305): a, c, t, g, unknown or other
  misc_feature (305)..(305): n is a, c, g, or t
  modified_base (314)..(314): a, c, t, g, unknown or other
  misc_feature (314)..(314): n is a, c, g, or t
  modified_base (329)..(329): a, c, t, g, unknown or other
  misc_feature (329)..(329): n is a, c, g, or t
tcagacgcgagtatcacgaccggtgctcgatttagcacacgatagttgggtttggggagcatcactcaacaaccacatctgtcctctagagagaaccctgtgagcacagcctcctcaccagtggactcggacctgggaggatccttcttcttggtggcagcagctacaggttcccactcccaggtcgcagcgtggagcngtctgggactgagtcngaagacgccgtgggggccncaggtggagggtctccgtggacaacggtctcgtacggaaaccgactacttccccngtatgacgtagatatnaagttgggncgacgacggtccgancggacgtcggtccttggacgtgggtacgtgggaccttacttaagtacgacccgttaaattacggacgggtactaagggttccggcgggtaaaccgttacggtcggtaacggagggtaacgggtaccggggttaccggggcggaacgggtacgttacgaccgttaacgacggtacccgtacgggtaccgaacgtaccgtaccgaccgtaacggaccgttaacggcccttacgtacgtaggggtaaccggtacggggacgggttacccgacggttaagggtaaccttttacggaaccgttacccggtacgggtaaaccctttttccggttaaccggtccgggcgggtacgggtacgggggttaccgggtaggtaacggtacgggttagttaagggtaccgg

SEQ ID NO: 229905 - DNA, 669 bp, Homo sapiens
  misc_feature: GYAE6OF02GTPFG.23.35.D02.1.454.CMB.1.raw
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttgggtggcagcagctacacggttcccactccctagggtgcagcgtggacgcagtcgtgggactgagctagaagaacgccgtggggccgcgaggtggacgggtcctccgtgacgtaaggtctacgtacggaaacacgtacttccctgatgagtagtaattagtacgtaaggttgggtcgacggacgacggccgtacgtacggtacgtcggtcgtaggaggtaggagtcggtactacgtacgttacgaccgttaaagtacggaggacgtacggtcggtacggtacgtagtacgcggtaaggtacgggtaccggggttaccgggacgtaccgggtacgtcctacgtacgttaccggaccgtacggaacctaccgactaccgaacacgtaccacgaccgtagacggtagggtacggtacggacggttcgtacgtaaggtactaacgacgtaccggtaccggtttacgttaccgtcggtcggtacggtacgggcgggtacgtacgtaggtacgttaggtacgttacgg

SEQ ID NO: 229906 - DNA, 750 bp, Homo sapiens
  misc_feature: GYAE6OF02FJMUJ.23.35.D02.1.454.CMB.1.raw
  modified_base (181)..(181): a, c, t, g, unknown or other
  misc_feature (181)..(181): n is a, c, g, or t
  modified_base (227)..(227): a, c, t, g, unknown or other
  misc_feature (227)..(227): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtncagctggagcagtcgtgggactgagctgaagacgtccgtggggccncgagtggacgggttcctccgtgacgtaacggtctcgtaggaaaccactacttcccctgatgatgatatcgtaagttgggtgacgacaggccacgtcggacgtccggtccttggagtgggactcgggtacctacgtagttaccgaccctaagttacggacggtccgtaagggttccggaccggtaacgttagtcgaccgtaacgggtacgggtacgggggttaccggggtaccgtaacgggttaccggttcctaacccgtaacgttaccgggaacccggttcggggtaacctaaccgtaaccgtacccaacgtacccgtacgaaccggttcccgtaacgtacggttacgggtaaacggttacggggaccggggtccttaagggtaacgttaaccggttttaaccaaccgggtacccgtacgggtttaaccccggttttaccgttaccgggtacggtcccgggtaacggggtacggggggtccgttagggtaaccgttagggttaagggttttaacgttaacggg

SEQ ID NO: 229907 - DNA, 835 bp, Homo sapiens
  misc_feature: GYAE6OF02H229G.23.35.D02.1.454.CMB.1.raw
  modified_base (183)..(183): a, c, t, g, unknown or other
  misc_feature (183)..(183): n is a, c, g, or t
  modified_base (333)..(333): a, c, t, g, unknown or other
  misc_feature (333)..(333): n is a, c, g, or t
tcagacgcgagtatcacgaccggtgctcgatttagcacacgatagttgggtttggggagcatcactcaacaacacatctgtcctctagagagaaccctgtgagcacagctcctcaccatggactggacctggaggactccttcttcttggtcggcagcagctacaggttcccactcccaggtncagctggaactgtacgtggtcgtagagagtcgtaaggaagaccgtcgggccggggacctaggtaggtcggggtcgttccgtccggcgtaacggttacgttacgtaacggtaaaaacgaaacctttccctagtagtacggtatagtaagtnttaactaaggttaggtacggccgaacgtacggacgtaccgacgggtacggttaccgtcccgttagtaggtacggacggttcggtacggtaccctagtacgtaacccgtaactaaggtaggacgtaagtcggaacggttaccgagttaacgacggtaaggtaacggttacggggtaccggggtacggtccggtaacgttaccgtaaccgtcgtaaccggtaccggtaaccgggacgtaacctaaccgtaaccgtaaccgtaaccgacgtaaccgtacctagtaaccggttaagtaaccgggtgggtaacccggggtacggtaccgttaacggtaacgtttaccgtaaacgggtaaacccgttaccggttttacccgtttaccccgggtttaacgttacccggggtcccgggttaaaccgggggtaaccggggggtcgtttaaccgggggtaagttttaccgggttaaaggttttaacgggttttaccggtagggttaaccggg

SEQ ID NO: 229908 - DNA, 754 bp, Homo sapiens
  misc_feature: GYAE6OF02G5HD9.23.35.D02.1.454.CMB.1.raw
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagctggagcagtgtgggactgagctggaagtacgccgtggggccgcaggtggagggtctcctgcaaggtctctaggaaacactacttcccgtgagtgaacgtagtatactacgtaagtttggggttacgtaggaccgtacgggacccgtacgtacgggtaccgttccgggtacccgtttaggagggttagggtacggttacgggtacctaacgtaacgtttaccggaacccgttaaagttaaacgggacggtaacgtacgggtacggggtacgggtaacccttagggttacggaccggtaagggtaacggggtaaccgggggtttacccggggacgtaaacgggtacggttcccgtacccggtaacgttacggtaacccggtacggggtaaccctaaccggtaacgtaccccgtaaccggtaaccgtaaccgtaccgtaacccgtaacgaaggtacggggtaaacgggtcgggtacggggtacgtaggtacgttacgttaacgacgtacggtacccgttcggttaccgttgtcggcggacgggagggtcggtgtagtaggttagtagtacgg

SEQ ID NO: 229909 - DNA, 644 bp, Homo sapiens
  misc_feature: GYAE6OF02F928Z.23.35.D02.1.454.CMB.1.raw
  modified_base (608)..(608): a, c, t, g, unknown or other
  misc_feature (608)..(608): n is a, c, g, or t
tcagacgcgagtatcacgaccggtgctcgatttagcacacgatagttgggtttgggggagcatcactcaacaaccacatctaaaaagtcctctagagagaaccctgtgagcacagctcctcaccatggactggacctggaggatcctcttcttggtggcagcagctacaggttcccactcccaggtgcagctggagcagtcgtgggactgagctagaagagccgtcggggccgcgagtggacgggtctccgtgcaaggtctacgtaggaaacactacttccctgatgatagatatactaagttgggtcgaccgacgacggccagtcggtaccgtcggtccgttaggaggtgggagtcgggactacgagttaacgaccctaaagttacgaggtataggtcggacggtactagtcgacgtaaggacgggtacgggttccggggacgtaggtacgttacctaccgtagtccggaccggtacgggaacctaacaccgtacccgaacgtaacccgtaacgaccgtacctaacgtacgtaagggtaggtcgggaacgggtcctaggacgtacttagacggtacgaccggttaccgtttactcggtcggtacggngggtacgggtcggtagtagtaggttagttagtacgg

SEQ ID NO: 229910 - DNA, 663 bp, Homo sapiens
  misc_feature: GYAE6OF02JG9UI.23.35.D02.1.454.CMB.1.raw
  modified_base (180)..(180): a, c, t, g, unknown or other
  misc_feature (180)..(180): n is a, c, g, or t
  modified_base (226)..(226): a, c, t, g, unknown or other
  misc_feature (226)..(226): n is a, c, g, or t
  modified_base (522)..(522): a, c, t, g, unknown or other
  misc_feature (522)..(522): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtgcagcagctacacggttcccactccaggtncagcgtggagcagtcgtggactgagctagaagagccgtaggggccncgaggtggaggtctccgtgacgtaaggtctcgaacggaaacacgtacttccgtagagttacgagtagtaattattaccgtaaaggttgggaccgtacggaaccggtacggaccgtaccgtagggtaacccgttccggtaccgtttagggaacggttgggacgtccgggtacttaacggtacgttaccgaaccgtaagtacggaagtcgtaaggtcggacgtaacgtgacggtacgtaaggcggttacggggtccgggactacgacgtccgtacgtagtccggaacgtggacctacnccgtacacgtaaccgacgacgtaccgtagagtacggaacggtgacggtcagtacgtactacgacgtacgtaccggttacttacgtcggtaacggtcgaacgggttcgggcgttagtacggttaacggttaggttagtcggg

SEQ ID NO: 229911 - DNA, 681 bp, Homo sapiens
  misc_feature: GYAE6OF02GL965.23.35.D02.1.454.CMB.1.raw
  modified_base (226)..(226): a, c, t, g, unknown or other
  misc_feature (226)..(226): n is a, c, g, or t
  modified_base (343)..(343): a, c, t, g, unknown or other
  misc_feature (343)..(343): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagctggagcagtctgggactgacgctgaagacgccgtggggccncaggtggacggtctccgtgcaaggtctcgtaggaaactactacttcctagatcgatgtatatataagttgggtacgtacgacgaccggacgtacgtcggacgtccggtccgttaggnggtacggtagtcggacgtactacgttacgacctaaggttacggaggtccgaggtacgacggtaactagtacgacgtaagggacggttacggggtccgggaagtacggtacggttctaaccggtagtccggtaaccgtgggtaaccaccgtaactacccgtaacgtaccgtaacgtacgtaccgtaacgtacggtaacgggaaggtacggggtaaccggtcccgtaaggttaacgttacgttaaccgacgaaaccggttcccggttaccggtttaacgtccggtaacggcgggtacgggaggggttaccgtagtaacggtagttaggttaacgtaacgg

SEQ ID NO: 229912 - DNA, 731 bp, Homo sapiens
  misc_feature: GYAE6OF02JJRGW.23.35.D02.1.454.CMB.1.raw
  modified_base (339)..(339): a, c, t, g, unknown or other
  misc_feature (339)..(339): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagctggagcagtctgggactgagctgaagaagccgtggggccgcagtgaggggtctcctgacaggtctctaggaaacacgtacttccctgatgatgatatcaagttgggtagcgtacgaggccacgtacgggtacctcgggtccttggacggtaggngttcggggactaacgtagttacgaccctaaagttaaggacggacgtaacggtcggtacggtaacgttaagtcgtacgtaacgggtacgggtacggggtttaccggggacgtaacggtacgtccgtaccgtacgtacggtaacccgtacggggaacctaacgtaccgtaacccgtaacgaacccggtaccgaacggtaccgtaacacggtaacggggtaaacggttacggggtacggggtacccgttagggtaacgttaacgtttaccggtaacggtaaccggtaccgggtttcccggttttaaaccttccgggtaccggacccgggtaaccggggacgggggggttaccggtaacggttaggttaacgggttaacggtttaagttaacgggg

SEQ ID NO: 229913 - DNA, 543 bp, Homo sapiens
  misc_feature: GYAE6OF02IPD8L.23.35.D02.1.454.CMB.1.raw
  modified_base (365)..(365): a, c, t, g, unknown or other
  misc_feature (365)..(365): n is a, c, g, or t
  modified_base (370)..(370): a, c, t, g, unknown or other
  misc_feature (370)..(370): n is a, c, g, or t
  modified_base (425)..(425): a, c, t, g, unknown or other
  misc_feature (425)..(425): n is a, c, g, or t
  modified_base (433)..(433): a, c, t, g, unknown or other
  misc_feature (433)..(433): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagctggagcagtcgtgggactgagctgaagaagccgtgggggccgcagtggagggtctcctgcaaggtctctggaaacacattcccctgatgatgatatcaagtttggggtgcgacaggccactggactcggccttgagtggatgggctacattacgacctaagttagaggcagtgacgatangcagnggtagggtcgggacaggacgtctccgagtcgaccgtggacacactccacacgacncgacctanacgtaggaacgtggacgggcgtagagtattacgacgacgtaccgggttccgtttaccgttcgtcgacggtacggtacgggggcgttcggagttaggtagtttagtacggg

SEQ ID NO: 229914 - DNA, 616 bp, Homo sapiens
  misc_feature: GYAE6OF02J0ITN.23.35.D02.1.454.CMB.1.raw
  modified_base (582)..(582): a, c, t, g, unknown or other
  misc_feature (582)..(582): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggactcctcttcttggtgcagcagctacaggttcccactccaggtcgcagtctggagcaggtctgggactgagctaggaagagccgtacggggccacgacggtggacgggtcctccgtagcgtaacggttctcgtaggaacgtactaacttccccgtgagtgtaagtcgagttactgaaaggttgggtacgtacggacgacggacctacggtcggaacgtcggtccgtaggtagtcggtagtggactacgtattacgacctaagttacggagtcgaagtcggcggtatagtcgacgaggaggtacggtcgggacgtagcgtcgtaccgtatcggtacgtacggactacctacgtccaaacgtccgtaacctacgtctaccgatacggacgtaggacggtacgtgtaacgtacgtacaggtacgacggtccgtttactcgttcgacggngggtacgggcgtagagtacggttatagttacggg

SEQ ID NO: 229915 - DNA, 711 bp, Homo sapiens
  misc_feature: GYAE6OF02I4EFL.23.35.D02.1.454.CMB.1.raw
  modified_base (186)..(186): a, c, t, g, unknown or other
  misc_feature (186)..(186): n is a, c, g, or t
tcagacgcgagtatcacgaccggtgctcgatttagcacacgatagttgggtttgggggagcatcactcaacaaccacatctgtcctctagagagaaccctgtgagcacagctcctcaccatggactggacctggaggatcctcttcttggtggcagcagctacgaggttcccactcccgtagggtncagcgtggagcaggtcgtgggactggagcgtgaagaagccgtcgggggaccgcaggtggacgggtcctccgtgacgtaggtctcgtaggaaacacgtacttcctagacgtgagtagtatagtactaggttgggtacgacgacgcggacgtacgtcggtacgtccggtaccgttggacggtaggtagtcgggtactacgtaagttaccgacctaaggtaggtacgacggtggtacggcggtacgtcgtagacggtaaggacgggtacggggtaccgggtagacggtaagtcccgtacgtaggtaccgtacggtaccggtaacgtacgaccgttaccgaccgtaaccgtacgtaacccgtaccgtagtaacggtacgggtaaacggtcggggtaccgggtcgtaacggtagttaacgtaacgaaccggtacggttacccggttacccggttttaccgttcggtaccggcgggttaacggggcgggggtcctagggttagtaacgggtttacggttaggttaaacggg

SEQ ID NO: 229916 - DNA, 748 bp, Homo sapiens
  misc_feature: GYAE6OF02HRFXJ.23.35.D02.1.454.CMB.1.raw
  modified_base (190)..(190): a, c, t, g, unknown or other
  misc_feature (190)..(190): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagctggancagtctgggactgagctagaagagcctggggccgcgagtgagggtctccgtagcaaggtctcgtaggaaaccacattccccgtagacgttgaatgaattacttaccgtaaagtttggggtacgcggaaccgtacggaccccaacgtttgggaacccgttccgggtaccctttagggaacgggttggtaacgtcggggtacccttaacgtaagttaaccgacccgtaaagtttaggacgggtactagggttacggaccgggtacttacgtacggtacgaacggggttacggggtaaccggggttttaccccggggggacgtaaacgggtacggttacccgttaccggtaacgttaccggtaaccggttcgggaacctaacgaccttacccgaacgtaaccgtaacgcgtacccgttacgaagtacgggtaaaggtcggggaacgggtccgtaggaacgttaacgttacgaacgtaccgaacgggtcccttaagttttaccgtacgtcggtacggacggggtacggggcgtttacggtaagttacggttagtttaaacgg

SEQ ID NO: 229917 - DNA, 646 bp, Homo sapiens
  misc_feature: GYAE6OF02F9I2I.23.35.D02.1.454.CMB.1.raw
  modified_base (225)..(225): a, c, t, g, unknown or other
  misc_feature (225)..(225): n is a, c, g, or t
  modified_base (258)..(258): a, c, t, g, unknown or other
  misc_feature (258)..(258): n is a, c, g, or t
  modified_base (266)..(266): a, c, t, g, unknown or other
  misc_feature (266)..(266): n is a, c, g, or t
tcagacgcgagtatcacgaccggtgctcgatttagcacacgatagttgggtttgggggagcatcactcaacaaccacatctgtcctctagagagaaccctgtgagcacagctcctcaccatggactggacctgggaggatcctcttcttggtggcagcagctacaggttcccactcccaggtgcagctggagcagtctgggactgagctgaagagcctggggccncagtgagggtctcctgcaaggtctctggaaacncattcccngatgatgatatctaagttgggtgcgacaggccacgtggactcggccttggagtggagtggactacgtattacgacctaagttaggaggacagtgacggtactagtgcgaagaggtacgggttccggggactaggagttcctaccgtaagttacggaccgtagggactaccgacgtacccaacgtacgtaccgacggtaccctaacgtacgtacgggtaaggttacgggacggggtacccgtaggtaacgtacgttttaccgaacggtaaccggtacccgggttaccccggttttaaccgttcccggttacggtacccggtaccggggtacggggggttaccgttacgggtacgttaggttacggtttaaggttaacgggg

SEQ ID NO: 229918 - DNA, 564 bp, Homo sapiens
  misc_feature: GYAE6OF02GFFCG.23.35.D02.1.454.CMB.1.raw
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagctggagcagtctgggactgagctgaagaagccgtggggccgcagtgagggtctcctgcaaggtctctggaaacacattccctgatgatgatatcaattgggtgcgacgaggccaacgttggaccttccgggtccttaggacgtggagtgggctacattacgccctaaattaggaggccaggtgacggactagtgacaggaggtagggttccgggcgtagacgtctccgagtcggacccgtgggaactacgactcccaacaccgtacgacgaccctacagtggaaggtcggacggggcctaggagtagttacgaagaccgacggttccgtttacttccgtggcgtcggacggggtccggtaggagtgttaggttagtacgg

SEQ ID NO: 229919 - DNA, 690 bp, Homo sapiens
  misc_feature: GYAE6OF02G4YY6.23.35.D02.1.454.CMB.1.raw
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcaggctacaggttccccactccccagggtgcagctggagcagtctgggactgagctgaagagccgtggggccgcgaggtggaggggtcctccgtgctaacgggtctcgtaggaaaacctacactttccccgaggaattggaacttggaattacgtacgtaaaggtttggggtacacggtaaccgacggggccctaacgtcgggtacctccgggtccttaggagttgggacgttggacctactagttaccgacctaagttagacggctagtgacggtactagtgacgtaggacggtacggggttccgggactacgggtacgtccgtacgaggtccggtaccggtagggaccactacgtacccacgtacgtaccacgtaccctaagacggttacgggaacggtacgggaccgggccgtaaggagttacgtttaccgaacggtacccggtacggtttacccgtttaccgtaccggtggacccgggttaagggggacgggggtccggtaggtaggtttacggttacggttaaggtacgg

SEQ ID NO: 229920 - DNA, 618 bp, Homo sapiens
  misc_feature: GYAE6OF02FQROW.23.35.D02.1.454.CMB.1.raw
  modified_base (225)..(225): a, c, t, g, unknown or other
  misc_feature (225)..(225): n is a, c, g, or t
  modified_base (243)..(243): a, c, t, g, unknown or other
  misc_feature (243)..(243): n is a, c, g, or t
  modified_base (273)..(273): a, c, t, g, unknown or other
  misc_feature (273)..(273): n is a, c, g, or t
  modified_base (300)..(300): a, c, t, g, unknown or other
  misc_feature (300)..(300): n is a, c, g, or t
  modified_base (399)..(399): a, c, t, g, unknown or other
  misc_feature (399)..(399): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagctggagcagtctgggactgagctagaagaagcctggggccncgagtggagggtctccgngacgaaggtctctaggaaacacacttcccngagtgatgactatcaagtggtgcgacncgccacgtggactcggtccgttgaggtggagtgggctacgtacgttacgacctaagttaggaggacgtagtcggcggtactagtcgacgtaggaacggngggttaccggggacgacggtacggtactccgtagtacggaccgtacggacgacctacgtacccgaacgtaccgtaaccgacgtaccgtaacgtacgtaagggtacgacgggtaccggtacgtacgagtacgtttacggaagtaccgtacggttccgtttaacgttcgtacggtccgggacgggtacggggacggttggtaagtggttaagtagttacgg

SEQ ID NO: 229921 - DNA, 856 bp, Homo sapiens
  misc_feature: GYAE6OF02G92SF.23.35.D02.1.454.CMB.1.raw
  modified_base (236)..(236): a, c, t, g, unknown or other
  misc_feature (236)..(236): n is a, c, g, or t
tcagacgcgagtatcacgaccggtgctcgatttagcacacgatagttgggtttggggagcatcactcaacaaccacatctgtcctctagagagaaccctgtgagcacagctcctcaccatgactggacctggagatcctctcgttggtgcagcagctacgaggttcccacctcccgaggtgcagtcgtggagccaagtcgtagggactggagctagaacgacgccgtaggggcccncgtaggtcggacgggtcctccgtaggaccgaacggttcgtacgttacgggaaaacctaccgttaacgtttcccccgtaggtacgttacggtagttacgtaaacggttactaccgttaagggtttacggggttcggaccggtaaccggaacgggtacccctaacgggtttaccggaacccggtttccgggtaccccggttttggaaccggggttgggtaaccggtcgggtaaccgttacgtaacgttaccggtaaccccgttaaaggttaaccgggagggttaaccgacgggttacggaacgggtaaccgttacgtacggtaccgaagggttacggggtaacccggggtttcgggaacccgtaaggtacggttacccgtaccgtacgggtagttacccggtaaggaaccgtacgtaaccgtacccgacgtaaccgtaacgtaccgtaccgtaaacgtagtacccggggtaagtcgggtacgggtacccggttagtaacggttaacgttaccgtaacgggccgttaacccgggttaccgttttactaccggttacgggcccgggttaacggggcggggtaccggttagaaccgggttaggtttaacccggttattaacgggg

SEQ ID NO: 229922 - DNA, 720 bp, Homo sapiens
  misc_feature: GYAE6OF02IQYAN.23.35.D02.1.454.CMB.1.raw
tcagacgcgagtatcacgaccggtgctcgatttagcacacgatagttggggtttgggggagcatcactcaacaaccacatctgtcctctagagagaacccctgtgagcacagctcctcaccatggactggacctggaggatcctcttcgttggtggccagcagctacacggttcccactcccgaggtgcgagcgtggagctagtcgtgggactgagctagaagacgccgtggggccacgaagtcggagggttcctccgtgctaaggtcctacggtacggaaacacctacttccccgtagatacgattagacttaacgtacgtaagttcgggtagaccgtaacgacggccagttacggacgttaccggtaccgttaggtacgggtaagtcgggtacggtaccgttaactacggttaaccgtacccgttaaagttacgggacggtacgacgttacggaccggttagtacggtacgcggaaggtacggggtacgggtaccgggtagacggtacgtacgtccgtaagtacggtaccgtaggtaaccacgttacaaccgtactacgacgacgtaccgacgaggtaggaggtacgggacggccgtaaagtccgtaacgtttaacacggtaaccgttccgggtttaccgtttaacgtgttacccggtacggggacgggttcggggtacggttacggtacggttacggttaacgttaggttaaccggg

SEQ ID NO: 229923 - DNA, 703 bp, Homo sapiens
  misc_feature: GYAE6OF02I69GK.23.35.D02.1.454.CMB.1.raw
  modified_base (163)..(163): a, c, t, g, unknown or other
  misc_feature (163)..(163): n is a, c, g, or t
  modified_base (182)..(182): a, c, t, g, unknown or other
  misc_feature (182)..(182): n is a, c, g, or t
  modified_base (201)..(201): a, c, t, g, unknown or other
  misc_feature (201)..(201): n is a, c, g, or t
  modified_base (214)..(214): a, c, t, g, unknown or other
  misc_feature (214)..(214): n is a, c, g, or t
  modified_base (235)..(235): a, c, t, g, unknown or other
  misc_feature (235)..(235): n is a, c, g, or t
  modified_base (249)..(249): a, c, t, g, unknown or other
  misc_feature (249)..(249): n is a, c, g, or t
  modified_base (263)..(263): a, c, t, g, unknown or other
  misc_feature (263)..(263): n is a, c, g, or t
  modified_base (660)..(660): a, c, t, g, unknown or other
  misc_feature (660)..(660): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggagatcctcttcttgggtgcagcagctaacnggttcccactcccaggtcncgacgctggaagcagtcgngggactgacgtcngaagaacgtccgtggggccanaggttggagggtcncgtgcgtaacggtntcgtacggaaacacgtacttacccgtagagtagatacgattagtacgtaagtggtcacgagcggaccgactaggaccctacggtccgtaggtaggtaggtaacgtacgggtacttaaccgtagtaccgtaacccggtaaagtttacggacgtaccgtaaggttcggacccgggtaattactacggggcgaaacgggtacggtaaacggggtcccggggtaaccgtaaacggtccgggttaactaccggtacgttaaccgggtaccgtaacggttacaacgaccgttacgaaccgtaccgtacaacgtcctaagtacgacggaacggtagaacccgggtgttataaacgtacggttaacgtaggaacgtaacgtcccgttttagtaccttagaccggngggttaacgggccgtaaggtagaccggttagttacggtaacgg

SEQ ID NO: 229924 - DNA, 744 bp, Homo sapiens
  misc_feature: GYAE6OF02H8O0O.23.35.D02.1.454.CMB.1.raw
tcagacgcgagtatcacgaccggtgctcgatttagcacacgatagttgggtttggggagcatcactcaacaaccacatctgtcctctagagagaaccctgtgagcacagctcctcacatggactggacctggaggatcctcttcttggtggcagcagtctacacggttcccactcccgaggtgcagctggagctagtcgtgggactggagcgtaggaaaggaacggcccgtcgggggaccgacggtaggtcgggaggggttcctcccgtaggacggaacggttctccggtaaggaaaaccacctacttccccgtgacttgataggtaattatacgaaggtttgggtgacggtacgaggccaggtcggaccgtcggtccgtaggacggtacggtagtaggtcctaagttacgtacgaacccgtaaagttacgggaacggtcgtaacgtcgaccggtatacgcggtacggagggtacgggtaccggggttaccggggcaacgggtacgtctaccgtaggcggtaaccggtcgaacgtcctaacgtacccgaaccgtaccgtaacacgtaacccttacggtacgtaacggggtacgtacggggtacgggtaccgtaacggaacgtttacgtaaccgtaaccgggcgttaacccggtttccggttttaccgtaccggtccggggttaccggacggggtcggggttaccgtaagggtacggttaggttaaaccggttaggtttaccggg

SEQ ID NO: 229925 - DNA, 879 bp, Homo sapiens
  misc_feature: GYAE6OF02GWNR8.23.35.D02.1.454.CMB.1.raw
  modified_base (181)..(181): a, c, t, g, unknown or other
  misc_feature (181)..(181): n is a, c, g, or t
tcagacgcgagtatcacgaccggtgctcgatttagcacacgatagttgggtttgggagcatcacttcaacaaccacatctcgtcctctagagagaccctgtgagcacagctcctcaccatggactggacctggaggatcctcgttctggtgcagcagctacaggttcccatcccaggtacnccaggcctggacgctacggttcgtacgggactggaagcgttacgaacgaacgtccggtggggaccccgtgtaaggtacggtaacgggttcctaccgtagtcgtaaaccgggttctaccggttaacggaaaacccttacggttaaccgttcccccgtaggtaacgttacggaaccgtttaggtaaccgttaacgttaaccggttaaaaggtttggggttaaccgtaccgaaacccggtaacgggtacccgacgttaaccggggtaacctcgggttaccgttaaggtaaccgttcggggtaaacttccggggtaccttaaacggtaacccggttaccgggtaaaccctttaaaggtaacgggacggtacggtaacgtgggtaaccggtaaccgttaggttccgaaacgacggggttaacgggtacggggttaacccggacgtttaaagggccggtttacccgtacgaaacgggttccgtaaccgggtaacggtaaacccgacgttaccgtaacccgaccgtaaacccgaggtaccctaaacccggtaggtaccggtagggaaggttaccgcgggtaaaccgttggacgttaaccgttaccgaggtacccggttaacccgtttaacggttcctttaacggacccggccggtaacgggggacgggttaccacggtttacgaaggtttacccttaagggtcgg

SEQ ID NO: 229926 - DNA, 618 bp, Homo sapiens
  misc_feature: GYAE6OF02IIZ6B.23.35.D02.1.454.CMB.1.raw
  modified_base (301)..(301): a, c, t, g, unknown or other
  misc_feature (301)..(301): n is a, c, g, or t
  modified_base (328)..(328): a, c, t, g, unknown or other
  misc_feature (328)..(328): n is a, c, g, or t
  modified_base (332)..(332): a, c, t, g, unknown or other
  misc_feature (332)..(332): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagctggagcagtctgggactggagctgaagaagccgtcggggccgcaggtggacgggtctctgacaacggtctcgtaggaaacctacacttcccgtgatgatagatatctaagttgggncgacgaggctagtggctcggtcgtggngtgngtggtcatatacgaccaattagaggtctagcgcggactagtgcaagtcggtacgggtcgggcgacgtagtctaccgtacgtacggtaccgtacggggactacgtactaccgaaccgtacgtaccgaccgtacgtacgtaacggtacggaggtacgggacgggttaccgtaggtaacggttaagttacggaacgtacccggtaccggttacccggtttaaccgttcggtccggtcgggacgggtaccgggggtcgtaggtacggtaaggttaacggttaggtacggg

SEQ ID NO: 229927 - DNA, 736 bp, Homo sapiens
  misc_feature: GYAE6OF02HPEOF.23.35.D02.1.454.CMB.1.raw
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcgttggtggcagcagctacaggttcccactcccgaggtgcagctggagcagtcgtgggactgagctaggaagacggtcgtggggccgcgtaggtggacgggtcctccgtgacgtaaggtcgtacgacggaaactacgtaccttccctagaatgtagtagtaacttaacgtacgttaaaggtttgggtcggaccgtaaccggacggaccgtacggttacgggacccgttccggtaccgttggacgggtggtaggtacggtactacgtacgttacgaacctaagttaggacggtacgtaggtcggacggtactagtcggaacgtaagggtacgggtacgggtaccgggagaacggtcgtactaccgtagtaccggtaccgacggtacacctactacccgaagtccgtaaccgacgtaaccgtaacgtagtaccgggtaaggtacgggtaaccggggtcgtaggaacgttacgttaaccggaacgggttaccgtaccgggtttaacccggtttacgtaccgggtccggttaccgggacgggggttacgggggttcgttaacgggttaggttaacggttaggtttaagggtacggg

SEQ ID NO: 229928 - DNA, 680 bp, Homo sapiens
  misc_feature: GYAE6OF02G3BTT.23.35.D02.1.454.CMB.1.raw
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagcgtggagcagtcgtgggactgagctagaagaagccgtcggggccgcgaggtggagggtcctccgtgacaaggtcctacgtacggaaacacgtacttccctagactgatagaatatacgtaagttggggtacgcgtacgacggtccagtcggacgtcggtcttggacgtggacgttcggactaacgtagttaacgacccgtaagttacggacggtacgaggtcggaccggtactagtgacggaggaacgggtacgggtcccggggagtacggtacgtccgtaccgtagtaccggtaccggtacgggaacctacgaaccgtacccaacgtaaccgtaccgaacgtacccgtaacgtacgtaacggggaacggtacgggacggggtcctaggtaacgttacgtacggacggtaaccggtaccggtttacggtttaccgtccggtacggccgggtacgggtacggggttcgtacggtagtaggttacggttagtacgggg

SEQ ID NO: 229929 - DNA, 800 bp, Homo sapiens
  misc_feature: GYAE6OF02HULTK.23.35.D02.1.454.CMB.1.raw
  modified_base (201)..(201): a, c, t, g, unknown or other
  misc_feature (201)..(201): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatccctcttcgttggtggcagcagtctacgacggttcccaccttcccgaggtcgcagcgtggacncagtcgtagggaccgtgacgcgtagaaaggaacggtccggtacgggggcccgcgtaagggtcgggtacggggttcccttaccgtacggcgtaaacggttcctacgtaaggaaacctacctaaccgttcccgtagtagtagtacgttagtagtacgtaaccggtaaggtttcggggagtaccgaccggacggtcccgtaacgacggtacccggttccggtaccgtaggtacggttacggacgttacggtaacctacgttaacgtaaccggtaccgttaaagttaacgggaccggtaggtacggtaccggtacgtaacgttttaccgaggtaccgggtaagggtacgggtttacgggggttaccgtacggtaacggtcggtttaccaaccgtacgggtcccgggtaaacgtaccgggtaacaacccggttaacctaccccgtaaccgtaacccgtaaccggtacccttaacgtaaccggtagtacgggtaacggtgggaccggtagtacgtagtaccgtacgacggtaccgttaccgggtctttaacggcgtacggtcggcgggtacgggtactaggttaacgggtcttaggttatacggg

SEQ ID NO: 229930 - DNA, 1024 bp, Homo sapiens
  misc_feature: GYAE6OF02GKZQK.23.35.D02.1.454.CMB.1.raw
  modified_base (185)..(185): a, c, t, g, unknown or other
  misc_feature (185)..(185): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctgggaggatcctcttcgttggtggcagcagctacacggttcccactcccaggtcncagctggacgcagtcgtgggactggactctaggaacgacgccggtaggggcccgacgtaggttcggaacggggttcctccggtaggaccgtaaacgggttccttacggtaacggtaaaaacctaaccgttaaccgttttcccctaggtaaccgttaggaaacgtttacggtaacgttaaacgttaaccgtttaaacggtttcggggttacggacccggtaaccgaccggggtaaccgtaacggttacgggacccttccggggttacccgtttagggaacggttcggggtacggtttccggtaaccgttaaaccggttacttaaaccccgggtaccttaaaggtttaacgggaacccgggtacgttaggggttaacccggtaccgggtttaaacttaacgggtcgtaaaccgggtaacggggtaacgggggtaaaccgggtttccccggggggtaaacttcccggggtaaaccggttttacccgtaacgggttaacggttaacccggttaccggggttaaaccggtaacccgttaaacccgttaaccggaaccccggttaacccgtaaaaccggttaccgtaaacccgggttacccgttaaaaccggtaccggtttaacgggtaaccggggttaaccggggtaaccgggttaccggtaaaccgggttaagtttaaaccgttaacccgggtaagtacccccgggtttaaccgggtttaccccggtttttaaacggtccccgggttaccgggtaacggggtaccccgggggttaacgggggtttccgttaaaccggggttaacgggttaacggtttaaacccggttaggggtttaacccggg

SEQ ID NO: 229931 - DNA, 617 bp, Homo sapiens
  misc_feature: GYAE6OF02G14PL.23.35.D02.1.454.CMB.1.raw
  modified_base (223)..(223): a, c, t, g, unknown or other
  misc_feature (223)..(223): n is a, c, g, or t
  modified_base (256)..(256): a, c, t, g, unknown or other
  misc_feature (256)..(256): n is a, c, g, or t
  modified_base (264)..(264): a, c, t, g, unknown or other
  misc_feature (264)..(264): n is a, c, g, or t
  modified_base (491)..(491): a, c, t, g, unknown or other
  misc_feature (491)..(491): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagctggagcagtctgggactgagctgaagagcctggggccncagtgagggtctcctgcaggtctcgtggaaacncattcccngatgatgatatcaagttggtgcgacaggccacgtggacctcggccttggagtggagtcggctacgattacgaccctaagttacgaggtccaaggtgaccgggtacttagtacggacgaggacgggtacgggtttaccggggctaaggtacggttcctaccgtagttccggacccgttagggtaaccaaccgtacgttacccaaccgtaacgtaccacgtaccctaanacggtacggaacggtgggtacgggtcctaggtacgtacgttacgaacgtaccgtaccggtccgtttaaccgttcgtcggtccggagggtacgggggtcgtaggtacgtaggttagttagttacggg

SEQ ID NO: 229932 - DNA, 626 bp, Homo sapiens
  misc_feature: GYAE6OF02HGM1P.23.35.D02.1.454.CMB.1.raw
  modified_base (181)..(181): a, c, t, g, unknown or other
  misc_feature (181)..(181): n is a, c, g, or t
  modified_base (190)..(190): a, c, t, g, unknown or other
  misc_feature (190)..(190): n is a, c, g, or t
  modified_base (226)..(226): a, c, t, g, unknown or other
  misc_feature (226)..(226): n is a, c, g, or t
  modified_base (240)..(240): a, c, t, g, unknown or other
  misc_feature (240)..(240): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtncagctggancagtctgggactgagctagaagacgccgtggggccncagtgagggtctcngcaggtctcgtaggaacactactccctgatgatgatactacgtaagttcgggacgacgacgacggaccacgtcgggaccctcgggttccttaggacggtacggtacgtcgggacttaacgattaccggacctaaagtacggaggacgtagtcgacggtactagtcgacgtaggacggtacgggttccgggagtacggacgttctacgtacgtccggacgtacggacacgtactaccgaacgaccgtacgacgtaccctagagtacgggacgtacgggacggtacgtggaagttacgttacgacgtaccggtaccgggtccgtttaaccgttcgacgccgggtacgggtacggggttacttaggtagtttaggttacgtgggtaacg

SEQ ID NO: 229933 - DNA, 644 bp, Homo sapiens
  misc_feature: GYAE6OF02FZY3K.23.35.D02.1.454.CMB.1.raw
  modified_base (228)..(228): a, c, t, g, unknown or other
  misc_feature (228)..(228): n is a, c, g, or t
  modified_base (240)..(240): a, c, t, g, unknown or other
  misc_feature (240)..(240): n is a, c, g, or t
  modified_base (274)..(274): a, c, t, g, unknown or other
  misc_feature (274)..(274): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacaggttcccactcccaggtgcagctggcgcaggtctgggactgagctgaagaacgcctggggccacnggtgacgggtcnccgtgcaaggtctctaggaaacacgtacttcccngatcgatgatatacaattgggtagcgacacggccaacgtggaaccgtcggtacttggacggtcggagtcgggtactagtacgtacgccctaagttagacggagtaggtcgcggtaacgtacgtacggacgtaggaggtaccgggttccggggactaacgggtacttacgtacctagttaccggacccgtagggtacctaaccgtacgtacccacgacttaaccgagaccctacacgggtacgtaagtaccgggtagggtaccgtaaggtacgttaattaccgtaacgaccggtacgggtccgttttaacgttaccggtcggtacggtccgggaggggttcctaggtaggtacggttacgtttagtacggg

SEQ ID NO: 229934 - DNA, 752 bp, Homo sapiens
  misc_feature: GYAE6OF02F1A6Q.23.35.D02.1.454.CMB.1.raw
tcagacgcgagtatcacgaccggtgctcgatttagcacacgatagttgggtttggggagcatcactcaacaaccacatctgtcctctagagagaaccctgtgagcacagctccctcaccatggactggacctggaggatcctcttcttggtggcagcagctacacggttcccactcccaggtgcagcgtggagcagtcgtgggacgtgagctaggaagacgccgtcggggccgcgaaggtagaaacgtccaccgtcgacgaacggtcttacgaaggtaacctaccgtaccttaccgaacctaaatttgaactaactactaacggtcgggtacgaccggaccggtaccggaccccggtaagggaaaacgggtcgtacgggacggttagggtacggtcgggggtaggtcggggtagtaccggttacggttaggttgttacgggaagttaacggtacccggtacgtacgttctaacgtaaggtaacgttacgaacggtccgacggtcctaccggacgtacccgtacggtaacctaaccggtaaaccgtaacctaaccggaaagtaaaccggaacgtaccgtaccgttaagtttaaccggatacccggcgggtaccggcccgtacgtacccgttcgaacgtaccgtaccggtcggtaccgtttagttacgtttgtacggtcggacgggtacgacggggacgggtaccgtccgggttaggttacggtttagggaactttgttacggttggttacggg

SEQ ID NO: 229935 - DNA, 708 bp, Homo sapiens
  misc_feature: GYAE6OF02H1T9N.23.35.D02.1.454.CMB.1.raw
  modified_base (612)..(612): a, c, t, g, unknown or other
  misc_feature (612)..(612): n is a, c, g, or t
  modified_base (673)..(673): a, c, t, g, unknown or other
  misc_feature (673)..(673): n is a, c, g, or t
  modified_base (683)..(683): a, c, t, g, unknown or other
  misc_feature (683)..(683): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggactcctcttcgttgggtggcagcagctacgacgttcccactcccgaggtcgcagcgtggacgcgagtcgtgggactgagtcgtagaaggaacgtccggtacgggggacctcgtaaggtggacggtcctacgtgacgtaacggtctacgttaacggaactactacgttccccgtagtaacgtgtagtagtattacgtacgttaaggttttcggggacgacgtacgtacggacctacggtccgtactccgggtagttacggaggtacggtaggtccggtactacgtacgttacgtacccgtaagttacggacgtacgtacggtacggtaacggtatacgtaggacgtaggggaacggtaccggggtacgggactaacggtacgtcccgtaacgtcgaccggttacggaacggttacccaacggttacctaccgaaccgtacgtacccgacgtaccgttacgaggtacgggttaacggnggttaacgggctaaggacgttacgtagaccgtcgtaccggtttctacgttcggacgcgggngggtaacggntagttaacgtggtacttaggtacgg

SEQ ID NO: 229936 - DNA, 721 bp, Homo sapiens
  misc_feature: GYAE6OF02JXWZ2.23.35.D02.1.454.CMB.1.raw
  modified_base (164)..(164): a, c, t, g, unknown or other
  misc_feature (164)..(164): n is a, c, g, or t
  modified_base (228)..(228): a, c, t, g, unknown or other
  misc_feature (228)..(228): n is a, c, g, or t
  modified_base (245)..(245): a, c, t, g, unknown or other
  misc_feature (245)..(245): n is a, c, g, or t
  modified_base (281)..(281): a, c, t, g, unknown or other
  misc_feature (281)..(281): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcgttggtggcagcagctacnggttcccactcccaggtgcagcgtggagcagtcgtggactgagctgaagacgccgtggggccgnaggtggagggtctccgngcgtaaggtcctcgaggaaaccacttactttcccgngtagtcgtagtagacttataccgtaagtttgggtacgcgacgtaggaccctacggttcggaccgttccgggtccgtttacggaaggttcggtaaggcgggtacctaaacgtaccgttacgacccgttaagttacggaggtcacggttcgaggtcgtagtacgacgaggtacggtacgggtccgggagtaggtacgtacgtacgtacgtccggaacggtacggttacacgtacgtacgaacccgtaacgtaccggtactacccgtacgtacgtacgggaaacggttacggggaccgggttaccgtacggtaagtacgtttaacccggacggtacccgttaccgggttacgttttaaccggtccgttaaccgggtaccgggtaccggggtaacgggtcgggttaaggttaacggtacgggtttaacggttaacttaacgggg

SEQ ID NO: 229937 - DNA, 764 bp, Homo sapiens
  misc_feature: GYAE6OF02GC4GB.23.35.D02.1.454.CMB.1.raw
  modified_base (187)..(187): a, c, t, g, unknown or other
  misc_feature (187)..(187): n is a, c, g, or t
  modified_base (202)..(202): a, c, t, g, unknown or other
  misc_feature (202)..(202): n is a, c, g, or t
  modified_base (224)..(224): a, c, t, g, unknown or other
  misc_feature (224)..(224): n is a, c, g, or t
  modified_base (650)..(650): a, c, t, g, unknown or other
  misc_feature (650)..(650): n is a, c, g, or t
  modified_base (736)..(736): a, c, t, g, unknown or other
  misc_feature (736)..(736): n is a, c, g, or t
tcagacgcgagtatcacgaccggtgctcgatttagcacacgatagttgggtttggggagcatcactcaacaaccacatctgtcctctagagagaaccctgtgagcacagctcctcaccatggactggacctggaggatcctcttcttggtggcagcagctacagttcccactcccaggtgcagctgngcagtctgggactgngcgtgaagagccgtggggaccncgagtgagggtcctaccgtggcaacgggtctcgtaggaaacactacttcccctgtactgtatggtaactattacgtaaggtttggggactaccggaacgacggtaccgtaaccgtacgggtaccggttccggtaccccgttagggaggtacggtaggtacgggtaccttaacggtaactttacccggaaccctttaaggtttaccggaaacggggtaccctaggggtaacggtacccgggtaacttacggttaaccggacgttaacggggtaaacgggttaccgggggtttacccgggggacctaagggttaaacccgttaccggtaccgttaaccgtaccgggtaacccggtttcgggaaaccttaaaccgaccttacccgaaccgtaacccgttacgacccgtaccgtaacgtagttaacgggngtacggggtacgggtccgtaggtacgtagtttacgaccggtacgttaccgggtaccgtttacgttcgacggtcggcgggtacgggngttacgtaggtagttacgttagtacggg

SEQ ID NO: 229938 - DNA, 753 bp, Homo sapiens
  misc_feature: GYAE6OF02I0SPN.23.35.D02.1.454.CMB.1.raw
tcagacgcgagtatcacgaccggtgctcgatttagcacacgatagttgggtttggggaacatcactcaacaaccacatctgtcctctagagagaacccctgtgagcacagctcctcaccatggactggacctggaggatcctcttcttggtggcagcagctacacggttcccactcccaggtgcagctggagccagtcgtgggactggacgctgaaagaacggccgtacgggggccgcgaggtggacggtccgtccgtcgcgtaacggtctcgacggaaaccactacttcccgtagtatagagtcgatactagtaagttgggtacgcgaacgcggaccgacgtcggaccgttccggccgttaggtaggtacggtacgtacggtacgtaacttaacgttacgtaaccctaagttaaggacggtacgtaagggttccggaacgggttacttaacggtgaacgacggggtaacgggttacggggtttcccgggtaaggtacggtacggttaccgtccgtaacgtaccggtaccggtacggaccgtaacgtacctaacccgaaccgtaccgtaacgaccgtaccgaactacgggtagtaaggtcgggacggtacgttggtaagttaacgttacgtaaccgttacggttaaacccggttttccgtttaccgtttacggtaccgggttacccgggggtgggtaccgggggttcgtagggttaaccgttgggtttaaacgtttacggttaggtaccgggg

SEQ ID NO: 229939 - DNA, 690 bp, Homo sapiens
  misc_feature: GYAE6OF02JVTP4.23.35.D02.1.454.CMB.1.raw
  modified_base (164)..(164): a, c, t, g, unknown or other
  misc_feature (164)..(164): n is a, c, g, or t
  modified_base (504)..(504): a, c, t, g, unknown or other
  misc_feature (504)..(504): n is a, c, g, or t
  modified_base (595)..(595): a, c, t, g, unknown or other
  misc_feature (595)..(595): n is a, c, g, or t
tcagacgcgagtatcacgaccggtgctcgatttagcacacgatagttgggtttggggagcatcactcaacaaccacatctgtcctctagagagaaccctgtgagcacagctcctcaccagtcggactcggaccgtgggaggactcccttcttcgttggtggcancgagctacgtacggttcccactccacggtgcgacgccgtggacgcgacggttcgacgggtactgaacgtttcgacgtaaagggcccgtcgggtacggggccaggtacgtacgggggtctcccccgttgcctacggtacggtaccttcggaaacgtaccgataccttccgtaagtcgtagtagtactagttcgaattagggtgtacgagccgggtaccagtcggacttcgggaccttgagttcgggagttcggacttacgtagttaccgaccgttaagtacgggaagtcggtaagtccggagttaacgtcgtaagcgtaaggtacggtcgggtaccggtanacggacgtccgtatacgggacgtaccgggacgacgtaacggtccttaacgacctacgacctacgtacgactacgtaggaccgtggacgttntaacggctaagtaccgacggtcgaccgtttccgtaaggtccgtacgtccggtagggccgttaggtgtaggttaacgtaggtttacggagtaacgg

SEQ ID NO: 229940 - DNA, 882 bp, Homo sapiens
  misc_feature: GYAE6OF02HLKY8.23.35.D02.1.454.CMB.1.raw
tcagacgcgagtatcacgaccggtgctcgatttagcacacgatagttgggtttggggagcatcactcaacaaccacatctgtcctctagagagaaccctgtgagcacagctcctcaccatggactggacctgggagatccttcgttcgttgggtggcagcgagctacacggttccccacgtcccgagggtcgacaggtcgtggagcgtagtcgtagggtactggacgcgttagaaaggaccggccggtcgggggaccgtacggtaggttacgggtaggggttcccgttccgacggtaccggtaaacggttccgttacggttaacgggaaacctaaccgtccgttaccccgtttaggaacttagggtaacttaggtaacgttaacttagttaaccggggttttggggtacggaaccggtaaccggtcggtacccgtaaccggttacggacccgtttacgggtacccggttaggtacgggttagggacgttcgggtaccttaacgtacgttaaccgtaacccgttaaaggttacggacggtacgtacggtacggggaaccggttaacgtacgtacgggtaagtaaccggttacgggggtaaccggggttccggggtaaacgtaaagggttacccgttacgttaaccggttaacccggtacggtaccggttaacgggaaccctaaaccgtaacccgttaccgaaccgtttaaacccgacggttaacccgtaaccgtacggttaacggagggttaaccggtaacgggacgggttaccggtagttaacgttacgttaacccgtaacgaccggttaccggttacccttttacgcggttccggcggacggggtcgggtacggtgtaacggttacgtagttaggtaccgg

SEQ ID NO: 229941 - DNA, 504 bp, Homo sapiens
  misc_feature: GYAE6OF01DCQWJ.47.84.H07.1.454.CMB.1.raw
  modified_base (203)..(203): a, c, t, g, unknown or other
  misc_feature (203)..(203): n is a, c, g, or t
  modified_base (228)..(228): a, c, t, g, unknown or other
  misc_feature (228)..(228): n is a, c, g, or t
  modified_base (386)..(386): a, c, t, g, unknown or other
  misc_feature (386)..(386): n is a, c, g, or t
  modified_base (499)..(499): a, c, t, g, unknown or other
  misc_feature (499)..(499): n is a, c, g, or t
tcagagctcacgtacacgaccggtgctcgatttagcagacgtctgtcgcggggaggaactgctcagttaggtacccagacggaaccataggaaggccccagccgcagctttctcttcctcctgctactctggctccagagaccgactggagaaatagtgatgacgcagtctccagccaccctgtctgtctctccaggggaaanagccaccatctcctgtagggccgtnagagtattagaatcaacttagcctggtaccagcagagacctgggcaggctcccaggctcctcatctatgatgcatccaacagggccactggcatcccagacaggttcagtggcagtgggtctgggacagacttcactctcaccatcagcagcctagancctagaagtactttggtactttagttactgtcagtcagcgtgagttctggtcctcgctcacgtttcggcggtagggaccgagggtggagagtcgaaacgaatgtggctgcacngttcg

SEQ ID NO: 229942 - DNA, 348 bp, Homo sapiens
  misc_feature: GYAE6OF01A43AO.47.84.H07.1.454.CMB.1.raw
  modified_base (344)..(348): a, c, t, g, unknown or other
  misc_feature (344)..(348): n is a, c, g, or t
tcagagctcacgtacacgaccggtgctcgatttagcagacgtctgtcgcgggccgattcaccgtctccagagacaattccaagaacacgctatatttgcaaatgaacagcctgagacctgaggacacggctgtgtattactgtacgagaccttatggcggggactactttgactactggggccagggaaccctggtcaccgtctcctcagcctccaccaagggcccatcggtcttccccctggcaccctcctccaagagcacctctggggcacagcggccctgggctgcctggtcaaggactacttcctatgtatactctgagcgggctggcaaggcgcatagnnnnn

SEQ ID NO: 229943 - DNA, 346 bp, Homo sapiens
  misc_feature: GYAE6OF01AYE5V.47.84.H07.1.454.CMB.1.raw
  modified_base (344)..(346): a, c, t, g, unknown or other
  misc_feature (344)..(346): n is a, c, g, or t
tcagagctcacgtacacgaccggtgctcgatttagcagacgtctgtcgcgggccgattcaccgtctccagagacaattccaagaacacgctatatttgcaaatgaacagcctgagacctgaggacacggctgtgtattactgtacgagaccttatggcggggactactttgactactggggccagggaaccctggtcaccgtctcctcagcctccaccaagggcccatcggtcttccccctggcaccctcctccaagagcacctctggggcacagcggccctgggctgcctggtcaaggactacttcctacgtgagctctgagcgggctggcaaggcgcatagnnn

SEQ ID NO: 229944 - DNA, 488 bp, Homo sapiens
  misc_feature: GYAE6OF01ENP7C.47.84.H07.1.454.CMB.1.raw
  modified_base (199)..(199): a, c, t, g, unknown or other
  misc_feature (199)..(199): n is a, c, g, or t
  modified_base (430)..(430): a, c, t, g, unknown or other
  misc_feature (430)..(430): n is a, c, g, or t
  modified_base (459)..(459): a, c, t, g, unknown or other
  misc_feature (459)..(459): n is a, c, g, or t
  modified_base (483)..(483): a, c, t, g, unknown or other
  misc_feature (483)..(483): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtctctccaggggaaanagccaccatctcctgtagggccgtcagagtattagcatcaacttagcctggtaccagcagagacctgggcaggctccaggctcctcatctatgatgcgtccaccagggccactggtttcccagccaggttcagtggcagtgcgtctgggacagagttcactctcaccatcaacagcctgcagtctgaagattttgctagtttattactgtcagcagtatcataactggccnctcaccttcggccaagggcacgactgganattaaacgactgtagctgacaccntctcg

SEQ ID NO: 229945 - DNA, 546 bp, Homo sapiens
  misc_feature: GYAE6OF01BDTDT.47.84.H07.1.454.CMB.1.raw
  modified_base (199)..(199): a, c, t, g, unknown or other
  misc_feature (199)..(199): n is a, c, g, or t
  modified_base (256)..(256): a, c, t, g, unknown or other
  misc_feature (256)..(256): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccatcggagaagttgtgttgacacagtctccagccaccctgtctttgtctccaggggaaanagccacctctcctgcagggccagtcagaatattcactcctattagcctggtaccaanagaaacctggtcaggctccaggctcctcatctatgatgcatccaacagggccactggcatcccagacaggttcagtggcagtgggtctgggacagacttcactctcaccatcagcacgcctagacgcctagaagtactttggacttttattactgtcagctagcgtgtagttcgtggccctccgcttcacgtttcgggcgggtacgggaccgaggggtcggaaggtacgtacgtaaacggaacgttgggtcggaccgttacgccgtaaccaattccgttgttccttaccg

SEQ ID NO: 229946 - DNA, 488 bp, Homo sapiens
  misc_feature: GYAE6OF01EL25P.47.84.H07.1.454.CMB.1.raw
  modified_base (391)..(391): a, c, t, g, unknown or other
  misc_feature (391)..(391): n is a, c, g, or t
tcagagctcacgtacacgaccggtgctcgatttagcagacgtctgtcgcggggaggaactgctcagttaggacccagacggaaccatggaagccccagcgcagcttctcttcctcctgctactctggctcccagataccactggagaaatagagatgacgcagtctccagccaccctgtctgtgtctccaggggaaagagccaccctctcctgcagggccagtcagagtattagcagcaacttagcctggtaccagcagaaacctgggcaggctcccaggctcctcatctatggtgcatccaccagggccactggtatcccagccaggttcagtggcagtgggtctgggacagagttcactctcaccatcagcagcctgcagtctgaagtnttttgctaatttattactgtcagcagtataataactggcctcgcttcggccaagggacacgactggagtattaaacgactgtgctgacacatctgtc

SEQ ID NO: 229947 - DNA, 353 bp, Homo sapiens
  misc_feature: GYAE6OF01B3A0B.47.84.H07.1.454.CMB.1.raw
  modified_base (346)..(353): a, c, t, g, unknown or other
  misc_feature (346)..(353): n is a, c, g, or t
tcagagctcacgtacacgaccggtgctcgatttagcagacgtctgtcgcgggccgattcaccgtctccagagacaattccaagaacacgctatatttgcaaatgaacagcctgagacctgaggacacggctgtgtattactgtacgagaccttatggcgggtactactttgactactggggccagggaaccctggtcaccgtctcctcagcctccaccaaggcccatcggtccttccccctggccaccctcctccaagagcacctctggggcacagcggccctgggcctgcctggtcaaggactacttcctacgtgagctcgtgagcggctggcaaggcgcatagnnnnnnnn

SEQ ID NO: 229948 - DNA, 550 bp, Homo sapiens
  misc_feature: GYAE6OF01CWO8T.47.84.H07.1.454.CMB.1.raw
  modified_base (200)..(200): a, c, t, g, unknown or other
  misc_feature (200)..(200): n is a, c, g, or t
  modified_base (358)..(358): a, c, t, g, unknown or other
  misc_feature (358)..(358): n is a, c, g, or t
  modified_base (381)..(381): a, c, t, g, unknown or other
  misc_feature (381)..(381): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagtgatgacgcagtctccagcccaccctgtctgtctctccaggggaaangccaccatctcctgtagggccgtcagagtattagcatcaaacttgcctggtaccagcagagacctgggcaggctccgaggctcctcatctatgatgcgtccaccgagggcccactcggttcccagccaggttcagtggcagtcgcgtcgtgggacagngttcactctccactataccaacncgcctgctagtctagaagtattttcgcttagtttattactgttacagtctagtatactattaactggccctctccaccgttccggaccgaaacgggaccgaacgacgtgggaagtaacgttaaaccgaacgttaggtcggtaccttaggacctaacctagttccttacg

SEQ ID NO: 229949 - DNA, 352 bp, Homo sapiens
  misc_feature: GYAE6OF01AFC6S.47.84.H07.1.454.CMB.1.raw
  modified_base (346)..(352): a, c, t, g, unknown or other
  misc_feature (346)..(352): n is a, c, g, or t
tcagagctcacgtacacgaccggtgctcgatttagcagacgtctgtcgcggggccgattcaccgtctccagagacaattccaagaacacgctatatttgcaaatgaacagcctgagacctgaggacacggctgtgtattactgtacgagaccttatggcggggactactttgactactggggccagggaaccctggtcaccgtctcctcagcctccaccaagggccccatcggtcttccccctggcaccctcctccaagagcacctctgggggcacagcggccctgggctgcctggtcaaggactactcctacgtgagctctgagcgggctggcaaggcgcatagnnnnnnn

SEQ ID NO: 229950 - DNA, 351 bp, Homo sapiens
  misc_feature: GYAE6OF01DZBOF.47.84.H07.1.454.CMB.1.raw
  modified_base (345)..(351): a, c, t, g, unknown or other
  misc_feature (345)..(351): n is a, c, g, or t
tcagagctcacgtacacgaccggtgctcgatttagcagacgtctgtcgcggggccgattcaccgtctccagagacaattccaagaacacgctatatttgcaaatgaacagcctgagacctgaggacacggctgtgtattactgtacgagaccttatggcggggactactttgactactggggccagggaaccctggtcaccgtctcctcagcctccaccaagggcccatcggtcttccccctggcaccctcctccaagagcacctctggggcacagcggccctgggctgcctggtcaaggactacttcctacgtgagctctgagcgggctggcaaggcgcatagnnnnnnn

SEQ ID NO: 229951 - DNA, 508 bp, Homo sapiens
  misc_feature: GYAE6OF01EERZH.47.84.H07.1.454.CMB.1.raw
  modified_base (199)..(199): a, c, t, g, unknown or other
  misc_feature (199)..(199): n is a, c, g, or t
  modified_base (505)..(505): a, c, t, g, unknown or other
  misc_feature (505)..(505): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccaggggaaangccaccctctcctgcagggccagtcagagtattagcagcaacttagcctggtaccagcagaaacctgggcaggctccaggctcctcatctatggtgcatccaccagggccactggtactcccagcccaggttcagtggcaggtgggtctggggacaggtagttcactctcaccatcagcagcctgcagtctgaagtattttgactaatttattactgtcagtctagtatcattaacgtggccctctccaccgttcggaccaagggacacgacgtaggagtattaaacgatggtggactagcacctntcg

SEQ ID NO: 229952 - DNA, 522 bp, Homo sapiens
  misc_feature: GYAE6OF01BPYC0.47.84.H07.1.454.CMB.1.raw
  modified_base (199)..(199): a, c, t, g, unknown or other
  misc_feature (199)..(199): n is a, c, g, or t
  modified_base (363)..(363): a, c, t, g, unknown or other
  misc_feature (363)..(363): n is a, c, g, or t
  modified_base (519)..(519): a, c, t, g, unknown or other
  misc_feature (519)..(519): n is a, c, g, or t
tcagagctcacgtacacgaccggtgctcgatttagcagacgtctgtcgcgggggaggaactgctcagttaggacccagacggaaccatggaaaccccagcgcagcttctcttcctcctgctactctggctcccagatatcgccggagaaattgtgttgacacagtctccagccaccctgtctttgtctccaggggaaangccaccctctcctgcagggccagtcagaatattcactcctacttagcctggtaccaacagaaacctggtcaggctccaggctcctcatctatgatgcatccaacagggccactggcatcccagacaggttcagtggcagtgggtctgggacagacttcactctnaccccatcagcagcctagacgcctagaagtactttaggtactttattacttgtcagcgagtcgtgtagttcgtcggcctccgcttctaccgtttcgggcggacgggaccgagggtggagtacgtacgaaacggatggtggctgcacatctgtcttntac

SEQ ID NO: 229953 - DNA, 362 bp, Homo sapiens
  misc_feature: GYAE6OF01ED3D7.47.84.H07.1.454.CMB.1.raw
  modified_base (354)..(362): a, c, t, g, unknown or other
  misc_feature (354)..(362): n is a, c, g, or t
tcagagctcacgtacacgaccggtgctcgatttagcagacgtctgtcgcggggccgattcaccgtctccagagacaattccaagaacacgctatatttgcaaatgaacagcctgagacctgaggacacggctgtgtattactgtacgagaccttatggcggggactactttgactacgtggggccagggaatcctggtcaccgtctccacagcctccaccgaacgggcccatccggtccttccccctggccgccctgcctccaggacgccacctccgagagcacagcgccctgggctgcctggtcaaggactacttcctacgtgagctctgagcgggctggcaaggcgcatagnnnnnnnnn

SEQ ID NO: 229954 - DNA, 667 bp, Homo sapiens
  misc_feature: GYAE6OF01D932E.47.84.H07.1.454.CMB.1.raw
  modified_base (201)..(201): a, c, t, g, unknown or other
  misc_feature (201)..(201): n is a, c, g, or t
tcagagctcacgtacacgaccggtgctcgatttagcagacgtctgtcgcgggggaggaactgctcagttaggacccagacggaaccatggaagccccagctcagcttctcttcctcctgctactctggctcccagattccaccggagacattgttttgacacagtctccagccaccctgtctttgtctccgaggggaaagngcccaccctctcctgcagggccagtcagagtgttggcagctacttagcctggtaccaacagaaacctggaccaggcctcccaggcctcctcatctatgatcgccgtccaccgacgggccacgttcggttacccaggtcctaggttcaggtggcaggtgcgtcgtgggacagtagttcactctacacctatccaaacacgtcctgactagtctagtaaagttattttcgacgttaagttttacttacgttcggtacagtactaagttaacttactaagttaacgtcggtacccgtaccttaccgtaacccgtttacccgggaacccgtaaacggggtaccaaccggtaaccggttacgggtaaacggtaaacgtttaaaaccggtaacgttacgggttacggtaccgttacggacccaacccgttacgttaccgttacggtttacccttccgtaccgtttaccccgg

SEQ ID NO: 229955 - DNA, 569 bp, Homo sapiens
  misc_feature: GYAE6OF01DAM2R.47.84.H07.1.454.CMB.1.raw
  modified_base (202)..(202): a, c, t, g, unknown or other
  misc_feature (202)..(202): n is a, c, g, or t
  modified_base (229)..(229): a, c, t, g, unknown or other
  misc_feature (229)..(229): n is a, c, g, or t
  modified_base (421)..(421): a, c, t, g, unknown or other
  misc_feature (421)..(421): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagagaccactggagaaatagtgatgacgcagtctccagcccaccctgtctgtctctccgaaggggaaangccaccatcctcctggtacgggccgtnagagtattagcatcaacttagcctggtaccagcagagaccgtgggcaggcctcccaggctcctcatctatgatcgccgtccaccgagggcccacgttcggtttcccagccctaggttcaggtggcaggtcgcgtcgtagggacaggtacgttcacttctacacctaatcaacagcctgctagtctagaagtntttgactagtttatactgtcagctagtactactagttaacgtcgtccgtcttaccgtaccggttccggaccgaacgggaccaacggtacgtagggtaagtaacgttaaaccggaacgtggtacggcttacgactaccctatcgttacg

SEQ ID NO: 229956 - DNA, 541 bp, Homo sapiens
  misc_feature: GYAE6OF01BVZB1.47.84.H07.1.454.CMB.1.raw
  modified_base (201)..(201): a, c, t, g, unknown or other
  misc_feature (201)..(201): n is a, c, g, or t
  modified_base (396)..(396): a, c, t, g, unknown or other
  misc_feature (396)..(396): n is a, c, g, or t
  modified_base (416)..(416): a, c, t, g, unknown or other
  misc_feature (416)..(416): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagcccaccctgtctgtgtctccgaggggaaancgcccaccctctcctgcagggccagtcagagtattagcatcaacttagcctggtaccagcagagacctgggcaggctcccgaggcctcctcatctatgatgccgtccaccgagggccctacgttcggttccccaggtcctaggttcaggttggctaggtgcgtcgtgggacagtagttcactctcaccatcaacncgcctgctagtctagagttntttgcttagtttattacgtgtacagtctagttatactaatacgtcggcctctaccgtaccgttcggaccgaacgggacctacggacgtaggaagtaactaaacgagtggtcgctaggcacgtgtc

SEQ ID NO: 229957 - DNA, 534 bp, Homo sapiens
  misc_feature: GYAE6OF01EYM7H.47.84.H07.1.454.CMB.1.raw
  modified_base (199)..(199): a, c, t, g, unknown or other
  misc_feature (199)..(199): n is a, c, g, or t
  modified_base (374)..(374): a, c, t, g, unknown or other
  misc_feature (374)..(374): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagtgatgacgcagtctccagccaccctgtctgtctctccaggggaaangccaccatctcctgtagggccgtcagagtattagcatcaacttagcctggtaccagcagagacctgggcaggctcccaggctcctcatctatgatgcgtccaccagggccactggtttcccagccaggttcagtggcagtgcgtcgtgggacagagttcactctcaccatcaacngcctgcagtctagaagtatttgactagtttattactgtcagtctagtatacatacgtggcctctccgtaccttcggaccaacgggaccaaccggacgtgggtaagaacgtttaaaccggaacgttggtacggtctacggacctaacccgtgtccgttacg

SEQ ID NO: 229958 - DNA, 351 bp, Homo sapiens; identical to SEQ ID NO: 229950
  misc_feature: GYAE6OF01CIQZM.47.84.H07.1.454.CMB.1.raw
  modified_base (345)..(351): a, c, t, g, unknown or other
  misc_feature (345)..(351): n is a, c, g, or t

SEQ ID NO: 229959 - DNA, 499 bp, Homo sapiens
  misc_feature: GYAE6OF01B0670.47.84.H07.1.454.CMB.1.raw
  modified_base (485)..(485): a, c, t, g, unknown or other
  misc_feature (485)..(485): n is a, c, g, or t
  modified_base (493)..(493): a, c, t, g, unknown or other
  misc_feature (493)..(493): n is a, c, g, or t
  modified_base (495)..(495): a, c, t, g, unknown or other
  misc_feature (495)..(495): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccaggggaaagagccaccctctcctgcagggccagtcagagtattagcagcaacttagcctggtaccagcagaaacctgggcaggctcccaggctcctcatctatggtgcatccaccgagggcccactggtactcccagccaggttcagtggcaggtgggtctgggacagacgttcactctcaccatcagcagcctgcagtctagaagtatttgactaatttattactgtcagtctaagttaataataacgtggtcctcgtcttcggcgaggacacgactggagtattaacgactgngctgcacntntgtc

SEQ ID NO: 229960 - DNA, 547 bp, Homo sapiens
  misc_feature: GYAE6OF01BGBRS.47.84.H07.1.454.CMB.1.raw
  modified_base (199)..(199): a, c, t, g, unknown or other
  misc_feature (199)..(199): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccaggggaaanagccaccctctcctgcagggccagtcagagtattagcagcaacttagcctggtaccagcagaaacctggtcaggctcccaggcctcctcatctatgatgcatccaacgagggcccacgtggccatccccagacaggttcagtggctaggtgggtctggggacagtacttcactctcaccatcagcagccctagacgtcctagaacgtctttaggtacttttatacttgtcagcagtcgtgtcgttcgtcggccctccgctcgtccgtttcgggcggacgggaccgaggggtggacggtacgtaaccgaaacggtaacgttcggtacgggtacctcgccgtaccgtacg

SEQ ID NO: 229961 - DNA, 490 bp, Homo sapiens
  misc_feature: GYAE6OF01BN1UV.47.84.H07.1.454.CMB.1.raw
  modified_base (199)..(199): a, c, t, g, unknown or other
  misc_feature (199)..(199): n is a, c, g, or t
  modified_base (395)..(395): a, c, t, g, unknown or other
  misc_feature (395)..(395): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccaggggaaanagccaccctctcctgcagggccagtcagagtattagcagcaacttagcctggtaccagcagaaacctgggcaggctcccaggctcctcatctatggtgcatccaccagggccactggtatcccagcccaggttcagtggcaggtgggtctgggacagagttcactctcaccatcagcagcctgcagtctagaagtnttttgactaatttattactgtcagcagtataatacgtgcctcgctcggacaggcacgactggacgtattaacgatgtagctgacactatcgtgtc

SEQ ID NO: 229962 - DNA, 537 bp, Homo sapiens
  misc_feature: GYAE6OF01AHWC3.47.84.H07.1.454.CMB.1.raw
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccaggggaaagagccaccctctcctgcagggccagtcagagtattagcagcaacttagcctggtaccagcagaaacctgggcaggctccaggcctcctcatctatggtgcatcccaccagggccacgtggtttcccagccaggttcagtggcagtgcgtcgtgggacaggacgttccactctcaccatcaacagcctgcagtctgaagtatttgactagtttattactgtcagtcagttatactaataacgtggcccgtctccgtacccgttcggaccaagggaccacggacgtaggtaagtaagttaaaccggacgttggtacggtactcgacctactagtccgttcg

SEQ ID NO: 229963 - DNA, 836 bp, Homo sapiens
  misc_feature: GYAE6OF01BBP10.47.84.H07.1.454.CMB.1.raw
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaagttattttgacacagtctccagccaccctgtctttgtctccaggggaaagagccaccctctcctgcagggtcagtcagagtgttgacagctacttagtctggtaccaagagaacctggccaggcctcccaggctcctcatcgtgggatgcatccgaacgcgggcccgcgtggccacgtccccgagcccgtaggtttccaggtcggacgtagggttcggggtcgtacggggactacgggtaacctttccgaacctttccgttacccaaccccgtaacgttacccgaacggtacccgtaaccggtaccccgttaaacgggtaaccggtacccccgttaagggtaaaacggtttaacgttttttacggaaccttttaaaccgttttttaacgtttaaccgtttacggttaccgtaacggtacccgtaacgggtaccgggttaacggtacccgtaaaccggtttccggggtaccccctttacccgtttacccggtttaacccgggtttttacccggggacccgggggtaaccgggggtaaccccgggtaacggggggttaccggggtaaacggtaacggtacccggaaacgggttaaacccgggtaaacccgggtttcgggttacgggtacccgttaccggtaacccgtaacccgttaacgtttcccggttcggtttcccgtttaaccccg

SEQ ID NO: 229964 - DNA, 535 bp, Homo sapiens
  misc_feature: GYAE6OF01BL27L.47.84.H07.1.454.CMB.1.raw
  modified_base (289)..(289): a, c, t, g, unknown or other
  misc_feature (289)..(289): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgactcagtctccagccaccctgtctgtgtctccgaggggaaagagccaccctctcctgcagggccagtcagagtattagcagcaacttagcctggtaccagcaagaaacctgggcaggcctccaggctcctnatctatggtgcatcccaccgagggccacgtggtactcccagcccaggttcagtggctaggtgggtctgggacaggagttcactctcaccatcagcacgcctgcagtctagaagtattttgacttaatttattactgtacagctaagtataagtaacgtgtcctcgtcgttcggaccgaagggacacggacgtagggaacgtaagttaacgacgtggtcggtactcgaccacctattcgtcgttacc

SEQ ID NO: 229965 - DNA, 501 bp, Homo sapiens
  misc_feature: GYAE6OF01D4YMR.47.84.H07.1.454.CMB.1.raw
  modified_base (199)..(199): a, c, t, g, unknown or other
  misc_feature (199)..(199): n is a, c, g, or t
  modified_base (297)..(297): a, c, t, g, unknown or other
  misc_feature (297)..(297): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccaggggaaanagccaccctctcctgcagggccagtcagagtattagcagcaacttagcctggtaccagcagaaacctgggcaggctcccaggctcctcatctatggtncatccaccgagggccactggtatcccagccaggttcagtggcagtggtctgggacagagttcactctcaccatcagcacgcctgcagtctagaagtattttgactaatttattactgtcagactagtaataataactgcctcgctcggcaaggacacgacgtggagtaataaacggactaggtcgactcgacaccatcgtgttc

SEQ ID NO: 229966 - DNA, 514 bp, Homo sapiens
  misc_feature: GYAE6OF01BL03H.47.84.H07.1.454.CMB.1.raw
  modified_base (202)..(202): a, c, t, g, unknown or other
  misc_feature (202)..(202): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagcccaccctgtctgtgtctccgagggggaaangccaccctctcctgcagggccagtcagagtattagcagcaacttagcctggtaccagcagaaacctgggcaggctcccaggctcctcatctatggtgcatcccacgagggcccactggtactcccagccaggttcaggtggcaggtgggtctgggacaggacgttcacttctccacatcagccagcctgcagtctagaatattttgacttaatttattactgtcagctagtaataatacgtgtcctcgcttcggacgaaggacacgactggaactagttaaacggagtggtcgcgtgacactctctgttacc

SEQ ID NO: 229967 - DNA, 524 bp, Homo sapiens
  misc_feature: GYAE6OF01AH6BZ.47.84.H07.1.454.CMB.1.raw
  modified_base (440)..(440): a, c, t, g, unknown or other
  misc_feature (440)..(440): n is a, c, g, or t
  modified_base (454)..(454): a, c, t, g, unknown or other
  misc_feature (454)..(454): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccgaggggaaagacgccaccctctcctgcagggccagtcagagtattagcagcaacttagcctggtaccagcagaacctgggcaggctcccaggcctcctcatctatggtgcatcccaccgagggccacgtggtactccccgaagtccgaggttcaggtcggctaggtgggtctgggacagcgttcactctacacatcagcacgcctacgagtctagaagttatttgacttaatttatactgtcagctagtntacaatacgtgccnctacaccgtcggaccgaggacacgacgtggaataacgtaaacgactggtacgtctcgacctactgtctcg

SEQ ID NO: 229968 - DNA, 537 bp, Homo sapiens
  misc_feature: GYAE6OF01A7FN5.47.84.H07.1.454.CMB.1.raw
  modified_base (199)..(199): a, c, t, g, unknown or other
  misc_feature (199)..(199): n is a, c, g, or t
  modified_base (444)..(444): a, c, t, g, unknown or other
  misc_feature (444)..(444): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccaggggaaangccaccctctcctgcagggccgtcagagtattagcatcaacttagcctggtaccagcagagacctgggcaggctcccaggctcctcatctatgatgcgtccaccgagggccactcggttcccagccaggttcagtggcagtgcgtcgtgggacagtagtcactctcaccatacaacacgcctgcagtctagtaagtattttgcttagtttattactgtctagtctagtatactatacgtcggccncttccaccgttcggacccgaagggaccacggtacgtaggaagtaacgttaaaccgaacgtggtacggtaccgtcgacctacctagtcgttacg

SEQ ID NO: 229969 - DNA, 580 bp, Homo sapiens
  misc_feature: GYAE6OF01D51FT.47.84.H07.1.454.CMB.1.raw
  modified_base (285)..(285): a, c, t, g, unknown or other
  misc_feature (285)..(285): n is a, c, g, or t
  modified_base (295)..(295): a, c, t, g, unknown or other
  misc_feature (295)..(295): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccgaggggaaagacgcccaccctctcctgcagggccagtcagagtattagcagcaacttgcctggtaccagcagaacctggcaggctccagctcctnatctagtggncactcccaccgagggccacgtggtactcccagcccaggttcaggtgctaggtcgggtctaggggacaggtacgtttccgaccttctccaaccctataccgaacgccaacgtccgtagccaggttctaggaagttacttttgaccttacgtttattacgttcgtacagtcaagtcgtaagacctaacgttcggtccctacgtacctacgtttccgggacgggtacgggaccgtaggggtgtaaggacgtaccgaaacgtactgggtcggtactgacctcgtagtcg

SEQ ID NO: 229970 - DNA, 567 bp, Homo sapiens
  misc_feature: GYAE6OF01DULRY.47.84.H07.1.454.CMB.1.raw
  modified_base (220)..(220): a, c, t, g, unknown or other
  misc_feature (220)..(220): n is a, c, g, or t
  modified_base (231)..(231): a, c, t, g, unknown or other
  misc_feature (231)..(231): n is a, c, g, or t
tcagagctcacgtacacgaccggtgctcgatttagcagacgtctgtcgcgggggaggaactgctcagttaggacccagagggaaccatggaagccccagctcagcttctcttcctcctgctactctggctcccagataccaccggagaagttattttgacacagtctccagccaccctgtctttgtctccagggaaagagccaccctctcctgcagggtnacccccccgtnagagtgttgacagctacttagtctggtaccaagagaaacctggtcaggctcccaggctcctcatctatgatgcatccaacgacgggccactggcatcccagacaggttcagtggcaggtgggtcgtgggacagtactcactctcaccatcagcagtcctagacgcctaggaacgttcgtttaggtaacttttatttacgtgtcaggctaggtcgttggtacgttcgtcggtccctccgtcttcgtaccgtttcgggcgggacgggtaccgaggggtgagtataccgaaaacgtacggtgtcgggcttggacacccgtattccgtgttcttctaccg

SEQ ID NO: 229971 - DNA, 666 bp, Homo sapiens
  misc_feature: GYAE6OF01BTL44.47.84.H07.1.454.CMB.1.raw
  modified_base (205)..(205): a, c, t, g, unknown or other
  misc_feature (205)..(205): n is a, c, g, or t
  modified_base (263)..(263): a, c, t, g, unknown or other
  misc_feature (263)..(263): n is a, c, g, or t
  modified_base (288)..(288): a, c, t, g, unknown or other
  misc_feature (288)..(288): n is a, c, g, or t
  modified_base (311)..(311): a, c, t, g, unknown or other
  misc_feature (311)..(311): n is a, c, g, or t
tcagagctcacgtacacgaccggtgctcgatttagcagacgtctgtcgcgggggaggaactgctcagttaggacccagacggaaccatggaacgccccagcgcagcttctcttcctcctgctactctggctcccagataccactgggagaaatagagtattgacgcagttctccagccaccctgtctgtgtctccgaggggaagngcccaccctcgtcctgcgacgggccagtcgagatatcactcctatagcctgtaccaanagaacctgacaggctccagctcctnatctatgatgccagtccgaacgngggccagtcgacactcccaggacgtaggtcagtcggactggtcggtcgagggactaggtaccttcgactccaccgactatccgacgcacgacctagacgtaccgtagtaacgttacgtttacggtaacctttttagaccgttcggtaccgacggtacgtaacgggttcgttaacgtacggttcccgtcgggtacccttccggtccttaaccggttccggttttccggggaaccggggtacgggtaacccggtagggggttacggtaaacggttaccgtaaacccgggttaaaacggacggtttacgggtacgggtacccgttacgggaacccctaacgttacgttcgttacccgg

SEQ ID NO: 229972 - DNA, 819 bp, Homo sapiens
  misc_feature: GYAE6OF01DHREK.47.84.H07.1.454.CMB.1.raw
  modified_base (199)..(199): a, c, t, g, unknown or other
  misc_feature (199)..(199): n is a, c, g, or t
  modified_base (201)..(201): a, c, t, g, unknown or other
  misc_feature (201)..(201): n is a, c, g, or t
  modified_base (209)..(209): a, c, t, g, unknown or other
  misc_feature (209)..(209): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctccagataccactggagaaatagagatgacgcagtctccagccaccctgtctgtgtctccgaggggaaancnccaccctntcctgcagggccagtcagagtattagcagctaacttgcctggtaccagcgaagaaaccgtgggacacggctacccgaggtcctcctcacttctaagttggtacgcctactcccgaccgacggggaccctacgtgggttaacctccccgaggtacccgtaagggtttcaagggttcgggactagggttggggttccgtaggggaacctagggttacgtttccctaaccttccgtaccaacctagtaccgaacggtaccaacgtccccgttaggacccgtaacggttaccgtaagggtaaacggtttacgtttttacggtaaacctttaaaagttttttaaccgttaaccgtttacggttaacgtaacgggtaaccttaaaggtttaaacgttaaaacgttaacccgtttaccggggaacccctttcgggtaacccggttttacgggaaaccccggttaaacggggtaacccgtaaaccgggtaaaccggttaacggggtaaaacgggttaaaaccgttttaaaaacccggtaaaccggtttacggggttacggaaaccgttaccgggtaaccctaacccgtaacgttttacgttacccggttttaaccccg

SEQ ID NO: 229973 - DNA, 575 bp, Homo sapiens
  misc_feature: GYAE6OF01AWB9M.47.84.H07.1.454.CMB.1.raw
  modified_base (199)..(199): a, c, t, g, unknown or other
  misc_feature (199)..(199): n is a, c, g, or t
  modified_base (297)..(297): a, c, t, g, unknown or other
  misc_feature (297)..(297): n is a, c, g, or t
  modified_base (455)..(455): a, c, t, g, unknown or other
  misc_feature (455)..(455): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccaggggaaanagccaccctctcctgcagggccagtcagagtattagcagcaacttagcctggtaccagcagaacctgggcaggctccgaggcctcctcatctatggtncatccacgagggccacgtggtactcccagccaggttcagtgcaggtggtctgggacaggtacgttcactcgtacacatcgagcagcctaggacgtccgtagaacgtacgtttcggtaacttttagtacgttgtacaggtacagtcgtgtacgttccgnggtccctcgtacttctacggtttcgggacggtacgggaccgtaggggtcggaacgtacttaccggaaaaccgtacggttggttacgggaccttacggaccctaaccgtgttccgttacgg

SEQ ID NO: 229974 - DNA, 614 bp, Homo sapiens
  misc_feature: GYAE6OF01DU4EF.47.84.H07.1.454.CMB.1.raw
  modified_base (298)..(298): a, c, t, g, unknown or other
  misc_feature (298)..(298): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagcccaccctgtctgtgtctccgaggggaaagacgcccaccctctcctgcagggccagtcagagtattagcagacaacttagcctggtaccagcagaacctgggcaggctccaggctctcatctatggngcactccacgagggcccagtggtactcccgagcctaggttcaggtggctaggtgggtcgtaggggacaggtacgtttaccacttacctacgaaccctataccgacgcctacgccctggacctagtccgttagtaacgttattttcgacttaattttattaccttgtacaggtactaagttaagttaacttaacgtcggtaccttcggtccgttaccgggaccgaaccgggtacaaccggtaacgtacgggtaacgtaaagttaacggaacgttacggtacggacctacggacccgtaacttacttcgttcgtaccg

SEQ ID NO: 229975 - DNA, 635 bp, Homo sapiens
  misc_feature: GYAE6OF01BQ7BT.47.84.H07.1.454.CMB.1.raw
  modified_base (200)..(200): a, c, t, g, unknown or other
  misc_feature (200)..(200): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggcctcccagataccactggagaaatagagatgacgcagtctccagccaccctgtctgtgtctccgaggggaancgccaccctctcctgcacgggccagtcagagtattagcagcaacttagcctaggtaccagcaacgaaccgtgggacacggcctaccccgaggtcctccctactattcgtagtgggtcgctactcccgaccgacgggcccacgtcggaccacgtcccgaagaccgtacggttcaggtcggacgtagggtcgggtcgtagggactaggtaccttccacgttcctaccaacctataccgacgcgacgcctgaccgtagtctagtaagttgtttacgactttaatttacttactgtacagtactaagttaataacttacgtcgtaccgtcgtaccgttaccggaccgtaacgggacctaaccggtacggtacggtaacggtaacgttaaacggacgttacggtacggtacctacggacctaaccgtagttccgttaccg

SEQ ID NO: 229976 - DNA, 779 bp, Homo sapiens
  misc_feature: GYAE6OF01BOATF.47.84.H07.1.454.CMB.1.raw
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccgaggggaaagagccaccctctcctgcagggccagtcagagtattagcagcaacttagcctggtaccagacaacgaaccgtgggacacggcctaccgacggtcctcctcatctatgatcgacactaccgaacgacgggaccctaacgtcggacctaccgtaccccgaacgtaaccgtagggtttaccgaacgggttcgggaccggttaacggggttcggggttaccggtacgggggtaaacctaacgggttaaccctttacccgtacctttacccgtacctaaccctactaccgaacgaccgtaacggtaccctaacggtaccgtacccgttaaggtaaacgtttaccgttttacgggttaacctttttaacgttaccgttagtacccgtaaggtaccgaaggttccggttaggtttacccggtttccggtccggtccccgttcccggtacctttaccgttaccgggtttaccggggacggggtaacccggggtaaccgggtacgggggttaggaacgggttaaccgtaaaccgggaaaaccggtacggttacgggttacgggtacgtccggaacccgtacccttaccgg

SEQ ID NO: 229977 - DNA, 579 bp, Homo sapiens
  misc_feature: GYAE6OF01BVW07.47.84.H07.1.454.CMB.1.raw
  modified_base (146)..(146): a, c, t, g, unknown or other
  misc_feature (146)..(146): n is a, c, g, or t
  modified_base (199)..(199): a, c, t, g, unknown or other
  misc_feature (199)..(199): n is a, c, g, or t
  modified_base (287)..(287): a, c, t, g, unknown or other
  misc_feature (287)..(287): n is a, c, g, or t
  modified_base (297)..(297): a, c, t, g, unknown or other
  misc_feature (297)..(297): n is a, c, g, or t
  modified_base (358)..(358): a, c, t, g, unknown or other
  misc_feature (358)..(358): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctccagataccactgganaaatagagatgacgcagtctccagccacctgtctgtgtctccgaggggaaacncgcccaccctctcctgcacgggccagtcagagtattagcagcaacttagcctggtaccagcaagaacctggcaggctccaggctcctnatctatggtncatccaccgagggccagtggtactcccagccaggttcaggtggcaggtcgggtctgggacngtagttccacgttctaccacatcacggccagcctgctagtctagtaagtcttttagactaattttatacttgtactagtactaagttactcaacgttaacgtcgtccctacgtacctaccgttacgggaaccgtaaacgggtacctaacggtacggtagggaacgttaaccgtaaaacgtaacgtcgggttacgaccgttacgaacctaccgtcgttaccg

SEQ ID NO: 229978 - DNA, 562 bp, Homo sapiens
  misc_feature: GYAE6OF01BLWU1.47.84.H07.1.454.CMB.1.raw
  modified_base (200)..(200): a, c, t, g, unknown or other
  misc_feature (200)..(200): n is a, c, g, or t
  modified_base (297)..(297): a, c, t, g, unknown or other
  misc_feature (297)..(297): n is a, c, g, or t
  modified_base (402)..(402): a, c, t, g, unknown or other
  misc_feature (402)..(402): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccgaggggaaangccaccctctcctgcagggccagtcagagtattagcagcaacttagcctggtaccagcaagaaacctgggcaggctccaggctcctcatctatggtncatccaccgagggccacgtggtactccccagccaggttcaggtcggcaggtgggtctgggacaggtagttcactctccacatcagcagcctgcagtctagaagtnttctgactaactttattactgtacagtctaagttaactaataaccgtggtacccttcggtccttaccggaccgtaaagggacctaaccggtacgtacgggtaataacggttaaaacggacgtaggtacgggtaccttacgacctaacctagttcgttacg

SEQ ID NO: 229979 - DNA, 601 bp, Homo sapiens
  misc_feature: GYAE6OF01BIUU1.47.84.H07.1.454.CMB.1.raw
  modified_base (201)..(201): a, c, t, g, unknown or other
  misc_feature (201)..(201): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccgaggggaaagngccaccctctcctgcgagggccagtcagagtattagcagcaacttagcctggtaccagcaagaaaccgtgggcaggcctcccaggcctcctcatctagtggtgcactccaccgaggggcccacgtggtactcccacgtccaggttcaggtggcgtaggtcgggtcgtaggggacaggtacgttcacttcctaccaccctaagttccgacgccacgtccctggctacgtcgtagtaagttagttttacgacttaattttacgttacttaggttacgacgtcgaacgtccgtacgacgtaacgtcggtaccttcgtacctaccgttcgggacgggacgggtaccggtaggggtcggtagtacgtacgacggtacgaacgtcggtacggactcggctcgtacg

SEQ ID NO: 229980 - DNA, 630 bp, Homo sapiens
  misc_feature: GYAE6OF01APBQ3.47.84.H07.1.454.CMB.1.raw
  modified_base (198)..(198): a, c, t, g, unknown or other
  misc_feature (198)..(198): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccacctgtctgtgtctccaggggaaangccaccctctcctgtagggccgtcagagtattagcatcaacttgcctggtaccagcagagacctgggcaggcctcccgaggcctcctcatctatgatgcactccaacgacgggcccacgtcgggaccactccccgaagaccgtaaggtttccaaggtcgggaccgagggttcggggtcctaggggacctaggtacctttccgacttcctacaccatcagcacgccgtagacgtccgtagaagtagttcgttacgtactaacgtttaatttaactagttaacctaaaaattactaaaccgtacggtacccgtaccccgtacgttaccgtaccggtttaccgggaccgggtaacgggaacccgtaagggtacggaagtaacgtacgaaaccggtacgtggtacggacgtcgaccacgtacttcgtcgttacccg

SEQ ID NO: 229981 - DNA, 549 bp, Homo sapiens
  misc_feature: GYAE6OF01C0Q9K.47.84.H07.1.454.CMB.1.raw
  modified_base (199)..(199): a, c, t, g, unknown or other
  misc_feature (199)..(199): n is a, c, g, or t
  modified_base (393)..(393): a, c, t, g, unknown or other
  misc_feature (393)..(393): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccaggggaaangccaccctctcctgcagggccagtcagagtattagcagcaacttagcctggtaccagcagaaacctgggcaggctcccaggctcctcatctatggtgcatccacagggccactggtactcccagccaggttcaggtggcaggtgggtctgggacagagttcactctcacatcagcagcctgctagtctagagtntttgcttaatttattactgtcagtctaagttaataattaacgtggccttcgtcgttacggacctaaagggaccacggtacgtacgggtaacgtaacgtttaaaaccggtaacgttcggtacggacttacgacctaccgtacttccgttcggttacc

SEQ ID NO: 229982 - DNA, 572 bp, Homo sapiens
  misc_feature: GYAE6OF01EXQ7D.47.84.H07.1.454.CMB.1.raw
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccgaggggaaagagccaccctctcctgcagggccagtcagagtattagcagcaacttagcctggtaccagcagaacctggcaggctccaggctcctcatctagtggtgcactcccaccgacgggccacgtggtactccccgagccctaggttcaggtcggcgtaggtcggggtctggggacaggtacgttcactctaccacctatcagtcacgtcctgctagtctaggtaagtatttgacttagtttacttacgtgtactagtctaagtactactaagttaacgtcggacccgtctaccgtaccgttccggaaccgtaacgggaccacggtacgtaggaacgtaacgttaaacgacgttggtacggctagacctaccgtagtcg

SEQ ID NO: 229983 - DNA, 601 bp, Homo sapiens
  misc_feature: GYAE6OF01C66ZZ.47.84.H07.1.454.CMB.1.raw
  modified_base (196)..(196): a, c, t, g, unknown or other
  misc_feature (196)..(196): n is a, c, g, or t
  modified_base (377)..(377): a, c, t, g, unknown or other
  misc_feature (377)..(377): n is a, c, g, or t
  modified_base (390)..(390): a, c, t, g, unknown or other
  misc_feature (390)..(390): n is a, c, g, or t
  modified_base (412)..(412): a, c, t, g, unknown or other
  misc_feature (412)..(412): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccatcggagaagttgtgttgacacagtctccagccaccctgtctttgctcaggggaangccacctctcctgcagggccagtcagagtgttggcagctacttagcctggtaaccaacagaaacctggaccaggcctcccaggctcctcatctatgatgccgtccaccgagggccctacgttcggtttcccagcctaggttcaggtcggctagtcgcgtcgtgggacagtacgtcactccncaccataccaacncgcctgcctagtctagaagttntttgcttattttactactgtacagtactagttatctaataaccgtcggccgtacctaccgtacccgttacgggaccgaacggggtaccaaccggtacgtacggggtaacgttaaaccgttaaaacgacgttagggtccggtacttacggaccctaaccgtactttaccgttcgttccttccgttacccg

SEQ ID NO: 229984 - DNA, 716 bp, Homo sapiens
  misc_feature: GYAE6OF01D9HZS.47.84.H07.1.454.CMB.1.raw
  modified_base (333)..(333): a, c, t, g, unknown or other
  misc_feature (333)..(333): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccgaggggaagacgcccaccctctcctgcgagggccagtcagagtattagcagctaacttacgcctggtaccagacaacgaaaccgtggaccacggcctcccgaggcctcctcactcgtgggatcgcactccgaacgacgggccncgtcggccacgtccccgacggaccgtaggttcgacgggtggccgtagggtcgggtcgtaggggactacgtacgtttccaccgttctaccaacctactaccgacgaccgacgtacccgtaaggacgtaccgttacggtaaacgtttacgttttacgtacgtttaagtttttaactttacgtttacgtaccgtaacgtaaccgttaaacgttaaacttaccggtaccggtaccccgttacccgtacccgttaccgtacccggttttaccggggaccgggtaaccggggtaccggtaggggtacggtaacgtaaggtaacggtaaaccggtaacggttacggtaccgggtacgttaccggaccgtaacccgtcgttacgttacccg

SEQ ID NO: 229985 - DNA, 570 bp, Homo sapiens
  misc_feature: GYAE6OF01BBWG0.47.84.H07.1.454.CMB.1.raw
  modified_base (430)..(430): a, c, t, g, unknown or other
  misc_feature (430)..(430): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccgaggggaaagagccaccctctcctgcagggccagtcagagtattagcagcaacttagcctggtaccagcaagaaacctgggcaggcctccaggcctcctcatctatggtgcactcccaccgacgggcccacgtcggtactccccgagcccgtaggttcaggtcggcgtaggtcgggtcgtggggactaggtacgttcacgttctaccacctatccgagcagtcctgctagtctagaagtntttgacttaatttactactgtacagctaagtaataataacgtcgaccgttcgtccgttacggaccgtaagggtaccacgtacgtagggaagtaacgttaaacggacgtggtacgtacgtacaccgactatccgtcgttcc

SEQ ID NO: 229986 - DNA, 810 bp, Homo sapiens
  misc_feature: GYAE6OF01DKAU5.47.84.H07.1.454.CMB.1.raw
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagcccaccctgtctgtgtctccgaggggaaagacgccaccctctcctgcagggccagtcagtagtattagcagactaacttacgcctggtaccagcaacgaaaccgtgggacacggcctaccgacggccttacctacacgtttacctagtcgggtacactaccgtaccgacccgagggccctaacgtggtaacctcccgaacgtccgtaacggtttccaagggttcgggaccgtaggggtttcggggttacgtacgggggtaacctaaggggtacttttacccgaacgtttcccttaccgaaccctaacgttcccgtaacggacccgtaacgggtccccctaggggtaccccttaagggttaccgttaagggttaaaggtttaacttttttacggaaccctttaaaagtttttttacctttaacggttacggtttacaacgggttaacctaaacgggtttaaattaaacccgtacggtttacgggtaccccttacgggttcccgtaaccgggtaaccggtaacggggtaaccctaaccgggtaagtaacgggttaaacggtaaaccgtttaaaacccggaaactttcgggtaccggacttaacggaccccttaaaccgtgttaaccggttcgtttaccccg

SEQ ID NO: 229987 - DNA, 621 bp, Homo sapiens
  misc_feature: GYAE6OF01C41QL.47.84.H07.1.454.CMB.1.raw
  modified_base (336)..(336): a, c, t, g, unknown or other
  misc_feature (336)..(336): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccgaggggaaagacgcccaccctctcctgcgagggccagtcagagtattagcagacaacttagcctaggtaccagcaagaaaccgtgggacaggctcccgaggcctcctcactctagtcggtgcactccacgacgggccagtggtacncccgagcctaggttcaggtggacgaggttgggtacgtagggactaggtacgttcacgttcctaccgactataccgagcctaacgtccctaggacttacgtcttaagaacggtttattttacgactttaaattttacgttaccttggttaccaggtactaacgttattacgaatacgtcggaccttactcccgtacttccgggaacgtaacgggaccgacgtacggtaggaacgttaaaccgttaaacggattcgggtacggacttaccggaactacgtcgttacg

SEQ ID NO: 229988 - DNA, 677 bp, Homo sapiens
  misc_feature: GYAE6OF01A35M0.47.84.H07.1.454.CMB.1.raw
  modified_base (495)..(495): a, c, t, g, unknown or other
  misc_feature (495)..(495): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggcctcccagataccactggagaaatagagatgacgcagtctccagcccaccctgtctgtgtctccgaggggaagcgcccaccctctcctgcgagggccagtcagagtatagcagacaacttacgcctggtaccagacaacgaaccgtgggcacggcctcccgaggtcctccgtctacttccgttagtcgggtcacctacgtacccaaccggacgggccctacggtcggtacctccccgacgtcccgtaggttccgagggtcggacgtagggttcgggtcgtacggggtaacgaggttacgttcctaccgtccgtacaccgtagtcgacgaccgacgcccgtagccgtaacgtcgtaaggtaacgtttntttacgaactttaattttacgtaccgttgtactagtactaagttaacttaagtaaccgtcggtacccttcggtacgtaccggaaccggtagggtaccaacggtacgtagggtaacgttaaacgttaaacggtacgttacgggtacgaccgtacgtaccctaacgttacttccgtgtttaccc

SEQ ID NO: 229989 - DNA, 628 bp, Homo sapiens
  misc_feature: GYAE6OF01AYT2O.47.84.H07.1.454.CMB.1.raw
  modified_base (201)..(201): a, c, t, g, unknown or other
  misc_feature (201)..(201): n is a, c, g, or t
  modified_base (462)..(462): a, c, t, g, unknown or other
  misc_feature (462)..(462): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggcctcccagataccactggagaaatagagatgacgcagtctccagccaccctgtctgtgtctccgaggggaaancgccaccctctcctgcagggccagtcagagtattagcagctaacttagcctggtacccagaccaaggaaaccgtgggacacggcctcccgaggcctcctcatcgtatggtcgcactcccgaccgacgggcccacgttcggtttccccaggccctaaggtttccaggtggacctaggtcgcgtcgtcggggactaggtcgtttaccaccttctacccacctaacgtacaacgtcgccctagctagttacctagtaaacgttnttttgaccttagttttaacttactgtcagtctaagttactacaacgttaacgtcggacccgtcttacctacccggttaccggaccgtaagggaccctaacggtacgtacgggaataaacgttaaacgacgttaggtacggacttacggactaccgtgtccgttacg

SEQ ID NO: 229990 - DNA, 734 bp, Homo sapiens
  misc_feature: GYAE6OF01B6B1K.47.84.H07.1.454.CMB.1.raw
  modified_base (210)..(210): a, c, t, g, unknown or other
  misc_feature (210)..(210): n is a, c, g, or t
  modified_base (377)..(377): a, c, t, g, unknown or other
  misc_feature (377)..(377): n is a, c, g, or t
  modified_base (717)..(717): a, c, t, g, unknown or other
  misc_feature (717)..(717): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggcctcccagataccactggaagaaatagagatgacgcagtctccagcccaccctgtcctgtcgtcctaccggaaggggaaacncgcccaccctctcctgccgagggccagtcagagtatagcagctaacgttcgcctaggaccagcaagtaaaccgtggggaccacggccctacccgaggtccctccgtacaagttcctagttcgggtcaccaactcccgaaccgacgggaccctacggtcggttacccncccgagtcccgtagggttcagggtcggcgtaggtcgggtacgagggactaaggtacgtttccaccttcctaccgaacccgtataccgaacggtcctaaccggtccccgtaggtacccgttaaggttacccggttaaggttaaagttttacttttacggtaacctttaaagtttttacgtaccttacggttaccgaagttaccgttaaatttaacgttaaacgtaccggttccgtaaccgttccggtacggttaccggaacggtaaacgggacctaacggtagtacgggaaagttaaccgtaaacggtccggttaggtcggtacctaggacctaacccgtnttaccgttggtttaccc

SEQ ID NO: 229991 - DNA, 715 bp, Homo sapiens
  misc_feature: GYAE6OF01BEYOM.47.84.H07.1.454.CMB.1.raw
  modified_base (201)..(201): a, c, t, g, unknown or other
  misc_feature (201)..(201): n is a, c, g, or t
  modified_base (230)..(230): a, c, t, g, unknown or other
  misc_feature (230)..(230): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggcctcccagattccaccggagacattgttttgacacagtctccagccaccctgtctttgtctccgaggggaaancgcccaccctctcctgcaggccagtcagngtgtggcagctactagcctgtaaccacagaacctggccaggcctcccgaggcctcctcatctatgatgcactaccaacgagggcctacgtcggcactcccgagtcctaggttcaggtggcaaggtgagtcgtagggaactacggtacttccgaacttcctaccgaaccctattacccgaacgtaccctaaccggaccgtaaacggtaacccgtccgttaacggtaaaacggtttaccgttttaacgggttaaccctttttaacgtttaaccggtacgttaccgaacgttcccggtaacggtccggtttacggtacggtttcccgtacgggtccccgttaccccgtcgtttacccttaccgggtttaccggggacggggtaaccgggtaaccggtagggggtacggtaacggaacgttaaccgaaaaccggttaacgttcggtacggtaccgtacggaccctaaccgtacttccggtgttaccccg

SEQ ID NO: 229992 - DNA, 697 bp, Homo sapiens
  misc_feature: GYAE6OF01DMULX.47.84.H07.1.454.CMB.1.raw
  modified_base (313)..(313): a, c, t, g, unknown or other
  misc_feature (313)..(313): n is a, c, g, or t
  modified_base (347)..(347): a, c, t, g, unknown or other
  misc_feature (347)..(347): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggcctcccagataccactggagaaatagagatgacgcagtctccagccaccctgtctgtgtctaccgaggggaagacgcccacctcctcctgcacgggccagtcgagtacgtattacgcagactacgttacgccgtaggtaccagacaacgaaccgtggcaggcctcccgaggtcctcctcagtcgngggactcgacacgtacccgaacggacgggtcccncgtcggacctaccttaccccgaggtcccgtaggttcccggagtcgggacgtacgggtcggtcggacgggactaccgtcgtacgtaccctgtacccacgtacgcacgtacgacgtaccgtacggactacccggttagtaaacgttttgtttacggtcgtttaagttttacgtttaccgtacgtaacgtaacgtaaccgttaaagttaaacgtccggtcggtacccctccggttacctaccggttaccggttcgggaacggtacgggaacccgtaggggtaccgtacgtaacgggtaagtaaaccggtacgttcgggaccgtcgtaccaccgtacgttcgtcgtttacccgg

SEQ ID NO: 229993 - DNA, 356 bp, Homo sapiens
  misc_feature: GYAE6OF01D80LN.47.84.H07.1.454.CMB.1.raw
  modified_base (259)..(259): a, c, t, g, unknown or other
  misc_feature (259)..(259): n is a, c, g, or t
  modified_base (348)..(356): a, c, t, g, unknown or other
  misc_feature (348)..(356): n is a, c, g, or t
tcagagctcacgtacacgaccggtgctcgatttagcagacgtctgtcgcggggccgattcaccgtctccagagacaattccaagaacacgctatatttgcaaatgaacagcctgagacctgaggacacggctgtgtattactgtacgagaccttatggcggggactactttgactactggggccagggaaccctggtcaccgtctcctcagcctccaccaagggcccatcggtcttcccctggccaccctcctccaagngcacctcgtggggcacagcggccctgggctgcctggtcaaggactacttcctacgtgacgctctgagcgggctggcaaggcgcagtagnnnnnnnnn

SEQ ID NO: 229994 - DNA, 751 bp, Homo sapiens
  misc_feature: GYAE6OF01E0GR1.47.84.H07.1.454.CMB.1.raw
tcagagctcacgtacacgaccggtgctcgatttagcagacgtctgtcgcgggggaggaactgctcagttaggacccagacggaaccatggaagccccagctcagcttctcttcctcctgctactctggctcccagataccatcggagaagttgtgttgacacagtctccagcccaccctgtctttgtctccgaggggaaagcgcccaccctctcctgcagggccagtcagaatattcactcctattagcctggtaccagcagaaacctgggcaggctcccaggctcctcatctagtggtgcatccacgacgggccacgtggtactcccgagccctagggttcaggtcggactagggttcggggtcgtaggggactaaggtacgtttccaacgttccgtacctaacccgtattccgaacggccgtaacgtccccgttaggacctaacggttccgttaagggttaaacggttacgttttttacggaacctttaaagttttttaactttaaccgttggttacctaacggttaccgttaaaggtttaaacttaaaacgttaaccgttacggggtaccccttaccgggttaccgtttacccggggtacccgtaaacgggggtacctaaccgggtaacggttacgggtaaacggtaaaacgtttaaaaccgggtaaaccgttggggttacggtaccgttacggaccctaacccgttacgttaccgttacggtttcctttaccgtccgtttacccccg

SEQ ID NO: 229995 - DNA, 651 bp, Homo sapiens
  misc_feature: GYAE6OF01CZFZ6.47.84.H07.1.454.CMB.1.raw
  modified_base (199)..(199): a, c, t, g, unknown or other
  misc_feature (199)..(199): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccacctgtctgtgtctccgaggggaaancgccaccctctcctgcagggccagtcagtagtattacgcatcaacttagcctaggtaccagcagtacgaccgtgggcacggcctccgaggcctccgtcacgtctagtgatcgcgtccaccgacgggccacgtcggtttacccagcctaaggttcaggtcggactaggtcgacgtcgtagggtacaggtacgttcaccgtctaccactactaccaacgtcgtccgtagacttacgtacgtaagtacgttattttacgacgttttaagtttactttacgttacgtacgaacgtactagttaactacgtaacgtaccgtcggtacctaccttccgtaaccgtttccgggaaccgtaaacgggtaccgtaaccggtaacggtaagggtaacgttaaacgttaaaccggtaaccgttggttaccggtacgtacgaacccgtacccgtgtttacccgg

SEQ ID NO: 229996 - DNA, 707 bp, Homo sapiens
  misc_feature: GYAE6OF01B6YAE.47.84.H07.1.454.CMB.1.raw
  modified_base (314)..(314): a, c, t, g, unknown or other
  misc_feature (314)..(314): n is a, c, g, or t
tcagagctcacgtacacgaccggtgctcgatttagcagacgtctgtcgcgggggaggaactgctcagttaggacccagacggaaccatggaagccccagctcagcttctcttcctcctgctactctggctccagattccaccggagacattgttttgacacagtctccagccaccctgtctgtctctccgaggggaaagcgcccaccctctcctgcgacgggccagtcagaatattcactcctacttagcctggtaaccaacgacgaacctggtcaggcctccaggcctcctcatctatgatgcactccaacgnggccacgtcggacactaccgagacgtacggttcaggtcggacgagggttcggggtacgtagggacctaggtacctttcaccgttctaccgacctatcgagaccgacgtacccgtaagacgtaccttaaggaacgttaccgtttaggtaacttttacgttacgtcgtacgacgtccgtaacggtcgttacggtacggtttcccggtacggtccccgttaccgtccgtttaccggttaccgggtttccggggaccggggtaacgggtacccgggttagggggtaccgggtaaagtaacccgttaacccgggaaaacgggtttaccgttcggggaccggtaccgtaaccggtaccctaaacccgttaggtttccttaccggttcccgttttacccc

SEQ ID NO: 229997 - DNA, 747 bp, Homo sapiens
  misc_feature: GYAE6OF01DD49U.47.84.H07.1.454.CMB.1.raw
  modified_base (322)..(322): a, c, t, g, unknown or other
  misc_feature (322)..(322): n is a, c, g, or t
  modified_base (532)..(532): a, c, t, g, unknown or other
  misc_feature (532)..(532): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggcctccagagaccactggagaaatagagatgacgcagtcctcagcccaccctgtctgtcgtctaccgaaggggaaacacgcccaccctctccgtgcgacgggtccagtcagtagtatagcagctaacttcgcctaggaccagcaagaaccgtggaccaggtcctaccgaggtcctcctactatcgtagttcggcncactacccgaccgacgggtccctaggtacgtacctacccgacgtaccgtaggttccgaagggtcggacgtagggttcggggtcgtacggggaactacgggtactttaccgacttacccgtacctaacgtacgtacgacggacctccggtactgggaccttacggttactaagggtaaatttcgttttacgtaaacttttaaacggttttnttaaccggttaggtacttaaccggtaattaaccgtttaaagttaacgtacccgggttcggtaaccctttcccggttaacccgggtaccggtaacccggggtaaagtaccccggtaaccggttaaacggaaggttaaaacccgggttaaattaaaacccgggtcgttacggtacgtaaccgtccgtaaacctacctacgttccgtgtttaaccccg

SEQ ID NO: 229998 - DNA, 598 bp, Homo sapiens
  misc_feature: GYAE6OF01DPFT3.47.84.H07.1.454.CMB.1.raw
  modified_base (291)..(291): a, c, t, g, unknown or other
  misc_feature (291)..(291): n is a, c, g, or t
  modified_base (302)..(302): a, c, t, g, unknown or other
  misc_feature (302)..(302): n is a, c, g, or t
  modified_base (384)..(384): a, c, t, g, unknown or other
  misc_feature (384)..(384): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccgaggggaaagcgccaccctctcctgcagggccagtcagagtattagcagcaacttagccttaggtaccagcaagaaacctgggcaggctccaggcctcctnatctatggtcncactcccacgagggcccactggtactccagccagttcagtggcaggtggtcgtgggactaggacgtttcacgtctacactancgagcagcctagctagtctaggaacttgttttgaaccttaattttataccgttgtactaacgtctaaagttaattaaacgttaccgtgggtacccttcggtacttaccgggacgtaaacggggtcaaccggtacgtacgggaaattaaaccggttaaacggaacgttcgggtacgccttaacggactaaccctaagttccgttacgtttacccg

SEQ ID NO: 229999 - DNA, 666 bp, Homo sapiens
  misc_feature: GYAE6OF01DCIDQ.47.84.H07.1.454.CMB.1.raw
  modified_base (198)..(198): a, c, t, g, unknown or other
  misc_feature (198)..(198): n is a, c, g, or t
tcagagctcacgtacacgaccggtgctcgatttagcagacgtctgtcgcgggggaggaactgctcagttaggacccagacggaaccatggaagccccagcgcagccttctcttcctcctgctactctggctccagataccactggagaaatagagatgacgcagtctcagccacctgtctgtgtctccgaggggaaancgccaccctctcctgcgacgggccaaggtcagaagtattagcagacaacttagcctaggtaaccaaacacggaaacctgggacaaggcctacccgaggcctcctcaatcctaagtgaattgacctaactacccgaaacgacgggaccctaagtcggaccaacgttccccgagacccgtaggtttccaagggttcggactaggttcggacgttcgtcggggaacagtaccttcacttcctacaccactcacgaccaagccttagacgtaccgtagtaacgttaattttcgtacttaactttttacttacgttgttacaggtaccgtacggtacgttaagcctaaacgttcggtacccttacgtaccgttaaccggtttccgggacgggtaacgggacccggtaaaggggtggaacggtacgtacggaacggaaccgtaacgttcgggtacggtcgtcgtacctaacccg

SEQ ID NO: 230000 - DNA, 621 bp, Homo sapiens
  misc_feature: GYAE6OF01BX7FE.47.84.H07.1.454.CMB.1.raw
  modified_base (202)..(202): a, c, t, g, unknown or other
  misc_feature (202)..(202): n is a, c, g, or t
tcagagctcacgtacacgaccggtgctcgatttagcagacgtctgtcgcggggggaggaactgctcagttaggacccagacggaaccatggaagccccagcgcagcttctcttcctcctgctactctggctcccagataccactggagaaatagagatgacgcagtctccagcccaccctgtctgtgtcctcgaggggaaangccaccctctcctgcagggccagtcagagtattagcagcaacttagcctggtaccagacaacgaaacctgggcaggcctccccgaggcctccctcatctagtggtcgcactccaccgagggcctacgtggtactcccgagccgtaggttcgaggtcggctaggtgggtctgggactaggtacgttcactcctcaaccatacacgtcacgccgtcgacgtagtctaggtaagttagttttacgacttaaagttttacttacgttcgtacaagtactaaggttaactaacgttaactcgggtaccttcgtaccgttaccggaaccgtaacgggtaccacggtacgtaaggtaaacgtaagttaaacggtaacgttacggtacggtacgtacggaaccctacgtaacttcgttacgttaccg

SEQ ID NO: 230001 - DNA, 444 bp, Homo sapiens
  misc_feature: GYAE6OF01D087L.47.84.H07.1.454.CMB.1.raw
  modified_base (377)..(377): a, c, t, g, unknown or other
  misc_feature (377)..(377): n is a, c, g, or t
  modified_base (417)..(444): a, c, t, g, unknown or other
  misc_feature (417)..(444): n is a, c, g, or t
tcagagctcacgtacacgaccggtgctcgatttagcagacgtctgtcgcgggccgattcaccgtctccagagacaattccaagaacacgctatatttgcaaatgaacagcctgagacctgaggacacggctgtgtattactgtacgagtaccttagtgggcgggtactactttgactacgtggggccagggaaccctggtcaccgtctcctcgacgcctccgaccgaacgggcccctacgtccggtcccttccccccgtggaccacccctcctaccaagcgccaccgttcgcggggcacgacgccggcccgtcgggctcgaccgtcgggtacaaggtaccttccgttaccctacggttcgacggtccttacgtgggngggccgggcgttcgggacgaacggccgtaccgaagtaggnnnnnnnnnnnnnnnnnnnnnnnnnnnn

SEQ ID NO: 230002 - DNA, 668 bp, Homo sapiens
  misc_feature: GYAE6OF01DSP03.47.84.H07.1.454.CMB.1.raw
  modified_base (205)..(205): a, c, t, g, unknown or other
  misc_feature (205)..(205): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggcctcccagataccactggaagaaatagtgatgaacgcagtcctccagcccaccctgtctgtctctaccgaggggaancgccaccatcctccgtggtacgggccgtcagtagttatagcatacaacttgcctggtaccagcagacgccgtgggcacggcctcccgaggtccttcctacgacttctaagtcgagttcgcccgtaccaaccgacggcctacgttcggttcccagtcccgtaggtcaggtcgacgtagtgtcgtcgagggacagtacgttcacgtctacactactacaaccgagtccgtgacgtaagttccgtaagtaagtttacgttttacgagttttaacgtttacgtttacgtcgtaccgtaagtacttaacgttacctacgtaaacgttaccgtacggtcccttccgtaacccgttaccgttcccggaaaccgtaacgggtaccgtaacggtaacggtacggtaaacgtaaaccgttaaaacggcgttacggtacggtaccttacgaccgtacttacgttcgtttacccg

SEQ ID NO: 230003 - DNA, 726 bp, Homo sapiens
  misc_feature: GYAE6OF01EPAHH.47.84.H07.1.454.CMB.1.raw
  modified_base (200)..(200): a, c, t, g, unknown or other
  misc_feature (200)..(200): n is a, c, g, or t
  modified_base (432)..(432): a, c, t, g, unknown or other
  misc_feature (432)..(432): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtcctcacgccaccctgtctgtgtctccgaggggaancgccaccatctcctggtacgggccgtacagagtattacggctaatacaacgtttacgccgtaggtaccagacaggacgaccgtgggcacggcctaccgaggcctcctcacgtctagtgacgtcgtacccgtccaccggacgggtaccctacggtttccgttacccacggtcccgtaggtttcgacggttgcgtaggtccgcgtacgtgggatacgtacgttccacgttccanaaccctataaccaacgacgtccgtcgacgtacgttacgtaacggtaagtttacgttttcgaacttttaaccgtttaacgtttaacgttccgtaccgtaacgtaccgtacggtacgtaacgtacccgtaaaccggttccggtcccgttaccgtacggttaccggtttaccggggaaccgggggtaacgggtaacccgggtagggggtacggaaacggtaggtaaccgaaccgggtaaaccggtaaccgtacgggttaaccggtacgtacccggaccgttacccggtcttaccggg

SEQ ID NO: 230004 - DNA, 660 bp, Homo sapiens
  misc_feature: GYAE6OF01BET1H.47.84.H07.1.454.CMB.1.raw
  modified_base (200)..(200): a, c, t, g, unknown or other
  misc_feature (200)..(200): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccgaggggaaanacgccaccctctcctgcagggccagtcagatattagcagcaacttagcctggtaccagcacgaacgtggcaggcctaccgaggcctcctcatcctagttcggtgcactccaccggacgggaccctacgtcggtactccccgagcccgtaggttcaggttcggacgtagggtcgggtcgtagggacaaggtacgttccactctaccactatacgacgccacgtccgtacgcgtagttctagtaagttagttttaggtaactttatttacgttcggtaacttaacggtacgggttaacgttccggttttaccccgacgttacccgtaccgtttaccggggaccgggtaacgggtaaccggtaaggggtacggaaggtaaagtaaagggtaaaacgtaccgttagggtacggtacgtacgacccgtaactacgttcgtacgtttccttacgtcctttaccccg

SEQ ID NO: 230005 - DNA, 701 bp, Homo sapiens
  misc_feature: GYAE6OF01AUL7U.47.84.H07.1.454.CMB.1.raw
  modified_base (201)..(201): a, c, t, g, unknown or other
  misc_feature (201)..(201): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtcgtctccgaggggaaanacgccaccctctcctgcgacgggccagtcagtagtatagcagcaacttagcctggtaccagcaagaaccgtgggacacggcctcccgaggtcctcctcaattcgtagtcggagacctactcccaccgacgggccctaacgttacggtacctaccccgaggtccccgtagggtttccgacgggttacgggacgtacggggttcggggtaccgtagggggaacctagggtacgtttccaacgtttcacctacctagtaccgacgacctacggtcccgtgtaccgtacggttacgtaggtaaacgtttcgttttaggacctttaaagttttacgttaccgttgtaccgagtaccgtaagttaacgttaaacgttaacgtccgggtaccttaccgtacggttaccgggacctaagggaccgtaaccggtacgtaggtaaacgttaacgtaaaccggacgttaggacgtccgtacgaccttaaccgtcgttccgttagttacccg

SEQ ID NO: 230006 - DNA, 733 bp, Homo sapiens
  misc_feature: GYAE6OF01C2SZE.47.84.H07.1.454.CMB.1.raw
  modified_base (200)..(200): a, c, t, g, unknown or other
  misc_feature (200)..(200): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccgaggggaaancgcccaccctctcctgcagggccagtcagagtgttgcagctacttagcctaggtaccaacagaacctggccaggcctcccgaggcctcctctatctatgatgacactaccgaacgcgggaccctacgtcggacctaccgtaccccgacggtacccgtagggtttaccgaacgggttcgggaccgtaagggttacggtacggttaccggtacggggacctacggtaacccgtttacctacccgttccttacccgaaccgtacttaccgaacggccgtaacggtaccccgttaaggaaccgtacccgtaaggtaagtttacgtttttacggaacctttaacgtttttactttaacgttcgtaaccgtacggtaccgtacggtacggttacgtaaccgtaaccgttccggttacccttaccgtaccggttaccggtttaccggggaccgggtacggggtaacccggtagggggtaggacggtaacgtaccggtaaggaaacccggtacggttcggtacgggtctccggcctaaccg

SEQ ID NO: 230007 - DNA, 775 bp, Homo sapiens
  misc_feature: GYAE6OF01B2T74.47.84.H07.1.454.CMB.1.raw
  modified_base (156)..(156): a, c, t, g, unknown or other
  misc_feature (156)..(156): n is a, c, g, or t
  modified_base (222)..(222): a, c, t, g, unknown or other
  misc_feature (222)..(222): n is a, c, g, or t
  modified_base (239)..(239): a, c, t, g, unknown or other
  misc_feature (239)..(239): n is a, c, g, or t
tcagagctcacgtacacgaccggtgctcgatttagcagacgtctgtcgcggggaggaactgctcagttaggacccagacggaaccagtggaacgccccagcgcagcttcctcttcctcctgctactcgtcggcctacccagactaccagtaggaanaaagtagaagtagtcgacgctagtccaccacgacccaccgtgtctgtcgtccgacggaagggaacncgccctaccgtctccgngacgacggccagtcgaagtagtactcgacgacgtactacgtcgcgtacgtaaccagacgaacgtaaccggtggacgacggtcctaccggagtcctaccctataacttgtaggtcggtacacctaccgtacccacggaccgtacctagttcgtacctccgacgtcgtacggtcgaggtcggtaccgtaggttccgggtacgacgggactaacgggttaccttaccgtaccttaccgtaaccgtaaccgtacgttacgaccggaaccgtaccgtacccgttacgaacgttcgttaacgtaagttaacgttttcgtttaaccgttaaacgttttaacttttacgttaaccgttcgtaacggtaaccgtaacgtttaaagtttaacttaaccggtaaccgttccggtacccgtacggtttaccgacccggaaacgtaaccggaaacgtccggtaaacggtaaggttaaaccgtaacgtaaaccggtcgacgggtttaaccgccgttacaacgttacctacgtttacgtccgtttaacccg

SEQ ID NO: 230008 - DNA, 677 bp, Homo sapiens
  misc_feature: GYAE6OF01CPR3H.47.84.H07.1.454.CMB.1.raw
  modified_base (188)..(188): a, c, t, g, unknown or other
  misc_feature (188)..(188): n is a, c, g, or t
  modified_base (202)..(202): a, c, t, g, unknown or other
  misc_feature (202)..(202): n is a, c, g, or t
  modified_base (317)..(317): a, c, t, g, unknown or other
  misc_feature (317)..(317): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagcccacctgtctgtgtcnccgaaggggaaaancgcccaccctctccgtgacgagggccagtcagagtatagcagacaacgttagcctaggtaccaagcaagaaccgtgggacaggcctaccgaggtctacctcactctagtggtacncactcccgaccgagggccctaacgtcgggtacctcccgaacgtccctaaggttccgaggttcggacgtaggtcgggtacgtaggggaactagggtcttacacgtactccaacctactaccgaggaccctacggtccttacggaccttaaggttcccgtaaaaggtaccgtttaattttcggaacttttaaatttacgttacgtagtaccaggttaacctaagttaaataacgttaaccgtgggtacctacggtccttaccgggaacgtaacggacgtacgtacggtaacgggaacttaaacgttaaacggtaacgtcgggtaacacggttacaacccgacttaacgttgtacttacccgg

SEQ ID NO: 230009 - DNA, 817 bp, Homo sapiens
  misc_feature: GYAE6OF01BNP2B.47.84.H07.1.454.CMB.1.raw
  modified_base (197)..(197): a, c, t, g, unknown or other
  misc_feature (197)..(197): n is a, c, g, or t
tcagagctcacgtacacgaccggtgctcgatttagcagacgtctgtcgcgggggaggaactgctcagttaggacccagacggaaccatggaagcccagcgcagcttctcttcctcctgctactctggctccagataccactggagaaatagagatgacgcagtctccagccacctgtctgtcgtctcgaaggggaancgcccacctctcctgcgacgggccagtcagtagttatacggcaggtacctaacgttacgccgttaggtaacccaggtaacctaacggaaaccggtggggaccaacggggtccctaccccgaggtcccttacccctactaactttccgttaaggttcggttacgacctaccgtacccgaaccggtacgggtacccctacggttaccgggttaccctaccccgaacggtcccgtaagggttaccgtaggggtcggtaccggtagggttcgggtcggtagggtaactaggtacgttccgaccgttacctacgaacctataccgacgacctacggtcccgtagaccttaaggttactaggtaacgttttacttttacggaactttttaattttaaccgttcgttacgttaaccgtaagttaacgttaagttaaacttaaccgttaacggtcccggttaccgtccggttaaccggttaccggaaccggtaaacgggttacccgtaaaccggtaacgttaaacggggtaacttaaaggtttaaacccggtacggttacggtttaccgggaccctttaaacggacccccggtttaaagtccctttccgggtttacctttaaccccgg

SEQ ID NO: 230010 - DNA, 773 bp, Homo sapiens
  misc_feature: GYAE6OF01EK07H.47.84.H07.1.454.CMB.1.raw
  modified_base (199)..(199): a, c, t, g, unknown or other
  misc_feature (199)..(199): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccgagggaaanacgccaccctctcctgcagggccagtcagagtattacgcagactaacttacgccgtggtaccagacaagaaacctgggcaggcctcccaggcctccgtcatctagtggtcgctactacccgaccgacgggcccacgttcgggtaacctaccccgacgacccgtacggttcgtaggtcgggtacgtaggttcggggttccgtaggggactaagggtacggtttaccaccttacctacccgtaacccagttaccgacggtaccgaccgtacccgttaggtacccaaggttccttaagggtaaacgttttacgtttttacggaaccttttaaagtttttaacgtttacgtttacgtttacgtacgtactttaaagtttaaacttaaacgttacccgttacgggtaccccgtttacggttacccgtttacccggggaaacccggttaaacggggaacccgttaaaccgtaccggttaaaggggtaaccggttaaaaccgtttaaaacggtaaccggtttacgggaggttaccccgtcgggaacccttaaccgttaaccgttccgttacgtttaccccg

SEQ ID NO: 230011 - DNA, 558 bp, Homo sapiens
  misc_feature: GYAE6OF01CZZBG.47.84.H07.1.454.CMB.1.raw
  modified_base (149)..(149): a, c, t, g, unknown or other
  misc_feature (149)..(149): n is a, c, g, or t
  modified_base (169)..(169): a, c, t, g, unknown or other
  misc_feature (169)..(169): n is a, c, g, or t
  modified_base (189)..(189): a, c, t, g, unknown or other
  misc_feature (189)..(189): n is a, c, g, or t
  modified_base (202)..(202): a, c, t, g, unknown or other
  misc_feature (202)..(202): n is a, c, g, or t
  modified_base (216)..(216): a, c, t, g, unknown or other
  misc_feature (216)..(216): n is a, c, g, or t
  modified_base (294)..(294): a, c, t, g, unknown or other
  misc_feature (294)..(294): n is a, c, g, or t
  modified_base (304)..(304): a, c, t, g, unknown or other
  misc_feature (304)..(304): n is a, c, g, or t
  modified_base (315)..(315): a, c, t, g, unknown or other
  misc_feature (315)..(315): n is a, c, g, or t
  modified_base (339)..(339): a, c, t, g, unknown or other
  misc_feature (339)..(339): n is a, c, g, or t
  modified_base (343)..(343): a, c, t, g, unknown or other
  misc_feature (343)..(343): n is a, c, g, or t
  modified_base (381)..(381): a, c, t, g, unknown or other
  misc_feature (381)..(381): n is a, c, g, or t
  modified_base (404)..(404): a, c, t, g, unknown or other
  misc_feature (404)..(404): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagactaccactagganaaatagagatgacgcagtcnccagccacctgtctgtgtcnccgaagggaaacncgccaccctctccngcacgggcctagtcagtataatagcagacaacttgcctaggtaccagacaagaacctgggacacggctccagctcctnatctagtgtncactccaacgngggcctactgtacccgagctagtnacgngcaggtggtcagggactaggtctcacttcgccaacgtntacgagcacgcctgactacgtanagtaagtctttagacttaacgtttactagtctacagtactaaagtaactaacgtacgtcggtactcggtctacggacgaacgacaacgtagtaggtaaactaagttaaaccgattggtacgacgttacgaacgtctaacgttcttacggttacc

SEQ ID NO: 230012 - DNA, 645 bp, Homo sapiens
  misc_feature: GYAE6OF01BATEN.47.84.H07.1.454.CMB.1.raw
  modified_base (206)..(206): a, c, t, g, unknown or other
  misc_feature (206)..(206): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggcctccagataccactggaagaaatagagatgacgcagtctccacgcccacctgtctgtcgtctaccgaaggggaaacncgcccaccctctccgtgcgacgggccagtcaagtagttatacgcagctaaacgttagccgtaggtaccagacgaacgaaaccgtggggacacgggtcctaccgaggtcctccgtctacttcgtagtcgggtcacctacgtacccgaaccggaccgggtcctaacggttcggtacctacccgagtacccgtaggttacgaggtcggacgtaggtcggtcggtaggaacacgtacgtcctactccgtacactactcgagtaccgacgtcgtacgactacgtcgttaaggtaacgtttctttacgactttaaagttttctaccgtgacgtacgtaattaacgtaatacgttacgtcgtccgtacgtcgtacgaacgtacgacacgtagaggtaactaagaacgtacgtgtacgtacgtacgtaccattcgtgtcgttacccg

SEQ ID NO: 230013 - DNA, 860 bp, Homo sapiens
  misc_feature: GYAE6OF01BT0VM.47.84.H07.1.454.CMB.1.raw
  modified_base (200)..(200): a, c, t, g, unknown or other
  misc_feature (200)..(200): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagcccaccctgtctgtgtctccgaggggaancgcccaccctctcctgcgacgggccagtcagagtattagcagactaacttacgccgtggtaccagaccaacggaaaccgtggggacacgggtccctacccggaggtccctacctctaacgttccgttagtcgggtacgacctacctaccccgaccggaccgggtaccctaacgttacggtacctccccgagtacccgtagggttaccagggtcggacgtagggttcggggtacgtacgggaacgtacggtacgtttacccaccgttacctacccgaacctagttaccgacggtccaccgggtccccgttaggacccgtaaccggttacgttaagggttaaacgttttacgtttttaacggtaaccttttaaacgttttttaccgttaacggttacggttaccgtaagggttaactaaacggttttaaacgtttaaaacccggtttaacccggttccgggttaccccttaccggggttaacccgggttaacccgggtaacccggtaaacgggggttaaccccgaaaccgggttaacgggttaaacggggttaaaaccgtttaaaaccgggttaaaacccggttacgggttaccgttaaccggggtaccgtacccggtaaccgttaaccccgtttacgtttacccgtttcggttttaacccc

SEQ ID NO: 230014 - DNA, 700 bp, Homo sapiens
  misc_feature: GYAE6OF01ATD9D.47.84.H07.1.454.CMB.1.raw
  modified_base (147)..(147): a, c, t, g, unknown or other
  misc_feature (147)..(147): n is a, c, g, or t
  modified_base (198)..(198): a, c, t, g, unknown or other
  misc_feature (198)..(198): n is a, c, g, or t
  modified_base (226)..(226): a, c, t, g, unknown or other
  misc_feature (226)..(226): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactgganaatagtgatgacgcagtctccagccaccctgtctgtctctccgagggaaancgccaccatcctcctggtacgggccgtnagtagtattagcatcaacttgccttggtaccagcagacgtaccgtggcacggcctcccgaggcctcctcactctatgactcgtccgaccaccgtacgggcccctacgttccggtttccccagtccgtaggttccgaggtcggtacgtggttcggaccggtcgtacggggactaggtaccgtttaccgaccttccgtacccaaccttacgtacccaaacgtcctccgtcggtctaacggttcgtagttaaaggttcttttacgacgtttaattttacttacggtctacgtaggtacctagttaactacgtaacgttaacccggtccggtacccgtacccttacccggtacccgttacccgggacccggtaacgggaccgtaaaccggcggttaacgggtaaacggttaaaccgttaaaccgggtaacgttcgggtacggttaccacggtaaccctccttaccgtttcgttacccg

SEQ ID NO: 230015 - DNA, 722 bp, Homo sapiens
  misc_feature: GYAE6OF01C5OHN.47.84.H07.1.454.CMB.1.raw
  modified_base (200)..(200): a, c, t, g, unknown or other
  misc_feature (200)..(200): n is a, c, g, or t
  modified_base (310)..(310): a, c, t, g, unknown or other
  misc_feature (310)..(310): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagcccacctgtctgtgtctccgaggggaaancgcccaccctctcctgcagggccagtcagagtatagcagactaacttcgcctaggtaccagacagaaacctgggacacggctcccgaggcctcctcgatcgtagtcggtnccaactcccgacgacgggccctacgtacggtacctcccgaggtccgtacggtttcacgggttcggacgttagggttcggggtaccgttaggggaacctagggtaccgtttacccgaaccgttccgttaacccaaccgtataccgaacgtccgaaccggtccttcggaacttacggttaccgttaacggtaacgttttacttttaaccggacttttaaacgttttacgttacgtttacgtactaacggtacgttaaacgttaacttaaaacgtttaccggttccggtaccctttgttaccccggttaccggaccggtaaacgggtaccaacgggtaccgtaagggtaacctaaacgtttaaacggaacgtttcgggtacgacgtcgtaccctaacgttactctttcggtaccc

SEQ ID NO: 230016 - DNA, 661 bp, Homo sapiens
  misc_feature: GYAE6OF01DEV2G.47.84.H07.1.454.CMB.1.raw
  modified_base (198)..(198): a, c, t, g, unknown or other
  misc_feature (198)..(198): n is a, c, g, or t
  modified_base (308)..(308): a, c, t, g, unknown or other
  misc_feature (308)..(308): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccacctgtctgtgtctcgaggggaaancgccaccctctcctgcgagggccagtcagagtatagcagcaacttcgcctaggtaccagcaagaaacccgtgggacacggcctccgaggcctcctcattctagtgggtcncctaactcccgaacggacgggaccctaggtacggtacctccccgaggtacccgtaagggttccgaggttcgggacgtagggttgggtcgtaggggacctaggtacgtttccacttctaccactactcgacgcacgtcctgctagtctagtaacgtttatttacgaactttaattttacttacgttgtactaagtactaagttaattaaacgttacgttcggaccgttccgttaccggttacgggaaccgtaaacgggtacgtaacggtacgtagggtaaacgttaaagttaaaaccggtacggttacggtacggtacgtacggaaccctacgttacgttcgttacgttacccg

SEQ ID NO: 230017 - DNA, 873 bp, Homo sapiens
  misc_feature: GYAE6OF01EYB0M.47.84.H07.1.454.CMB.1.raw
  modified_base (165)..(165): a, c, t, g, unknown or other
  misc_feature (165)..(165): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagactaccacgtaggagtaaatagagatgacncagtctccacgcccacctgtctgtcgtcgtaccggagggaacgcgcccaccctctccgtgccgacgggccagtcaaggtattaagtacgacagtactaaccgttacgtacccgtacggtaccagaccgaaacggtaaccgtgggaccgaacggtccgtaccccgacggtccctacccgttactacgttacgttacggttacggttccgaccgtaaccgtaccccgaaccgggaccggtacccgtaacggttacgtaaccgtaccccgacggttaccgtaacgggttccgtaaggttcgggtaccggttaacgttccgggtccggttacgggaacggggtaacgttaacggtttacccgttcccggttaaaccgtcccggttaaccctaaccgttaacccgtaacccttaaaccgaccggtacccgttacgtacggttaacgtttaaccggttaaggtttaaagtttacggtttttaaccgtaaatttttaacgttttaaccgttactttaccgttaagtaccgtaaagtttaaacgttaaaccgtaaacgttttacgggtaccgtaccgtttccgttaccgggtaaccggttaacggaaccggtaacctaccgggtaacgtaagggtaaccgtttaaaggtaaaccggttacggttacgtacgttaacggtcccgtaactaacccggtcgtttctacccgtttaccgg

SEQ ID NO: 230018 - DNA, 787 bp, Homo sapiens
  misc_feature: GYAE6OF01BARUW.47.84.H07.1.454.CMB.1.raw
  modified_base (148)..(148): a, c, t, g, unknown or other
  misc_feature (148)..(148): n is a, c, g, or t
  modified_base (329)..(329): a, c, t, g, unknown or other
  misc_feature (329)..(329): n is a, c, g, or t
  modified_base (584)..(584): a, c, t, g, unknown or other
  misc_feature (584)..(584): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagactaccactgganaaatagagatgacgcagtcctccagcccaccctgtcctgtcgtcgtccgaaggggaaagcgacccaccctcgtcctgaccgagggccagtcaagtacgtatagcagactaacttagccgtacgtaacacgacacggacgtccgtgggacacgggtcctacccgaggcctacctcaacgttntacgtgagttccgaccgtacccaccgcgggtaccacggtgacctacgcccgtagacgtacggttacgacggtcggacgtacgggttcggggtacgtagggggaacctacggttacctttaaccgacccgttacctaccgtaacctaccgtaccgtaacgaccgtaaccggtacccgtaacgggaaccggttaaccgtaacggtaaccgtttacggttttaccgtttaactttttaccgttaacttcggttaaccncggtaacgtcgggttacttacgggttacccgttccggttaccggttacccctttcccggtcctttaaccggtcccggggttttaaccgggccgggggtaaacggggttacccggggaaggggttaaggtaaccgtaacggttaaaccggtaaacgggtacccgttaggtacgttacccgggtacgtaaccctcccggttaacg

SEQ ID NO: 230019 - DNA, 579 bp, Homo sapiens
  misc_feature: GYAE6OF01A5GX5.47.84.H07.1.454.CMB.1.raw
  modified_base (203)..(203): a, c, t, g, unknown or other
  misc_feature (203)..(203): n is a, c, g, or t
  modified_base (301)..(301): a, c, t, g, unknown or other
  misc_feature (301)..(301): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactgggaagaaatagagatgacgcagtctccagcccacctgtctgtcgtctccgaggggaaancgccaccctctcctgcgagggccagtcagatatgcagactaacttgcctgtaccagcaagaacgtggcaggccaccaggcctcctcatctagtggtcncactccgaccgacggccacgtcgacctacgtccgagaccgtaggtacaggtcggcgtaggtcgggtcgtaggggactacggtaccttcgactccgtccactactcgacgcacgactagacgctagtacgtacgtttaggttactttagttcgtgtacagtcacgtggtcgtagttcgtcggtcctccgtctcgtacgttccgggacgggcgtaccgggtaggtcggtagtaccggtaacgaaccggtagtcgggtacgcgtacggacacgttcgtacg

SEQ ID NO: 230020 - DNA, 694 bp, Homo sapiens
  misc_feature: GYAE6OF01DG04C.47.84.H07.1.454.CMB.1.raw
  modified_base (215)..(215): a, c, t, g, unknown or other
  misc_feature (215)..(215): n is a, c, g, or t
  modified_base (667)..(667): a, c, t, g, unknown or other
  misc_feature (667)..(667): n is a, c, g, or t
  modified_base (685)..(685): a, c, t, g, unknown or other
  misc_feature (685)..(685): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggcctcccagactacccacgtgggaagaaaatagagatgacgcagtcctccagcccaccctgtctgtcgtcctaccggaaggggaaacncgcccaccctctccgtgcgacgggccagtcaggtatatagacagactaacttacgcctacggtaccagacgaacggaaccgtgggaccacggtccctacccgacggtccttaccgtactaacgttcctaagtcgggtacacctaaccgtcccgaacgtaccggtacctaacgtcggtacctaccccgacggtaccgttaggtcgtacggtcggacgttacgggtcgggtacgtacggggaactagggtaccttacgaccgtttaccaccgtaactacgtccggaacgccgtaccgtaccgtggtaaccttacggttacgtaagggtaaactttcgttttacgaactttaaacgttttactacgtagttaccgtagtaacttaggttaactacgtaaccgtcgtaccgtcgtaccgtacggacgtaaggaccagtagagtaagaacttaacgngtgacgcacgtacacttntcgtgttcc

SEQ ID NO: 230021 - DNA, 719 bp, Homo sapiens
  misc_feature: GYAE6OF01A4LUU.47.84.H07.1.454.CMB.1.raw
  modified_base (147)..(147): a, c, t, g, unknown or other
  misc_feature (147)..(147): n is a, c, g, or t
tcagagctcacgtacacgaccggtgctcgatttagcagacgtctgtcgcgggggaggactgctcagttaggacccagacggaaccatggaagccccagcgcagcttctcttcctcctgctactctggctccagataccacgtggaanaaatagagatgacgcagtcctaccacgccctacccgtgtccgtgtacgtcgtaccggaagggggaaactccgcccacccgtctaccgtggaccgacgggcctagtacgaagtacgttataggcaagacctaacgtacgccgtacgtaaccagacgaacgaaccggtggacctacggcctaccgacggtcccttaccgtcgtacttaccgtagttcggaccacctaccgtacccgaaccgggcgggtaaccccacgttcggtaacctccccggagtaccggttacggtaccgagggtccggacgtgggttagggtccgtaagggactggtacttactaccttccgaactacctcacgtacgcgtaccgcgtcggtaacgtagtacgtaagtaagtttactttcgtaactttaacgtttagttacgtgttaccgagttaactaacgttaaacgttaccgaagttcccggtcgttacccgtacgtacggaccgaacggacgtacgtacgtacggtaataaccgttaacggtccggtagtccggtacgtacgtccctacgttgtcgttcgtacccg

SEQ ID NO: 230022 - DNA, 785 bp, Homo sapiens
  misc_feature: GYAE6OF01D396F.47.84.H07.1.454.CMB.1.raw
  modified_base (198)..(198): a, c, t, g, unknown or other
  misc_feature (198)..(198): n is a, c, g, or t
tcagagctcacgtacacgaccggtgctcgatttagcagacgtctgtcgcggggggaggaactgctcagttaggacccagacggaaccatggaagccccagcgcagcttctcttcctcctgctactctggctcccagataccactggagaaatagagatgacgcagtcctccagccacctgtctgtgtctcgagggaanacgccaccctctcctgcgacgggtccaggtcagagttattagctagactaacttcgccttaggtaccagaccgaacgaaccgtgggcaacgggcctacccgaggtccctcctacgtatccgtagtcgggtacgcctaacgtcccaaccggaggggtacccctaacggttacgggtaaccttcccccggaaaggtcccgttaaaggggtttccgaacggggttacgggcttaacggggttccggggtacggtacgggggtaaacctaagggtacccgttttaccccaacgtttccgtaacccggaaccttataccgaaccggtccgaacggttccgtacggacgtaacgttacggtaacggtaaaggtttacttttacggaactttaaacgttttacgtttaacgtcgttaaccgtaagtacgttaagttaacgttaaacgtaaccggttcgtacccgttaccggtacgttaacccggaacggtaaccgggacgtaccggtaacgttaacgggtaaacgttaaacgttaaacggacgttacgggtaccggacgttacgacccctaaacgttcgttacgttccgttacc

SEQ ID NO: 230023 - DNA, 722 bp, Homo sapiens
  misc_feature: GYAE6OF01EP227.47.84.H07.1.454.CMB.1.raw
  modified_base (198)..(198): a, c, t, g, unknown or other
  misc_feature (198)..(198): n is a, c, g, or t
  modified_base (389)..(389): a, c, t, g, unknown or other
  misc_feature (389)..(389): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccacctgtctgtgtctaccgagggaancgccctaccctctcctcgacgtacgggcctagtaccgagtaagttacgttaggacaagtacctaaacgttcgccgtaggtaccagacgtaacgaaaccgtggggtaccacgggtcctacccggacggtcctacctacgacttcgtacgtgggtcacgtacctccgaacgacggtcctacggtacggtaccnccccgtacgtaccggtacggttacgacggtcggtacggtaagggttcgggtacgtcgggtaactacggtacgttccctacgttacctacccgtaactacgttacgacggtaccgtaacggtccgtacgtacgttacggttacgtacggttaacttagttttccgtagtttacttttacgttactttacgtacgtacgtgtaacgttactacgtaacgtacggtcccggtacctaccgttaccgaccgttccggaaccgggtacgtaaccgacggtacgtaggtaactaacgtaacggtacgtcggtacgacgtacgaccttcgcgtttacccg

SEQ ID NO: 230024 - DNA, 758 bp, Homo sapiens
  misc_feature: GYAE6OF01D44HA.47.84.H07.1.454.CMB.1.raw
  modified_base (147)..(147): a, c, t, g, unknown or other
  misc_feature (147)..(147): n is a, c, g, or t
  modified_base (167)..(167): a, c, t, g, unknown or other
  misc_feature (167)..(167): n is a, c, g, or t
  modified_base (196)..(196): a, c, t, g, unknown or other
  misc_feature (196)..(196): n is a, c, g, or t
  modified_base (222)..(222): a, c, t, g, unknown or other
  misc_feature (222)..(222): n is a, c, g, or t
  modified_base (225)..(225): a, c, t, g, unknown or other
  misc_feature (225)..(225): n is a, c, g, or t
  modified_base (245)..(245): a, c, t, g, unknown or other
  misc_feature (245)..(245): n is a, c, g, or t
  modified_base (259)..(259): a, c, t, g, unknown or other
  misc_feature (259)..(259): n is a, c, g, or t
  modified_base (268)..(268): a, c, t, g, unknown or other
  misc_feature (268)..(268): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactgganaaatagagatgacgcagtcncagccacctgtctgtgtctccgagggaancgccaccctctctgcaggccagtcanatntcactctatgctgtaccaanagaactgtcagccnccagctccnatctatgatcgcatacccaacgcggaccacgtcgactacctcccgaagtacgtaggttcagggtacggcgtagggtcgggttcgtacggggtaacctagggtacccttacgaccttaccctaccctaactaccgtacgacggaccgtaaaccgtaccgttacgggaaaccgtacccgttaaggtaaaccggttttaccgggtttttacgtaaacgtttttttacgtaacgttacggttacgaaacgttcgggtaaccgttccggttaagttaacccgggtttccggtacccgggtacccccggttacccgtccccgtttaacggttacccgggttttacccgggggaacggggtacccgggggtaaaccggttaacggggggtaacgggtacggttaaaccgtacccggaaaacccgttaacggggttaaccggtacgggttacccgggtacgggtaacccgttaccctaacccgttaaccgtttccggg

SEQ ID NO: 230025 - DNA, 942 bp, Homo sapiens
  misc_feature: GYAE6OF01EJIPX.47.84.H07.1.454.CMB.1.raw
  modified_base (155)..(155): a, c, t, g, unknown or other
  misc_feature (155)..(155): n is a, c, g, or t
  modified_base (165)..(165): a, c, t, g, unknown or other
  misc_feature (165)..(165): n is a, c, g, or t
  modified_base (184)..(184): a, c, t, g, unknown or other
  misc_feature (184)..(184): n is a, c, g, or t
  modified_base (195)..(195): a, c, t, g, unknown or other
  misc_feature (195)..(195): n is a, c, g, or t
tcagagctcacgtacacgaccggtgctcgatttagcagacgtctgtcgcgggggaggaactgctcagttaggaccagacggaaccagtggaacgccccagcgcagcttctcttcctcctgctactcgtggcctaccagactaaccagtagggaanaaataggaanagtcgaacgtcaagttccnccacgtacccncccgttgttcctgttacgtcctaccgggaaagggggaaacgcctaccctacccttccttccgtacggaccgacggggtaccctaaggtacctaaagggtaaacggttttaacgtacggaccgtaaaacggtaaccctttaaaaccggttaaccgggttccccgggtttaacgggtaaacccgtaaacggaacccgttaaaaccggaaaaccgggtacgggaaccgtaaaccggtcccgttaccgaaccgggtacccttacccgtactaaccgttacgtttacggtacggttaaccggacctaacccgtacccgaaccgggtaacgggtacccgtacgtaccggttaccctaccgtaacgccggttaaaggtccgtaagggtacggtacgtcgggttacgggtaccgggtaggggtaaaccgtaggttaccgtaccgtaccgttacctaaaccgtaccgtaacttaccgacggttaccgtaaccggtaccgtaacggttaccggtaacgtttaacggtaaggtttaaacgttttacggttttaacggttaaacttttactttttaacggtttacctacggttaacggttaagttaaccggtaaagttaaacctttaacgtaccggttaccgttaccgttaccggtaccggtaacggtaacgaccggtaacgtaccggtaagtaacggttaaacgtaacgtaaacgtaggtcggttacgtacgtactaacgacttagttcctagttacc

SEQ ID NO: 230026 - DNA, 696 bp, Homo sapiens
  misc_feature: GYAE6OF01BMWHY.47.84.H07.1.454.CMB.1.raw
  modified_base (199)..(199): a, c, t, g, unknown or other
  misc_feature (199)..(199): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagagaccactggagaaatagtgatgacgcagtctccagccaccctgtctgtctctccgaggggaancgccacctatctccgtggtacgggccggtcagagttattacgctatacaacttacgcctacggtaccagcaggacgaccgtgggacacggcctacccgaggtcctcctctatctatgattcgccgtccaccgacgggcctacgttcgttcccagtccgtaggttccaggtcggacagtcggtcgtcgtcgggactaggtacgttcaactccgtacacctacgtaccaacgcgtacctacgcttaagtctacggtaaattacgttttcaacgtttaacgttttattacgtgtactacggtataaggttactacttaacgtaacgttccgggacctaccgttaccgtaacccggtttacggaaccccgggtaaaagggtaccccgtaaacggtacgttaacggggtaaaaggtttaaacgttaaaaccccggtaaacggttacgggtaaccgggtacgttaccggaccccgttaaaccgttaacgttcgtttaccccgg

SEQ ID NO: 230027 - DNA, 710 bp, Homo sapiens
  misc_feature: GYAE6OF01BNE2J.47.84.H07.1.454.CMB.1.raw
  modified_base (147)..(147): a, c, t, g, unknown or other
  misc_feature (147)..(147): n is a, c, g, or t
  modified_base (200)..(200): a, c, t, g, unknown or other
  misc_feature (200)..(200): n is a, c, g, or t
  modified_base (695)..(695): a, c, t, g, unknown or other
  misc_feature (695)..(695): n is a, c, g, or t
  modified_base (701)..(701): a, c, t, g, unknown or other
  misc_feature (701)..(701): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggcctccagataccactgganaaatagagatgacgcagtctccagcccacctgtctgtgtctaccgaggggaanacgcccacccgtctcctgcagggccagtcagtagtattagcaggactaacttacgccgttggtaccagacgaacgaaaccgtggacgacggcctaccgacggccttccgtcaattcgtagtcgggtactcacctcccgtaaccgcgggtacctacggttcgtacctaccccgacgtacccggtacggtttcgacgggttcggcggtaacggggttcggggtacccggttagggggaacgtaaggttaaccggtttccaccgttacccgtaccgaaccctacgtaccgtacgacccgtaccggttcgtacgtaccgtaacgtttgacgttaaggtttacgtttacttaacgttaagtttttactacgttcgttacgtactaacgtaagttaaacttaacgtaccgttcggtaccttcggtaccgttaccggaccgaggtaccgtacggacgttacggagttaacgtacggacgtttagccgtacgtcgctaccgtnttccgngtttacccg

SEQ ID NO: 230028 - DNA, 784 bp, Homo sapiens
  misc_feature: GYAE6OF01DLWOW.47.84.H07.1.454.CMB.1.raw
  modified_base (203)..(203): a, c, t, g, unknown or other
  misc_feature (203)..(203): n is a, c, g, or t
tcagagctcacgtacacgaccggtgctcgatttagcagacgtctgtcgcgggggaggaactgctcagttaggacccagacgaaccatggaagccccagcgcagcttctcttcctcctgctactctggcctcccagattccaccggagactatttgttttgacacagtctccagcctacctgtctttgtctaccgaggggaaancgccaccctctcctgcgagggcagtcagtagtgttgcacgctacttagccgtaggtaaccaacaacgtaaaccgtcggaccgtaacgggtccctacccgacggtcctcctactacgtcgtagggtactcggacctacgtaccaacggacgggccgtcgtcggacctacgtaccccgaggtcccgtacgggttcgaacggttcggacgttaggggttcggggttcggtacgggttaccgtaacgttaccgttaccgtaaccttacctaacccggaaccctacgtacgaacggtaccgacgttaaccccgtacggtaccggtaaccgttaggtaaacggttttacgtttttacgtaaccgtttaagttttttaacgtttacgttacgtaaccgtaacgggtaaccctttaaaaacggtttaaacgttcccgggttaaccggtcccctttaccggtaccgtttaccgttaccgggtttaccggggacggtaaccggggtacggtaggggttaccgactagtaaccggaacgtacggtggacgtcgtacgacctacgttcgtacgtgtttcctagttcctacccg

SEQ ID NO: 230029 - DNA, 357 bp, Homo sapiens
  misc_feature: GYAE6OF02JLASJ.47.84.H07.1.454.CMB.1.raw
  modified_base (288)..(288): a, c, t, g, unknown or other
  misc_feature (288)..(288): n is a, c, g, or t
  modified_base (310)..(310): a, c, t, g, unknown or other
  misc_feature (310)..(310): n is a, c, g, or t
  modified_base (337)..(337): a, c, t, g, unknown or other
  misc_feature (337)..(337): n is a, c, g, or t
  modified_base (341)..(342): a, c, t, g, unknown or other
  misc_feature (341)..(342): n is a, c, g, or t
  modified_base (344)..(357): a, c, t, g, unknown or other
  misc_feature (344)..(357): n is a, c, g, or t
tcagagctcacgtacacgaccggtgctcgatttagcagacgtctgtcgcggggccgattcaccgtctccagagacaattccaagaacacgctatatttgcaaatgaacagcctgagacctgaggacacggctgtgtattactgtacgagaccttatggcggggactactttgactactggggccagggaaccctggtcaccgtctcctcagcctccaccaagggcccatcggtcttccccctggcaccctcctccaagagcacctctgggcacagcggccctgggctncgtcgtgagagtctctacgtgnacgtctgagacggcgtgcgacgagcanatgnngnnnnnnnnnnnnnn

SEQ ID NO: 230030 - DNA, 501 bp, Homo sapiens
  misc_feature: GYAE6OF02ITT8C.47.84.H07.1.454.CMB.1.raw
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccaggggaaagagccaccctctcctgcagggccagtcagagtattagcagcaacttagcctggtaccagcagaaacctgggcaggctcccaggctcctcatctatggtgcatccaccagggccactggtactcccagccaggttcagtggcagtgagtctgggacagacttcactctcaccatcagcagcctagagcctagaagtatttgctactttattactgtcagcagcgtagcaacgtgcctctcacgtttcggcggtacgggaccgagggtggagagtcgagacgtacgtggtggctcggccactacg

SEQ ID NO: 230031 - DNA, 353 bp, Homo sapiens
  misc_feature: GYAE6OF02GSZTB.47.84.H07.1.454.CMB.1.raw
  modified_base (346)..(353): a, c, t, g, unknown or other
  misc_feature (346)..(353): n is a, c, g, or t
tcagagctcacgtacacgaccggtgctcgatttagcagacgtctgtcgcggggccgattcaccgtctccagagacaattccaagaacacgctatatttgcaaatgaacagcctgagacctgaggacacggctgtgtattactgtacgagaccttatggcggggactactttgactactggggccagggaaccctggtcaccgtctcctcagcctccaccaagggcccatcggtcttccccctggcaccctcctccaagagcacctctgggggcacagcggccctgggctgcctggtcaaggactacttcctacgtgagctctgagcgggctggcaaggcgcatagnnnnnnnn

SEQ ID NO: 230032 - DNA, 503 bp, Homo sapiens
  misc_feature: GYAE6OF02JGSUZ.47.84.H07.1.454.CMB.1.raw
  modified_base (200)..(200): a, c, t, g, unknown or other
  misc_feature (200)..(200): n is a, c, g, or t
  modified_base (445)..(445): a, c, t, g, unknown or other
  misc_feature (445)..(445): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccaggggaaagngccaccctctcctgcagggccagtcagagtattagcagcaacttagcctggtaccagcagaaacctgggcaggctccaggctcctcatctatgatgcatccaacagggccactggcatcccagacaggttcagtggcaggtgggtctgggacagacttcactctcaccatcagcagcctagacgcctagaacgtacgtttggtacttttattacctgtcagcagcgtgagttctggcctcgctcncttcggcggacggacgtagggtggagatacgaaacgacgtcggtggctcgcacctacg

SEQ ID NO: 230033 - DNA, 517 bp, Homo sapiens
  misc_feature: GYAE6OF02GQ524.47.84.H07.1.454.CMB.1.raw
  modified_base (199)..(199): a, c, t, g, unknown or other
  misc_feature (199)..(199): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccaggggaaanagccaccctctcctgcagggccagtcagagtatagcagcaacttagcctggtaccagcagaaacctgggcaggctcccaggctcctcatctatggtgcatccaccagggccactggtactccccagccaggttcagtggcagtgggtctgggacagagttcactctcacatcagcagcctgcagtctagaagtattttgactaatttattactgtcagacaacgtaatactgcctcgctctactttcggcggagggaccgagggtcggaacgagtacggaaacgtaacgtggtacggcgtcggaccaccgtatctcgg

SEQ ID NO: 230034 - DNA, 349 bp, Homo sapiens
  misc_feature: GYAE6OF02F5KW6.47.84.H07.1.454.CMB.1.raw
  modified_base (346)..(349): a, c, t, g, unknown or other
  misc_feature (346)..(349): n is a, c, g, or t
tcagagctcacgtacacgaccggtgctcgatttagcagacgtctgtcgcggggccgattcaccgtctccagagacaattccaagaacacgctatatttgcaaatgaacagcctgagacctgaggacacggctgtgtattactgtacgagaccttatggcggggactactttgactactggggccagggaaccctggtcaccgtctcctcagcctccaccaagggcccatcggtcttccccctggcaccctcctccaagagcacctctgggggcacagcggccctgggctgcctggtcaaggactacttcctacgtgagctctgagcgggctggcaaggcgcatagnnnn

SEQ ID NO: 230035 - DNA, 536 bp, Homo sapiens
  misc_feature: GYAE6OF02H7UPF.47.84.H07.1.454.CMB.1.raw
  modified_base (199)..(199): a, c, t, g, unknown or other
  misc_feature (199)..(199): n is a, c, g, or t
  modified_base (298)..(298): a, c, t, g, unknown or other
  misc_feature (298)..(298): n is a, c, g, or t
  modified_base (423)..(423): a, c, t, g, unknown or other
  misc_feature (423)..(423): n is a, c, g, or t
  modified_base (425)..(425): a, c, t, g, unknown or other
  misc_feature (425)..(425): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccaggggaaanagccaccctctcctgcagggccagtcagagtattagcagcaacttagcctggtaccagcagaaacctgggcaggctcccaggcctcctcatctatggtncatccaccgagggcccactggtactcccagccaggttcagtggcaggtgggtctggggacagagttcactctcacctatcagcacgcctgcagtctagaagtattttgactaatttattactgtnanctagtaataatactggcctcgtcgtcggaccaaggacacgacgtaggaacgtaagttaaaccgaacgttagtacggtcgtacggtaccaacccgtagttccgttgttaccg

SEQ ID NO: 230036 - DNA, 552 bp, Homo sapiens
  misc_feature: GYAE6OF02I4MHN.47.84.H07.1.454.CMB.1.raw
  modified_base (199)..(199): a, c, t, g, unknown or other
  misc_feature (199)..(199): n is a, c, g, or t
  modified_base (223)..(223): a, c, t, g, unknown or other
  misc_feature (223)..(223): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtctctccaggggaaangccaccatctcctgtagggccgtnagagtattagcatcaacttagcctggtaccagcagagacctgggcaggctcccaggctcctcatctatgatgcatccaacgagggcccatggcactcccagcctaggttcaggtcggcaggtgagtctggggaacagacttcactctacacctatcagcagcctagacgcctagaagttattttcgctaactttatactgtcagtcacgtcgtacgctacgtcgtcctctacgtaccgtttcgggacgggtaacgggacccggtagggttcgggaacgtacggtacgaacgggtaacgtaacggtcggttacggtaccgtacgtacccg

SEQ ID NO: 230037 - DNA, 512 bp, Homo sapiens
  misc_feature: GYAE6OF02GP6AL.47.84.H07.1.454.CMB.1.raw
  modified_base (199)..(199): a, c, t, g, unknown or other
  misc_feature (199)..(199): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagagaccactggagaaatagtgatgacgcagtctccagccaccctgtctgtctctccaggggaaanagccaccatctcctgcagggccagtcagaatattcactcctacttagcctggtaccaacagaaacctggtcaggctcccaggctcctcatctatgatgcatccaacagggccactggcatcccagacaggttcagtgcagtgggtctgggacagacttcactctcaccatcagcagcctagacgcctagaacgtacgtttggacttttattactgtacagcagcgtgagttctggcctccgctctacgtttcggcggacgggaccaggggtggagacgtacgaaacgtacgtggtcggctgaccaccattccg

SEQ ID NO: 230038 - DNA, 539 bp, Homo sapiens
  misc_feature: GYAE6OF02GBUGA.47.84.H07.1.454.CMB.1.raw
  modified_base (199)..(199): a, c, t, g, unknown or other
  misc_feature (199)..(199): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccaggggaaanagcccaccctctcctgcagggccgtcagagtattagcatcaacttagcctggtaccagcagagacctgggcaggctcccaggctcctcatctatgatgcgtccaccagggccactggttccagccaggttcagtgcagtgcgtctgggacaggacttcactctccaaccatcaacacgcctgcagtctagaagtattttgctagtttattactgtctacgctagttatactataactcggccgtctaccaccgttcggaccaacgggtaccaacgtaccgtgggaacgtaacgttaaaccggaacgttgtacggtacgtcgacctaccgtactccgttcg

SEQ ID NO: 230039 - DNA, 546 bp, Homo sapiens
  misc_feature: GYAE6OF02H7C0J.47.84.H07.1.454.CMB.1.raw
  modified_base (199)..(199): a, c, t, g, unknown or other
  misc_feature (199)..(199): n is a, c, g, or t
  modified_base (209)..(209): a, c, t, g, unknown or other
  misc_feature (209)..(209): n is a, c, g, or t
  modified_base (238)..(238): a, c, t, g, unknown or other
  misc_feature (238)..(238): n is a, c, g, or t
  modified_base (286)..(286): a, c, t, g, unknown or other
  misc_feature (286)..(286): n is a, c, g, or t
  modified_base (296)..(296): a, c, t, g, unknown or other
  misc_feature (296)..(296): n is a, c, g, or t
tcagagctcacgtacacgaccggtgctcgatttagcagacgtctgtcgcgggggagaactgctcagttaggacccagacggaaccatggaagccccagcgcagcttctcttcctcctgctactctggctcccagataccactggagaaatagagatgacgcagtctccagccaccctgtctgtgtctccgaggggaaancgccaccctntcctgcagggccagtcagagtatagcagnaacttgcctggtaccagcagaaacctgggcaggctcccgaggctcctnatctatggtncactccaacagggccactggtactccagcctaggttcagtgcagtggtctgggactgagttcactctacacatcagcagtcctgctagtctagaatattagttcgacaactattacttactgtaacaaactagtactactaatacttccttaccctagttccggaccctagggaaccctaaaggtcggtaactacgtaacgaaaccgtaacgttgtacggaccgtacgtacctaaccgtacgttcttacg

SEQ ID NO: 230040 - DNA, 490 bp, Homo sapiens
  misc_feature: GYAE6OF02FHRS6.47.84.H07.1.454.CMB.1.raw
  modified_base (460)..(460): a, c, t, g, unknown or other
  misc_feature (460)..(460): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccaggggaaagagccaccctctcctgcagggccagtcagagtattagcagcaacttagcctggtaccagcagaaacctgggcaggctcccaggctcctcatctatggtgcatccaccagggccactggtatcccagccaggttcagtggcagtgggtctgggacagagttcactctcaccatcagcagcctgcagtctgaagtattttgctaattttattactgtcagcagtataataactggcctcgcttcggcaaggacacgactggaanattaaacgaactgtaggctgcacatctgtc

SEQ ID NO: 230041 - DNA, 523 bp, Homo sapiens
  misc_feature: GYAE6OF02FNDLW.47.84.H07.1.454.CMB.1.raw
  modified_base (199)..(199): a, c, t, g, unknown or other
  misc_feature (199)..(199): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccaggggaaangccaccctctcctgcagggccagtcagaatattcactcctacttagcctggtaccaacagaaacctggtcaggctcccaggctcctcatctatgatgcatccaacagggcccactggcatcccagacaggttcagtggcaggtgggtctgggacagtacttcactctcaccatcagcagcctagacgcctagaagtactttggtacttttatacttgtcagcagcgtgagttctcggtcctccgtccttctacgtttcgggccgggagggaccgaggggtggaggactacgaaacgtacgtggtcggctcgacacctatcttcg

SEQ ID NO: 230042 - DNA, 496 bp, Homo sapiens
  misc_feature: GYAE6OF02IHRG6.47.84.H07.1.454.CMB.1.raw
  modified_base (199)..(199): a, c, t, g, unknown or other
  misc_feature (199)..(199): n is a, c, g, or t
  modified_base (416)..(416): a, c, t, g, unknown or other
  misc_feature (416)..(416): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagagaccactggagaaatagtgatgacgcagtctccagccaccctgtctgtctctccaggggaaangccaccatctcctgtagggccgtcagagtattagcatcaacttagcctggtaccagcagagacctgggcaggctcccaggctcctcatctatgatgcgtccaccagggccactgtttcccagccaggttcagtggcagtgcgtcgtgggacagagttcactctcaccatcaacagcctgcagtctagaagtattttgcttagttttattactgtcancagtatctataactggccgctcaccttcgaccaaggacacgacgtggagaattaaacgacttgcggctgccactctctcg

SEQ ID NO: 230043 - DNA, 489 bp, Homo sapiens
  misc_feature: GYAE6OF02HDKDW.47.84.H07.1.454.CMB.1.raw
  modified_base (199)..(199): a, c, t, g, unknown or other
  misc_feature (199)..(199): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccaggggaaanagcccaccctctcctgcagggccagtcagagtgttgacagctacttagtctggtaccaagagaaacctggccaggctcccaggctcctcatctgggatgcatccaacagggccgctggcatccccagccaggttcagtggcagtgggtctgggacagacttcactctcaccatcagcagcctagagcctgaagtattttgcttattttattactgtcagcagcgtagcaactgcctctcacttcggcggaggaccgagggtggagatcgagacgatgtggctgcacatcg

SEQ ID NO: 230044 - DNA, 517 bp, Homo sapiens
  misc_feature: GYAE6OF02I1FZI.47.84.H07.1.454.CMB.1.raw
  modified_base (366)..(366): a, c, t, g, unknown or other
  misc_feature (366)..(366): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccaggggaaagagccaccctctcctgcagggccagtcagagtattagcagcaacttgcctggtaccagcagaaacctgggcaggctcccaggctcctcatctatggtgcatccaccagggccactggtatcccagccaggttcagtgcagtggtctgggacagagttcactctcaccntcagcagcctgcagtctagaagtatttgctaatttattactgtcagcagtataataactggcctcgtcttcggccgaagggacacgacgtaggaacgtaagttaaacgaacgttgtacggactacggtaccgtacccagttacctgttccc

SEQ ID NO: 230045 - DNA, 354 bp, Homo sapiens
  misc_feature: GYAE6OF02GB28N.47.84.H07.1.454.CMB.1.raw
  modified_base (347)..(354): a, c, t, g, unknown or other
  misc_feature (347)..(354): n is a, c, g, or t
tcagagctcacgtacacgaccggtgctcgatttagcagacgtctgtcgcggggccgattcaccgtctccagagacaattccaagaacacgctatatttgcaaatgaacagcctgagacctgaggacacggctgtgtattactgtacgagaccttatggcggggactactttgactactggggccagggaaccctggtcaccgtctcctcagcctccaccaagggcccatcggtcttccccctggcaccctcctccaagagcacctctggggggcacagcggccctgggctgcctggtcaaggactacttcctacgtgagctctgagcgggctggcaaggcgcatagnnnnnnnn

SEQ ID NO: 230046 - DNA, 531 bp, Homo sapiens
  misc_feature: GYAE6OF02IMBIX.47.84.H07.1.454.CMB.1.raw
  modified_base (199)..(199): a, c, t, g, unknown or other
  misc_feature (199)..(199): n is a, c, g, or t
  modified_base (287)..(287): a, c, t, g, unknown or other
  misc_feature (287)..(287): n is a, c, g, or t
  modified_base (297)..(297): a, c, t, g, unknown or other
  misc_feature (297)..(297): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccaggggaaanagcccaccctctcctgcagggccagtcagagtattagcagcaacttagcctggtaccagcagaaacctgggcaggctccaggctcctnatctatggtncatccaccagggccactggtatcccagccaggttcagtggcagtgggtctgggacagagttcactctcacatcagcagcctgcagtctagaagtattttgactaatttattactgtcagtcaagtaataataacgtcggtacctcgtcttacggaccgtaagggaccacgacgtggaacgtaagttaaacggaacttagtaggtactcggtaccgaccctattccgtcgttacc

SEQ ID NO: 230047 - DNA, 511 bp, Homo sapiens
  misc_feature: GYAE6OF02H59DF.47.84.H07.1.454.CMB.1.raw
  modified_base (199)..(199): a, c, t, g, unknown or other
  misc_feature (199)..(199): n is a, c, g, or t
  modified_base (223)..(223): a, c, t, g, unknown or other
  misc_feature (223)..(223): n is a, c, g, or t
  modified_base (378)..(378): a, c, t, g, unknown or other
  misc_feature (378)..(378): n is a, c, g, or t
  modified_base (396)..(396): a, c, t, g, unknown or other
  misc_feature (396)..(396): n is a, c, g, or t
  modified_base (467)..(467): a, c, t, g, unknown or other
  misc_feature (467)..(467): n is a, c, g, or t
  modified_base (505)..(505): a, c, t, g, unknown or other
  misc_feature (505)..(505): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagagaccactggagaaatagtgatgacgcagtctccagccaccctgtctgtctctccaggggaaangccaccatctcctgtagggccgtnagagtattagcatcaacttgcctggtaccagcagagacctgggcaggctcccaggctcctcattctatgatgcgtccaccagggccactggtttcccagcccaggttcagtcggcagtcgcgtcgtgggacagagttcactctcacctatcaacngcctgcagtctgaaagtnttttgactagttttatacttgttcagcagtatcatactgcctctcaccttcgaccgtaaggaccacgacgnggaacgtattaaaacgactggtacggctcgaccacctnttctcg

SEQ ID NO: 230048 - DNA, 576 bp, Homo sapiens
  misc_feature: GYAE6OF02IRR1Y.47.84.H07.1.454.CMB.1.raw
  modified_base (377)..(377): a, c, t, g, unknown or other
  misc_feature (377)..(377): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccaggggaaagagcccaccctctcctgcagggccagtcagagtatagcagcaacttagcctggtaccagcagaaacctgggcaggctccaggcctctcatctatggtgcactcccaccgacgggccacgtggtactccacgccaggttcaggtgcaggtcggtcgtgggacagtagtcactctccaccntacagcagcctgactagtcgtagaagttattttcgacttaattttacttacgttgtccagtctaagttaattaaactaacgtcggtacccttcgtccgttaccggaaccggaacgggacctacgtacgttagggaagttaaacgttaaaacggaacgttggtaggaccttaggacctaaccgtacgttcgtagtttacc

SEQ ID NO: 230049 - DNA, 494 bp, Homo sapiens
  misc_feature: GYAE6OF02FPCMA.47.84.H07.1.454.CMB.1.raw
  modified_base (199)..(199): a, c, t, g, unknown or other
  misc_feature (199)..(199): n is a, c, g, or t
  modified_base (296)..(296): a, c, t, g, unknown or other
  misc_feature (296)..(296): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccaggggaaangccaccctctcctgcagggccagtcagagtattagcagcaacttagcctggtaccagcagaaacctgggcaggctcccaggctcctcatctatggtncatccaccgagggccactggtactcccagccaggttcagtggcaggtgggtctggggacagtagttcactctacaccatcagcacgcctgcagtctagaagtatttgactaatttattactgtcagcagtaataatactggctcgtctcgacgaaggcacgacgtggagtaataaacgactgtagctgcacatctgtc

SEQ ID NO: 230050 - DNA, 528 bp, Homo sapiens
  misc_feature: GYAE6OF02HC3AK.47.84.H07.1.454.CMB.1.raw
  modified_base (199)..(199): a, c, t, g, unknown or other
  misc_feature (199)..(199): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccatcggagaagttgtgttgacacagtctccagccaccctgtctttgtctccaggggaaanagccaccctctcctgcagggccagtcagaatattcactcctacttagcctggtaccaacagaaacctggtcaggctcccaggcctcctcatctatgatgcatccaacagggccactggcatcccagacaggttcagtgcagtgagtctgggacagacttcactctcaccatcagcagcctagacgcctagaagtactttggactttattactgtctagcagtcgtgacgtttctcggccttccgcttctacgttcggcggagggaccaggggtcggaacgagtacaaacggtaattggtacggctacggccaccgtagttcctgttacc

SEQ ID NO: 230051 - DNA, 528 bp, Homo sapiens
  misc_feature: GYAE6OF02JDIXF.47.84.H07.1.454.CMB.1.raw
  modified_base (199)..(199): a, c, t, g, unknown or other
  misc_feature (199)..(199): n is a, c, g, or t
  modified_base (223)..(223): a, c, t, g, unknown or other
  misc_feature (223)..(223): n is a, c, g, or t
  modified_base (391)..(391): a, c, t, g, unknown or other
  misc_feature (391)..(391): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagtgatgacgcagtctccagccaccctgtctgtctctccaggggaaangccaccatctcctgtagggccgtnagagtattagcatcaacttagcctggtaccagcagagacctgggcaggctcccaggctcctcatctatgatgcgtccaccagggccactggttcccagccaggttcagtgcagtgcgtcgtgggacagagttcactctcaccatcaacacgcctgcagtctagaagtntttgctagtttattactgtcagcagttatactataacgtggccgtctcctaccgttcggaccgaagggacaccgtacgtgggaacgtaacgttaaaccgaacgttggtacggtacgtcgtaccgacctatccgttcg

SEQ ID NO: 230052 - DNA, 518 bp, Homo sapiens
  misc_feature: GYAE6OF02F142K.47.84.H07.1.454.CMB.1.raw
  modified_base (199)..(199): a, c, t, g, unknown or other
  misc_feature (199)..(199): n is a, c, g, or t
  modified_base (368)..(368): a, c, t, g, unknown or other
  misc_feature (368)..(368): n is a, c, g, or t
  modified_base (372)..(372): a, c, t, g, unknown or other
  misc_feature (372)..(372): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccaggggaaanagccaccctctcctgcagggccagtcagagtattagcagcaacttagcctggtaccagcagaaacctgggcaggctcccaggcctcctcatctatggtgcatccaccagggccacgtggtactcccagccaggttcagtggcaggtgggtctgggacagagttcactcncacntcagcagcctgctagtctagaagtattttgactaatttattactgtacagtctagtaataataactggccttcgtccttcggaccaagggaccacgacgtaggacgtaactaacgtacgtgtagcgtcgacctactactctgttcc

SEQ ID NO: 230053 - DNA, 806 bp, Homo sapiens
  misc_feature: GYAE6OF02I5ZAD.47.84.H07.1.454.CMB.1.raw
tcagagctcacgtacacgaccggtgctcgatttagcagacgtctgtcgcgggggaggaactgctcagttaggacccagagggaaccatggaagccccagctcagcttctcttcctcctgctactctggctcccagataccatcggagaagttgtgttgacacagtctccagccaccctgtctttgtctccgaggggaaagacgccaccctctcctgcagggccagtcagaatatcactcctacttagcctggtaccaacagaaacctggtcaggcctccaggcctcctcatctatgatgcactccaacgacgggccacgtcggactacctaccccgagaccgtaggttccaggtcggacgtagggtcggggttacgtcggggaactacggtaccttacgaccttacctcccaaccctattaccgaacgccgaacggtacccttaacgggaaccgtcccgttaaggtaaaacggttaccggtttttaacggggttaaaccttttttaacgtttaaccgttcggtttaaccgtaacgggtaccgtaaacgggttccggttacgggttaaacggttttcccgtaccggggttccccttcccgggttacccgttacccgtttaacccgggttttcccgggggacccggggtaaccgggggtaacccggggtaaggggggttacgggaaaccggttaaccgggttaaacccggtaaaacccgggttaaacggttacggggttaccgggtaccggttaccggacccgtaacccgttaagtttacccggtttaccggtttacccgtttacccg

SEQ ID NO: 230054 - DNA, 534 bp, Homo sapiens
  misc_feature: GYAE6OF02GPQ52.47.84.H07.1.454.CMB.1.raw
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccaggggaaagagccaccctctcctgcagggccagtcagagtattggcagcaacttagcctggtaccagcagaaacctgggcaggctcccaggcctcctcatctatgatgcatccaacagggccactggcatcccagacaggttcagtggcagtgggtctggggacaggtacttcgactctcaccatcagcagcctagacgccgtgaacgtacttttaggacttttattaccgttgtacagctaggcgttggtacgtttcgtcggtcccttccgtcttcctaccgtttcggcgggtacgggaccgaggggtcggaggactacgaacgtacgtgtggctgacaccta

SEQ ID NO: 230055 - DNA, 881 bp, Homo sapiens
  misc_feature: GYAE6OF02HPAKQ.47.84.H07.1.454.CMB.1.raw
tcagagctcacgtacacgaccggtgctcgatttagcagacgtctgtcgcgggggaggaactgctcagttaggacccagacggaaccatgggaagcccccgagcgcagtcttcttccttcctcctgacctactcgtcggccctaccgagtactaaccacgtagggaaagtaaataaggaagtagtacggaccgacgtacgttccctaccgacgaccccctacccgttgttccgttggttccgttccgtaccgggaaaaggggggaaaacgacccgaccccctaccccttccctccgtcggacggaaccgggtaccctagtaccgaaaggtaagtttaacgttaacggacgaacgaaaccttaaaccgttaccggtaccgttaaccgggtaaacccaaaacggaaaccgtaaaacccggtcggaaccgacggtcccctaccggacggtcccttacctactattacctaagtacgtacgtacgaacctaacctaacccgaacgggaccggaccctaggtcgactaccgaccgacgtacgtacggtacgacgggtcgacgtaggtaggtacgtcgggtacggaacgtacggtacgtttccaaccttcccgtaaccaactaacgtacgacgacctaccggtcctaggtacgtacggttacgtaaaggttaaagttttacgtttactaaactttttaaagttaactttacggtgtaacgtacgtaacgttaaagttaaacttaaaccgttcgtaccggtaccttcggtaaccgttaccgggaacggtaacggtaccctaagggtaaccggttaggtaaaacttaaaccggttaaaaccggtcgttacgggtacggtaccgttaccggaacccttacgtaacgttccg

SEQ ID NO: 230056 - DNA, 579 bp, Homo sapiens
  misc_feature: GYAE6OF02J0EWD.47.84.H07.1.454.CMB.1.raw
  modified_base (257)..(257): a, c, t, g, unknown or other
  misc_feature (257)..(257): n is a, c, g, or t
  modified_base (299)..(299): a, c, t, g, unknown or other
  misc_feature (299)..(299): n is a, c, g, or t
  modified_base (462)..(462): a, c, t, g, unknown or other
  misc_feature (462)..(462): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccgaggggaaagagccaccctctcctgcagggccagtcagagtattagcagcaacttagcctggtaccngcagaacctggcaggcctccgaggctccgtcatctatggtanccactcccgaaccgacggggcctacgtcgggtacctccccgaagtcccgtaaggtttccaggtcggcgtaggtcgggttccgtggggaactaggtacgtttccacgttctaccaccagtccagccagcctgctacgtctagaagtatttacgacttaaatttntacgtgcagtctaagttaataagtacgtcgtcttcgtcgtaccgacgtaaggacctacgacgtaggagtaaccgttaagaccgttgtacggacgtgacctactacgttccgtagttc

SEQ ID NO: 230057 - DNA, 567 bp, Homo sapiens
  misc_feature: GYAE6OF02G4IKB.47.84.H07.1.454.CMB.1.raw
  modified_base (200)..(200): a, c, t, g, unknown or other
  misc_feature (200)..(200): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccgaggggaaangccaccctctcctgcagggccagtcagagtattagcagcaacttagcctggtaccagcagaacctggcaggctcccaggcctcctcatctatggtgcactccaccgagggccacgtggtactcccagccaggttcagtggcaggtgggtctgggacagtgttcactctcacatcagcagcctgctagtctagtaagtattttgacttaatttacttactgtacagtactaagttaataagttacgtcggtaccttcgtaccgttccggaccgtaacgggtaccacggtacgtagggaacgtaacgttaaaaccggtacgttaggttaccggtacgtcggtacctaaccgtacgtttctacgttaccc

SEQ ID NO: 230058 - DNA, 350 bp, Homo sapiens
  misc_feature: GYAE6OF02HE0JJ.47.84.H07.1.454.CMB.1.raw
  modified_base (346)..(350): a, c, t, g, unknown or other
  misc_feature (346)..(350): n is a, c, g, or t
tcagagctcacgtacacgaccggtgctcgatttagcagacgtctgtcgcggggccgattcaccgtctccagagacaattccaagaacacgctatatttgcaaatgaacagcctgagacctgaggacacggctgtgtattactgtacgagaccttatggcggggactactttgactactggggccagggaaccctggtcaccgtctcctcagcctccaccaagggcccatcggtcttccccctggcaccctcctccaagagcacctctggggacacagcggccctgggctgcctggtcaaggactacttcctacgtgagctctgagcgggctggcaaggcgcatagnnnnn

SEQ ID NO: 230059 - DNA, 569 bp, Homo sapiens
  misc_feature: GYAE6OF02JWGGS.47.84.H07.1.454.CMB.1.raw
  modified_base (200)..(200): a, c, t, g, unknown or other
  misc_feature (200)..(200): n is a, c, g, or t
  modified_base (304)..(304): a, c, t, g, unknown or other
  misc_feature (304)..(304): n is a, c, g, or t
  modified_base (326)..(326): a, c, t, g, unknown or other
  misc_feature (326)..(326): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccgaggggaaanagccaccctctcctgcagggccagtcagagtattagcagcaacttagcctggtaccagcaagaaacctgggacaggcctcccgaggcctcctcatctatcggtncatccacgagggccatggtacncccagcctaggttcagtggcaggtcgcgtcgtgggactagtacgttcactcgtcaccatcaacacgcctagctagtctagaagttgtttcgacttagtttacttacgtcgtactagtacgtagttactactaacgttaacgtcgggtaccgtctaccgtaccgttcggaccgtaacgggtacctacggtacgtaggaactaacgttaacgacgttggtacgacgttcgactacctagttaccg

SEQ ID NO: 230060 - DNA, 577 bp, Homo sapiens
  misc_feature: GYAE6OF02HC4V6.47.84.H07.1.454.CMB.1.raw
  modified_base (199)..(199): a, c, t, g, unknown or other
  misc_feature (199)..(199): n is a, c, g, or t
tcagagctcacgtacacgaccggtgctcgatttagcagacgtctgtcgcgggggaggaactgctcagttaggacccagacggaaccatggaagccccagctcagcttctcttcctcctgctactctggctcccagataccatcggagaagttgtgttgacacagtctccagccaccctgtctttgtctccaggggaaangccaccctctcctgcagggccagtcagaatattcactcctacttagcctggtaccaacagaaacctggtcaggctccgagctcctcatctatgatgcataccaacgcgggccacgtggcactcccagactaggttcagtggcgaggtgggtctgggacagtacttcactctacacctatcagcacgtcctagacgcgtaggtaagttacgtttggtaacttttagtacgttgtacagtcagtcgtgtacgttcgtcggtccttccgccttcgttaccgtttcggggaccggtaacgggaccgtaggggtggaaggtacgtaccggaaaacgtcgtggtacggtccgtacgacctaccgtatccgttcgttccttaccg

SEQ ID NO: 230061 - DNA, 499 bp, Homo sapiens
  misc_feature: GYAE6OF02GZSOY.47.84.H07.1.454.CMB.1.raw
  modified_base (199)..(199): a, c, t, g, unknown or other
  misc_feature (199)..(199): n is a, c, g, or t
  modified_base (355)..(355): a, c, t, g, unknown or other
  misc_feature (355)..(355): n is a, c, g, or t
  modified_base (364)..(364): a, c, t, g, unknown or other
  misc_feature (364)..(364): n is a, c, g, or t
  modified_base (392)..(392): a, c, t, g, unknown or other
  misc_feature (392)..(392): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccaggggaaanagccaccctctcctgcagggccagtcagagtattagcagcaacttagcctggtaccagcagaacctgggcaggctcccaggctcctcatctatggtgcatccaccagggccacgtggtactcccagccaggttcagtgcagtgggtctgggacagngttcactcncaccatcagcagcctgcagtctgaagtntttgctaatttatactgtcagctagtataactactggcctcgcttcggaccaggacacgtacgtggaagtaacttaaacgaacttggtagctgacctacattctgtc

SEQ ID NO: 230062 - DNA, 541 bp, Homo sapiens
  misc_feature: GYAE6OF02GOPSL.47.84.H07.1.454.CMB.1.raw
  modified_base (200)..(200): a, c, t, g, unknown or other
  misc_feature (200)..(200): n is a, c, g, or t
  modified_base (308)..(308): a, c, t, g, unknown or other
  misc_feature (308)..(308): n is a, c, g, or t
  modified_base (365)..(365): a, c, t, g, unknown or other
  misc_feature (365)..(365): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagtgatgacgcagtctccagccaccctgtctgtctctccgaggggaaangccaccatctcctggtagggccggtcagagtattagcatcaacttagcctggtaccagcagagacctgggcaggctcccaggctcctcatctatgatgcatccaacgngggacccacgtggcactccagacaggttcagtggcaggtggtctgggacagacttcnctcacacatcagcagcctagacgctagaagtctttaggtactttattactgtcagcagtcgttgtacgttcgtcgtccctccgcttcgtaccgtttcgggcgggtacgggtaccgtaggggtacgtaacgtagtacggaaacggtacgttgggtacggtctcggacccaccgtacg

SEQ ID NO: 230063 - DNA, 532 bp, Homo sapiens
  misc_feature: GYAE6OF02HKVOH.47.84.H07.1.454.CMB.1.raw
  modified_base (200)..(200): a, c, t, g, unknown or other
  misc_feature (200)..(200): n is a, c, g, or t
  modified_base (223)..(223): a, c, t, g, unknown or other
  misc_feature (223)..(223): n is a, c, g, or t
  modified_base (361)..(361): a, c, t, g, unknown or other
  misc_feature (361)..(361): n is a, c, g, or t
  modified_base (388)..(388): a, c, t, g, unknown or other
  misc_feature (388)..(388): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtctctccgaggggaaangccacatctcctgtagggccgtnagagtattagcatcaattgcctggtaccagcagagacctggcaggctccaggctcctcatctatgatgcgtccacgagggccacgtcggtttcccagcaggttcagtgcagtgcgtcgtggacagagttcactctacncatacacagcctgctagtctagaagtntttgctagtttatactgtcagcagtactcgtataacgtggcctctccgaccgttcggaccgtaagggaccacggtacgtggaacgtaacttaaaaccggaacgttggtacggtccttacggacctaaccgtacttacgttacgg

SEQ ID NO: 230064 - DNA, 533 bp, Homo sapiens
  misc_feature: GYAE6OF02HR1XV.47.84.H07.1.454.CMB.1.raw
  modified_base (199)..(199): a, c, t, g, unknown or other
  misc_feature (199)..(199): n is a, c, g, or t
  modified_base (314)..(314): a, c, t, g, unknown or other
  misc_feature (314)..(314): n is a, c, g, or t
tcagagctcacgtacacgaccggtgctcgatttagcagacgtctgtcgcgggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggtcagtcagagtgttgacagctacttagtctggtaccaagagaaacctggccaggctcccaggctcctcatcgtgggatgcatccaacaggggccnctggcatcccagccaggttcagtggcaggtgggtctgggacagacttcacttctcacatcagcagcctagacgcctagaagtattttagactaacttactactgtacaacgtagagttaccggtacccgtactactttggccgacgggaccaacgtgacatacaacgactgtcgcgtcgacaccattcgtcgttcttctacttccttcccgcctatccg

SEQ ID NO: 230065 - DNA, 497 bp, Homo sapiens
  misc_feature: GYAE6OF02IF9TD.47.84.H07.1.454.CMB.1.raw
  modified_base (199)..(199): a, c, t, g, unknown or other
  misc_feature (199)..(199): n is a, c, g, or t
  modified_base (255)..(255): a, c, t, g, unknown or other
  misc_feature (255)..(255): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccatcggagaagttgtgttgacacagtctccagccaccctgtctttgtctccaggggaaangccaccctctcctgcagggccagtcagatattcactcctattagtctggtaccaanagaaacctggccaggctcccaggctctcatctatgatgcatccaacagggccactgacatcccagccaggttcagtggcagtgagtctgggacagacttcactctcaccatcagcacgcctgcagcctgaagatgttgactaacttattactagtacaaaaatataaacagtacgcccgctctacgtttcggcggacggacgaggtgagagtacaaacgactgtgctgcaccatctcgtctc

SEQ ID NO: 230066 - DNA, 695 bp, Homo sapiens
  misc_feature: GYAE6OF02HZ8KI.47.84.H07.1.454.CMB.1.raw
  modified_base (199)..(199): a, c, t, g, unknown or other
  misc_feature (199)..(199): n is a, c, g, or t
  modified_base (399)..(399): a, c, t, g, unknown or other
  misc_feature (399)..(399): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggcctcccagataccactggagaaatagtgatgacgcagtctccagccaccctgtctgtctctcgaggggaangccaccatctcctggtacgggccggtcaggagttatagcatccaattagcctggtaccagcagacgactgggcacggctccgaggctctcatctaatgatcgctccaccacggggtccacgtcggtttcccacgtccgtaggttcagtcgggctaggtcgggtcgtagggactacgtacgttcaacgttctaccgaaccngttccgaagtccgaacggtcccgttacggaccgtacggttacgtacggtaacggttacttttacgaacttaaacgtttttagttaccgttcgttaacgacgtaacgttaagttaaacgttaaacttaacgtcgggtaccttccggttaccgttaccgggtaccgtaaacggggtaaccgtaccggtaacgttacggtaacggtaaacgttaaacccggttagtaacggttaccgggtccgttacggggtaaccctacccgttacggtttaccgttaccggttaccgttttaacccg

SEQ ID NO: 230067 - DNA, 678 bp, Homo sapiens
  misc_feature: GYAE6OF02JDWNC.47.84.H07.1.454.CMB.1.raw
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccaggggaaagagcccaccctctcctgcagggccagtcagagtattagcagcaacttagcctggtaccagcagaacctgggcaggctcccaggcctcctcatctagtggtgctagtcccaccgagggcccacgtggtactcccgacgccaggtttccaggtgggacaggttcggggtctaggggacaggtaggtttccaccttcgtcgaaccctgtccaacggtccaaggtcccttggacgtacgttactacgggtaagttactttttggacttaaagtttttaacttaccgttggttaccctaaggtacgtaaggtttaacttaaaacgttaaccggttggtacccgttaccggtaccgtttaccgggacccgtaacggggtaaccctacggtacgtaccgggtaaattaaaccggtttaaaaccggtaacggttcggttaccggtacgtttacggaacccgtaccgtacgtttaccgtcggtttaccc

SEQ ID NO: 230068 - DNA, 586 bp, Homo sapiens
  misc_feature: GYAE6OF02HL026.47.84.H07.1.454.CMB.1.raw
  modified_base (200)..(200): a, c, t, g, unknown or other
  misc_feature (200)..(200): n is a, c, g, or t
  modified_base (296)..(296): a, c, t, g, unknown or other
  misc_feature (296)..(296): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagcccaccctgtctgtgtctccaggggaaanagccaccctctcctgcagggccagtcagagtatagcagcaacttagcctggtaccagcagaacctgggcaggctcccaggcctctcatctatggtncatccacgacgggccacgtggtactcccagcctaggttcaggtgctaggtcgggtcgtaggggactaggacgtttccacttctaccaccgtatcgagacacgccctgcgtacgtcgtagtaagttattttgactttaattttacttacgtgttacagtcgagtacgtagacctaacgtcggtcctctactaccgttccgggacggtacgggtaccgtaggggtggaacgtacgtaccggaacggtaaccggtacgttcggtcggtaccgtacggtacccgtaccgtacgg

SEQ ID NO: 230069 - DNA, 603 bp, Homo sapiens
  misc_feature: GYAE6OF02IPUYF.47.84.H07.1.454.CMB.1.raw
  modified_base (201)..(201): a, c, t, g, unknown or other
  misc_feature (201)..(201): n is a, c, g, or t
  modified_base (300)..(300): a, c, t, g, unknown or other
  misc_feature (300)..(300): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagcccaccctgtctgtgtctccgaggggaaangccaccctctcctgcagggccagtcagagtattagcagcaacttagcctggtaccagcagaaacctgggcaggcctccaggcctcctcatctagtggtncatccaccgagggccactggtactcccagccaggttcagtggacaggtcgagtcgtagggacagtacttcacctctacacctatcacgcacgtcctagcgtacctagaacgtacgtttaggtacttttagttacttgtacagtcgagtcgtgtacgttcgtacggtcccgttccgtccttccgttaccgtttccgggaccgggtacggggtaccggtagggggtcggtaacggtaacgtaaccggaaaccggttaacggttacgggttacggtaccgtacggtacccgtacccgtacgttccg

SEQ ID NO: 230070 - DNA, 613 bp, Homo sapiens
  misc_feature: GYAE6OF02H28WZ.47.84.H07.1.454.CMB.1.raw
  modified_base (198)..(198): a, c, t, g, unknown or other
  misc_feature (198)..(198): n is a, c, g, or t
  modified_base (221)..(221): a, c, t, g, unknown or other
  misc_feature (221)..(221): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagtgatgacgcagtctccagccaccctgtctgtctctcgaggggaangccaccatctctgtagggccgtnagagtatagcatcaattgcctggtaccagcagacgaccgtgggccaggctcccgaggctacctcactctatgatgacgtccacgaggtccacgtcggttcccagtccgaggttagcggctagtcgcgtcgtgggacaggtacgttcacgtctacacactacaacgcgcctagccgtagtcgtagtaagttctttacggacttaagttttaattacgttgttaccagttacaagttactacgtaattaaccgtccggtacctacccgttacttacccggttacggacccggtaacgggaccaccgtacgtacgggaaacgtaaccgtttaaacggaacgtttacgggtacggtaccgtcggtaaccctaacgttacttccggtactttacccg

SEQ ID NO: 230071 - DNA, 679 bp, Homo sapiens
  misc_feature: GYAE6OF02I71QW.47.84.H07.1.454.CMB.1.raw
  modified_base (211)..(211): a, c, t, g, unknown or other
  misc_feature (211)..(211): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactcgtggcctcccagactaccacgtggaagaaataggagatgacgctagtcctccagcccacctgtctgtcgtcctccgaaggggaaancgcccacctctcctgacgacggtccagtcagtagtatacgcagactaacttacgccgtaggaccagacaacgaaaccgtgggacacggtcctcccgaggtcctccgtacattacgtagttcggcaccactcccgaacggacgggacctacgttaggtacctcccgagtccgtaggttaccaggtccggagtacggttcgggtcgtacggggaacgtagtacgttccaaccgttccgtaccaaccgtatccgaagccgtacgtccctagccgtacggttactagggtaaacgtttcgttttacgaacgtttaaacgttttacttacgttcgttacgacgttaactaaggttaactaaacgtacgtccgtacctcgtacgttacggaaccgtaacggtaccagtaacgtggaaacgttaacttaaacgaccgtggtacgtacgtcgtacctaagtccttcgtacgttacc

SEQ ID NO: 230072 - DNA, 655 bp, Homo sapiens
  misc_feature: GYAE6OF02G9Q5G.47.84.H07.1.454.CMB.1.raw
  modified_base (200)..(200): a, c, t, g, unknown or other
  misc_feature (200)..(200): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccgaggggaaancgccaccctctcctgcagggccagtcagagtattagcagcaacttagcctggtaccagcagaacctgggcaggctccaggcctcctcatctatcggtgcactccaccgacgggccacgtggtactcccagtccgagttcagtggctaggtcgggtctgggacaggtacgtttccacttcctccaaccgtataccgaacgcctacggtccctggacctaggttctaggtaagttactttttacggaacctttaaagtttttactttaccgtttaggtaccaaggttacttaaggtttaaacttaaacgttaacccgttcgggacccctttcgtaaccggtttacccgggaaccgtaaaccggggaccttaccgggacgttacgggaacgttaaccgttaaaacggaacgtttggtacggacgttcggtacccaaccgtacgttccgttacttcccg

SEQ ID NO: 230073 - DNA, 350 bp, Homo sapiens
  misc_feature: GYAE6OF02HLCJ2.47.84.H07.1.454.CMB.1.raw
  modified_base (346)..(350): a, c, t, g, unknown or other
  misc_feature (346)..(350): n is a, c, g, or t
tcagagctcacgtacacgaccggtgctcgatttagcagacgtctgtcgcggggccgattcaccgtctccagagacaattccaagaacacgctatatttgcaaatgaacagcctgagacctgaggacacggctgtgtattactgtacgagaccttatggcggggactactttgactactggggccagggaaccctggtcaccgtctcctcagcctccaccaagggcccatcggtcttccccctggcaccctcctccaagagcacctctgggggcacagcggccctgggctgcctggtcaaggactacttcctacgtgagctctgagcgggctggcaaggcgcatagnnnnn

SEQ ID NO: 230074 - DNA, 513 bp, Homo sapiens
  misc_feature: GYAE6OF02GXQ8J.47.84.H07.1.454.CMB.1.raw
  modified_base (199)..(199): a, c, t, g, unknown or other
  misc_feature (199)..(199): n is a, c, g, or t
  modified_base (297)..(297): a, c, t, g, unknown or other
  misc_feature (297)..(297): n is a, c, g, or t
  modified_base (306)..(306): a, c, t, g, unknown or other
  misc_feature (306)..(306): n is a, c, g, or t
  modified_base (363)..(363): a, c, t, g, unknown or other
  misc_feature (363)..(363): n is a, c, g, or t
  modified_base (392)..(392): a, c, t, g, unknown or other
  misc_feature (392)..(392): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccaggggaaanagccaccctctcctgcagggccagtcagagtattagcagcaacttagcctggtaccagcagaaacctgggcaggctcccaggctcctcatctatggtncatccaccngggccactggtatcccagccaggttcagtgcagtgggtctgggacagagttcactcncaccatcagcagcctgcagtctaggaatntttgactaatttattactgtcagtctagttataatactgcctcgcttcggacgaagggcacgacgtggaataacgttaaacgacttggtaggacgtacggacctaccgtattccgtgttac

SEQ ID NO: 230075 - DNA, 626 bp, Homo sapiens
  misc_feature: GYAE6OF02IOYHJ.47.84.H07.1.454.CMB.1.raw
  modified_base (199)..(199): a, c, t, g, unknown or other
  misc_feature (199)..(199): n is a, c, g, or t
  modified_base (224)..(224): a, c, t, g, unknown or other
  misc_feature (224)..(224): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagagaccactggagaaatagtgatgacgcagtctccagccacctgtctgtctctccgaggggaaancgccacatctcctgtacgggccgtnagagtattagcatcaacttagcctgtaccagcagagacctgggcaggcctccaggcctcctcatctatgatgcgtccaccgagggccacgttcggtttcccagccgtaggttcaggtggctagtcgcgtcgtgggacaggtacgttcactccgtaccacctataccaacgacgtccctgactagttccgtagtaagttattttacggacttagttttacttaacgttgtacagtctaagttattactaagttaaccgtgggtccctaccttacccgtacccgtttccgggaacccgtaaacggggaccctaccgggtaacgttacgggtaaacgtaaacgttttaaaccggaacgttagggttacggtacgttacgaaccctaccgtacttaccgtttaccg

SEQ ID NO: 230076 - DNA, 647 bp, Homo sapiens
  misc_feature: GYAE6OF02I57EP.47.84.H07.1.454.CMB.1.raw
  modified_base (200)..(200): a, c, t, g, unknown or other
  misc_feature (200)..(200): n is a, c, g, or t
  modified_base (214)..(214): a, c, t, g, unknown or other
  misc_feature (214)..(214): n is a, c, g, or t
  modified_base (321)..(321): a, c, t, g, unknown or other
  misc_feature (321)..(321): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccgaggggaaangcccaccctctccngcagggccagtcaagagtatagcagctaacttgtcgtcggtaaccagacaacgtaaaccgtgggacacggctacccgaggcctacctacgtaactctagtcggtacnctactcccgaccgacgggtcccaacgttcggtaacctccccgacggtacccgtaacgggttccaaggtcggccgtaacggttggggtccgtaggggaacctaggtacgttccgaacgtccttacgacgtactcgaacgtcgacgtccgtcgacgtgtacgtagaagttacgtttagactttaatttacgttacttcgtactagacttaagtaatacgtaacgcggtacctcgtcgttacgaaccgtacgtactacggtacgtaggaacgtaacgttaacgtacgtacggtacgtacgtcgtacaaccgtcgttaccgttgtaaccg

SEQ ID NO: 230077 - DNA, 544 bp, Homo sapiens
  misc_feature: GYAE6OF02FME9W.47.84.H07.1.454.CMB.1.raw
  modified_base (287)..(287): a, c, t, g, unknown or other
  misc_feature (287)..(287): n is a, c, g, or t
  modified_base (385)..(385): a, c, t, g, unknown or other
  misc_feature (385)..(385): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccaggggaaagagccaccctctcctgcagggccagtcagagtattagcagcaacttagcctggtaccagcagaaacctgggcaggctcccaggctcctnatctatggtgcatccaccagggccactggtactcccagccaggttcagtggcaggtgggtctggggacagagttcactctacaccatcagcagcctanacgtctagagtattttgactaattttattactgtcagtctagttaataaattaaccgtggtcctcgtacgttcggaccgaacggggtacacgtacgtaggaagtaacgttaaacgaacgtggtacggtcgtacggaccgacctatcctaggtcttaccg

SEQ ID NO: 230078 - DNA, 482 bp, Homo sapiens
  misc_feature: GYAE6OF02JD21J.47.84.H07.1.454.CMB.1.raw
  modified_base (293)..(293): a, c, t, g, unknown or other
  misc_feature (293)..(293): n is a, c, g, or t
  modified_base (381)..(381): a, c, t, g, unknown or other
  misc_feature (381)..(381): n is a, c, g, or t
  modified_base (398)..(398): a, c, t, g, unknown or other
  misc_feature (398)..(398): n is a, c, g, or t
  modified_base (451)..(451): a, c, t, g, unknown or other
  misc_feature (451)..(451): n is a, c, g, or t
  modified_base (455)..(455): a, c, t, g, unknown or other
  misc_feature (455)..(455): n is a, c, g, or t
  modified_base (476)..(476): a, c, t, g, unknown or other
  misc_feature (476)..(476): n is a, c, g, or t
  modified_base (479)..(479): a, c, t, g, unknown or other
  misc_feature (479)..(479): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccaggggaaagagccaccctctcctgcagggccagtcagagtatagcagcaacttagcctggtaccagcagaacctggcaggctccaggctcctcatctatggtncatccaccgagggcccacgtggtactccccgagccaggttcaggtggctaggtgggtctggggacagacgttcactctcacatcagcngcctgcagtctagaatntttgctaatttatactgtcagcagtataatactgctcgctcgcagacacgtcngganacgtaacagtgtgctgaccantcngtc

SEQ ID NO: 230079 - DNA, 599 bp, Homo sapiens
  misc_feature: GYAE6OF02HYL4C.47.84.H07.1.454.CMB.1.raw
  modified_base (199)..(199): a, c, t, g, unknown or other
  misc_feature (199)..(199): n is a, c, g, or t
  modified_base (295)..(295): a, c, t, g, unknown or other
  misc_feature (295)..(295): n is a, c, g, or t
tcagagctcacgtacacgaccggtgctcgatttagcagacgtctgtcgcgggggaggaactgctcagttaggacccagacggaaccatggaagcccccagcgcagcttctcttcctcctgctactctggctcccagataccactggagaaatagagatgacgcagtctccagccacctgtctgtgtctccgaggggaangccaccctctcctgcagggccagtcagagtatagcagcaacttagcctggtaccagacagaacctgggcaggctcccaggctcctcatctatggtncactcccaccgagggcccagtggtactccccgaggcctaggttcaggtcggcaggtgggtactggggactaggacgttcacgtctcaaccatcacgctacgcctgactagtctagtaagttagttttcgacttaattttacttacgttagtcgtaacgtataaggttaataagttaaccgttcggtacccttacgttccgttaccggaccgtaacgggaccgtacggtacgtacggaagttaaaccttaaccggtaacgtcggtaacggtcgtacggtacccgaccgtacgttcgtagttaccc

SEQ ID NO: 230080 - DNA, 581 bp, Homo sapiens
  misc_feature: GYAE6OF02IC4XK.47.84.H07.1.454.CMB.1.raw
tcagagctcacgtacacgaccggtgctcgatttagcagacgtctgtcgcgggggaggaactgctcagttaggacccagacggaaccatggaagccccagctcagcttctcttcctcctgctactctggctcccagataccatcggagaagttgtgttgacacagtctccagccaccctgtctttgtctccgaggggaaagcgccaccctctcctgcagggccagtcagaatacttcactcctattagcctggtaccaacagaacctggtcaggctccaggctcctcatctatgatgcatccaacagggccactggccatcccagaccgagttcagtgctaggtgggtcagggactagtacttcacgtctaccaactactcagcacgacctagacgcgtagaacgtacgtttaggtactttacttacgtcgttacgtacgcgtagtcgtacgtacgttctacggtcctcccgtcttcgtaccggtttccggaccgggacgggtacgtaggggtcggacgtacgtaacggaaaccggtacgtggtccggtactcggacctaccgtatcgttacgtccttaccg

SEQ ID NO: 230081 - DNA, 535 bp, Homo sapiens
  misc_feature: GYAE6OF02GJHWU.47.84.H07.1.454.CMB.1.raw
  modified_base (199)..(199): a, c, t, g, unknown or other
  misc_feature (199)..(199): n is a, c, g, or t
  modified_base (299)..(299): a, c, t, g, unknown or other
  misc_feature (299)..(299): n is a, c, g, or t
  modified_base (401)..(401): a, c, t, g, unknown or other
  misc_feature (401)..(401): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccaggggaaanagccaccctctcctgcagggccagtcagagtattagcagcaacttagcctggtaccagcagaaacctgggcaggctcccgaggcctcctcatctatggtncatccacgagggccacgtggtactcccagccaggttcagtggcagtgggtctgggactaggattcactctccacctatcagcagcctgcagtctagtaagtntttgactaatttattactgtcagtctagtaataagtaactggcctcgtccttcggacaagggacctacgacgtggaacgtaacttaaacggaacgttagtacggacttcggacctacctagttcccgtgttacc

SEQ ID NO: 230082 - DNA, 581 bp, Homo sapiens
  misc_feature: GYAE6OF02GTUIX.47.84.H07.1.454.CMB.1.raw
  modified_base (201)..(201): a, c, t, g, unknown or other
  misc_feature (201)..(201): n is a, c, g, or t
  modified_base (298)..(298): a, c, t, g, unknown or other
  misc_feature (298)..(298): n is a, c, g, or t
  modified_base (382)..(382): a, c, t, g, unknown or other
  misc_feature (382)..(382): n is a, c, g, or t
  modified_base (391)..(391): a, c, t, g, unknown or other
  misc_feature (391)..(391): n is a, c, g, or t
  modified_base (415)..(415): a, c, t, g, unknown or other
  misc_feature (415)..(415): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagcccaccctgtctgtgtctccgaggggaaangccaccctctcctgcagggccagtcagagtatagcagctaacttgcctgtaccagcagaaccgtgggcaggctccgaggctccgtcatctatggtcnctactccacgacggccacgtgtactcccagccaggttcaggtcggctaggtgggtcgtgggactagtcgttacacttctccacntacgacgcncgcctgcctagtcgtagtaagttntttacgacttaagttttattaccgtgtacagtactaagttaactaacttacgtcgtaccgttcgtaccgttacggaccgtaaggcctacggacggttaggaaacttaacgttaaaccggagttacggtacgcgtacggacctaccgtacttccggttacttacccg

SEQ ID NO: 230083 - DNA, 554 bp, Homo sapiens
  misc_feature: GYAE6OF02FUOMX.47.84.H07.1.454.CMB.1.raw
  modified_base (199)..(199): a, c, t, g, unknown or other
  misc_feature (199)..(199): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccaggggaaangccaccctctcctgcagggccagtcagagtattagcagcaacttagcctggtaccagcagaaacctgggcaggctcccaggctcctcatctatgatgcgtccaccagggccacgtcggtttcccagccaggttcagtggcagtcgcgtcgtgggacagtagttcactctcaccatcaacagcctgcagtctgaagtatttgcttagtttattacgtgtcagtcagttactcattaacgtcggtccgtcttccgtacccgttcgggacctaacggggacccaagggtacggaaactaccggaaaacgtacgttacggtaggccgttacgacccgtaaccacgttccgttgttaccc

SEQ ID NO: 230084 - DNA, 558 bp, Homo sapiens
  misc_feature: GYAE6OF02HFKC7.47.84.H07.1.454.CMB.1.raw
  modified_base (199)..(199): a, c, t, g, unknown or other
  misc_feature (199)..(199): n is a, c, g, or t
  modified_base (383)..(383): a, c, t, g, unknown or other
  misc_feature (383)..(383): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctttgtctccaggggaaanagccaccctctcctgcagggccagtcagaatattcactcctactagcctggtaccaacagaaacctggtcaggctcccaggctcctcatctatgatgcatccaacgagggccactggcactcccagacaggttcagtggcaggtcgggtctgggacagtacttcactctacacctataccaacncgcctgcagtctagtaagtattttgcttagtttattcgtgtcagtctagtatacaattacgtcggccgtacttccgtacccgttcggaccgtaagggaccacggacgtaggaacgtaacgttaaaccggaacgttggtaggtaccgtaggacctaccgtacttccgtacgttacc

SEQ ID NO: 230085 - DNA, 528 bp, Homo sapiens
  misc_feature: GYAE6OF02GRLCN.47.84.H07.1.454.CMB.1.raw
  modified_base (199)..(199): a, c, t, g, unknown or other
  misc_feature (199)..(199): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccaggggaaangccaccctctcctgcagggccagtcagagtattagcagcaacttagcctggtaccagcagaaacctgggcaggctcccaggctcctcatctatggtgcatccaccagggcccactggtactcccagccaggttcagtggcaggtgggtctgggacagagttcactctcacctatcagcagcctgctagtctagtaagtattttgacttaatttattactgtcagctagtaataataacgtggtccttcgtcttcggaccgtaagggacacgacgtacgggaataacttaaacgacttaggtacgcgtacgaccgtacctatccttgtcc

SEQ ID NO: 230086 - DNA, 870 bp, Homo sapiens
  misc_feature: GYAE6OF02H4CM4.47.84.H07.1.454.CMB.1.raw
  modified_base (151)..(151): a, c, t, g, unknown or other
  misc_feature (151)..(151): n is a, c, g, or t
  modified_base (862)..(862): a, c, t, g, unknown or other
  misc_feature (862)..(862): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagatacccactggggaanaagtagagtagtacggaccgactacgttccctaccgaccgacccctaccgtcgttcgtggttcgtaccgtaccggggaaaggggaaacggaccgcccctaccccttccctccgtcggacggaccggaccgtacgtacgaaggtagttagtacgacgacgaaccttaacggtaccgtccgttaccggtaaccgacggtaccgaaaaccggtaaccgggtcgggaccggaccggtccccttaccccggaacggttccccttacccgtaacttaaccttttaccgttagggttcgggtaccaccgttacctaccccgaaccgggccggtaccgtaaccggttacggtaacccctacccggtaccgtaccggttaacggttcgtaacgggtcggtacggtaggggttcggtacggtacgggacgtacggttacgtaccctaccttaccgaccctaaccgtataccggacgtaccgaccgttcgcgtacggtaccgttacgtaaggtattttaacggtttactaaacgtttttaactttacgttacgttcgtaacgttagtagttaacgttaactttaaacgtccggtaccgttcccgttcttaaccgggtaccggaaaccggaaggtaaccaccggtaaggtaacggtaaggttaaccgttaaaccggtggttacgtacggtacgacccgtaacgtaccggtaatttcccggttntttacccg

SEQ ID NO: 230087 - DNA, 657 bp, Homo sapiens
  misc_feature: GYAE6OF02IIBTY.47.84.H07.1.454.CMB.1.raw
  modified_base (204)..(204): a, c, t, g, unknown or other
  misc_feature (204)..(204): n is a, c, g, or t
  modified_base (217)..(217): a, c, t, g, unknown or other
  misc_feature (217)..(217): n is a, c, g, or t
  modified_base (299)..(299): a, c, t, g, unknown or other
  misc_feature (299)..(299): n is a, c, g, or t
  modified_base (309)..(309): a, c, t, g, unknown or other
  misc_feature (309)..(309): n is a, c, g, or t
  modified_base (311)..(311): a, c, t, g, unknown or other
  misc_feature (311)..(311): n is a, c, g, or t
  modified_base (330)..(330): a, c, t, g, unknown or other
  misc_feature (330)..(330): n is a, c, g, or t
  modified_base (334)..(334): a, c, t, g, unknown or other
  misc_feature (334)..(334): n is a, c, g, or t
tcagagctcacgtacacgaccggtgctcgatttagcagacgtctgtcgcgggggaggaacgtgctcagttaggacccagacggaaccatggaagccccagcgcagcttctcttcctcctgctactctggcctcccagataccactggagaaatagagatgacgcagtctccagccaccctgtctgtagtctccgaaggggaaangccaccctctccngcagggcctagtcagagtatagcagctaacttagccgtaggtaccagaccaagaaaccgtggcaggcctcccgagcctcctnatctatggtncntcccacgacgggcctacgngtanccccagcctagtcgatggcagtgggtctggggacagtagtttccaacttcctcgaaccgtatacgacgacgaacggtcccgtggcctaggttccgtaggaacgtttacgtttaggtacttaaacttttacgtttaacccgtagttcgtaacgtctaacgttaattaaacgtaaacgttcggtaccctacgtacccggtttacggaacccgaaggggtaacccgacggtaacggtaccggtaaaggtaaacccgttaaacggtaaaccgttccgttaaggggttccacgggtaacccttaaccggtacgtaccgttacgttccg

SEQ ID NO: 230088 - DNA, 559 bp, Homo sapiens
  misc_feature: GYAE6OF02GFDR6.47.84.H07.1.454.CMB.1.raw
  modified_base (353)..(353): a, c, t, g, unknown or other
  misc_feature (353)..(353): n is a, c, g, or t
  modified_base (362)..(362): a, c, t, g, unknown or other
  misc_feature (362)..(362): n is a, c, g, or t
  modified_base (374)..(374): a, c, t, g, unknown or other
  misc_feature (374)..(374): n is a, c, g, or t
  modified_base (402)..(402): a, c, t, g, unknown or other
  misc_feature (402)..(402): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccaggggaaagagccaccctctcctgcagggccagtcagagtattagcagcaacttagcctggtaccagcaagaaacctgggcaggctcccaggcctcctcatctatggtgcatccaccgagggccactggtactcccagcctaggttcagtggcaggtgggtcngggacagtnttcactctcacntcgagcagcctgctagtctagtaacgtntttcgactaattttactactgtacagtctaagtattaactacgtgtaccttcgacgttccggaccgaacgggaccgtacgacgtagggaacgtaaaccgtttaaaccggaacgtttgacggtacgttacgacccgacctacgttacgtgttaacccg

SEQ ID NO: 230089 - DNA, 554 bp, Homo sapiens
  misc_feature: GYAE6OF02G0P3V.47.84.H07.1.454.CMB.1.raw
  modified_base (201)..(201): a, c, t, g, unknown or other
  misc_feature (201)..(201): n is a, c, g, or t
  modified_base (385)..(385): a, c, t, g, unknown or other
  misc_feature (385)..(385): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccgaggggaaagngccaccctctcctgcagggccagtcagagtattagcagcaacttagcctggtaccagcagaaacctgggcaggctcccaggctcctcatctatggtgcatccaccgagggccactggtactcccgagccaggttcaggtggcaggtgggtctgggacagtagttcactctcacctataccaacncgcctgcagtctagtaagtattttgacttagttttattacgtgtacagtctagttatacaattaacgtggcctctcctaccgttccgggaccgtaagggaccacggtacgtagggaacgtaagttaaaccgacgttaggtacggcttcggacctaccgtattccgttcg

SEQ ID NO: 230090 - DNA, 506 bp, Homo sapiens
  misc_feature: GYAE6OF02GJDOG.47.84.H07.1.454.CMB.1.raw
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccaggggaaagagccaccctctcctgcagggccagtcagagtattagcagcaacttagcctggtaccagcagaaacctggtcaggctcccaggctcctcatctatgatgcactccaacagggccactggcatcccagacaggttcagtggcagtgggtctgggacagacttcactctcaccatcagcagcctagacgcctgaacgtactttggactttattactgtcagcagcgtgagttcgtgcctcgctctacgtttcggcggagggaccgagggtggagtatacgaaacgtacgtggtcggctcggccacctacg

SEQ ID NO: 230091 - DNA, 741 bp, Homo sapiens
  misc_feature: GYAE6OF02JAKTD.47.84.H07.1.454.CMB.1.raw
  modified_base (163)..(163): a, c, t, g, unknown or other
  misc_feature (163)..(163): n is a, c, g, or t
  modified_base (199)..(199): a, c, t, g, unknown or other
  misc_feature (199)..(199): n is a, c, g, or t
  modified_base (208)..(208): a, c, t, g, unknown or other
  misc_feature (208)..(208): n is a, c, g, or t
  modified_base (215)..(215): a, c, t, g, unknown or other
  misc_feature (215)..(215): n is a, c, g, or t
  modified_base (293)..(293): a, c, t, g, unknown or other
  misc_feature (293)..(293): n is a, c, g, or t
tcagagctcacgtacacgaccggtgctcgatttagcagacgtctgtcgcgggggaggaactgctcagttaggacccagacggaaccatggaagccccagctcagcttctcttcctcctgctactctggctcccagataccatcggagaagttgtgttgacacngtctccagccaccctgtctttgtctccaggggaaangccaccctntcctgcnggccagtcagaatattcactctacttagcctgtaccacagaacctggtcaggctcccaggtctcctcatctatcgtancgcataccaacgagggccacgtggaccacgtcccacgtacacggttctaaggtcggtccgtaaggtcgggttacgtacgggggtaacacggttaacctttccgtaaccttccgtaccctaccgtaacgttccgaacgggtcccaaacggtacccttaaggaacccggtacccgttaaggtaaaccgtaaccggtttttcggtaaacctttttacgtttaaccgtttacggtaccgttaacggaccgttaggtacccggttaggttaaccggtttcggtttacccgggccctttacccgcccgtttaacgttacccgttttaccgggggaccggtaccggggggaacccgttgggggttaccggaggtaacttaacggaaaaccggttagtaaccgggtccggtacgtacggtaccaaccgttacgttcgttaccgttccgtttaaccg

SEQ ID NO: 230092 - DNA, 593 bp, Homo sapiens
  misc_feature: GYAE6OF02GLLYD.47.84.H07.1.454.CMB.1.raw
  modified_base (201)..(201): a, c, t, g, unknown or other
  misc_feature (201)..(201): n is a, c, g, or t
  modified_base (217)..(217): a, c, t, g, unknown or other
  misc_feature (217)..(217): n is a, c, g, or t
  modified_base (259)..(259): a, c, t, g, unknown or other
  misc_feature (259)..(259): n is a, c, g, or t
  modified_base (408)..(408): a, c, t, g, unknown or other
  misc_feature (408)..(408): n is a, c, g, or t
  modified_base (453)..(453): a, c, t, g, unknown or other
  misc_feature (453)..(453): n is a, c, g, or t
  modified_base (588)..(588): a, c, t, g, unknown or other
  misc_feature (588)..(588): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtcctccagccaccctgtctgtgtctccgaggggaaanacgcccaccctctccngcagggccagtcagagtgtggcagctatgcctaggtaccaanacgaacctggaccaggcctcccgaggcctcctcatctatgatgctactaccaacgacgggcccaacgtgaccaccgtcccagtcccgtaggttcaggtggactaggtgagtcgtagggaacacgtacttcactctaccacctatacgancacgtcagacgtctagtaattatttgactttacgtttattacgtntacgaacgtactaaacgtaacgtacgtcggtaccctcgtaccttaccgtaacggttcgggacgggtacgggaccgtaggggtcgtaacgtaaggtaacggaaaccgttagtggtacggccgttgacccgtaactnttccg

SEQ ID NO: 230093 - DNA, 539 bp, Homo sapiens
  misc_feature: GYAE6OF02IUH4U.47.84.H07.1.454.CMB.1.raw
  modified_base (398)..(398): a, c, t, g, unknown or other
  misc_feature (398)..(398): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccgaggggaaagagcccaccctctcctgcagggccagtcagagtattagcagcaacttagcctggtaccagcagaaacctgggcaggctccaggctcctcatctatggtgcatccaccgagggccactggtactcccgagccaggttccagtcgcagtgggtctgggacagagttcactctcacatcagcacgctgcagtcgtagaagtntttgactaatttacttactgtcagtcagtataataactcggtactcgtctacggtacgaacggacacggtacgtaggaacgtaacttaaacggtaacgtagtacggtacgtacgtaccgaacctacgttactacgttaccg

SEQ ID NO: 230094 - DNA, 543 bp, Homo sapiens
  misc_feature: GYAE6OF02IHX0V.47.84.H07.1.454.CMB.1.raw
  modified_base (200)..(200): a, c, t, g, unknown or other
  misc_feature (200)..(200): n is a, c, g, or t
  modified_base (335)..(335): a, c, t, g, unknown or other
  misc_feature (335)..(335): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagattccaccggagacattgttttgacacagtctccagcccaccctgtctttgtctccaggggaaangccaccctctcctgcagggccagtcagaatattcactcctacttagcctggtaccaacagaaacctggtcaggcctcccgaggcctcctcatctatgatgcatccaacgagggccacgtggctactcccgagacnggttcagtggcaggtgggtctgggacagtactcactctacaccatcagcagctagacgctagagtactttaggtactttattacgtgtctagctagtcgtgtagttcgtcgtccgtccgtctcgtacgtttcggcggacggtaccgagggtggagtacgtaacgaacgtacgtaggcggtcgtacgacgtacctgtctgtctactacc

SEQ ID NO: 230095 - DNA, 527 bp, Homo sapiens
  misc_feature: GYAE6OF02FLLSK.47.84.H07.1.454.CMB.1.raw
tcagagctcacgtacacgaccggtgctcgatttagcagacgtctgtcgcgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccacgtggcactccccagccaggttcagtcggcagtgagtcgtgggacaggtacttcactctcaccatcagcacgcctagacgcctagaagtatttcgcttactttattacttgtcagcagtcgtagactacgtgcctctctcgtttcggcggtagggaccgagggtggacgacgtacgaggaacgacgtggtcggtcgtcgacaccgtatcgttacg

SEQ ID NO: 230096 - DNA, 504 bp, Homo sapiens
  misc_feature: GYAE6OF02HA39K.47.84.H07.1.454.CMB.1.raw
  modified_base (332)..(332): a, c, t, g, unknown or other
  misc_feature (332)..(332): n is a, c, g, or t
  modified_base (467)..(467): a, c, t, g, unknown or other
  misc_feature (467)..(467): n is a, c, g, or t
  modified_base (499)..(499): a, c, t, g, unknown or other
  misc_feature (499)..(499): n is a, c, g, or t
  modified_base (501)..(501): a, c, t, g, unknown or other
  misc_feature (501)..(501): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccaggggaaagagccaccctctcctgcagggccagtcagaatattcactcctacttagcctggtaccaacagaaacctggtcaggctcccaggctcctcatctatgatcgcatccaacgcgggccacgtggcactccccagacnggttcagtgcagtgggtctgggacagactttcactctccacatcagcagcctagacgctagaagtactttggaacttttatactgtacagcagcgtagagttcgtcgcctccgcttcacgttcggcggacggcgngggtagagatacgaatacgtgcgcgtgctacntntcg

SEQ ID NO: 230097 - DNA, 522 bp, Homo sapiens
  misc_feature: GYAE6OF02ITMC3.47.84.H07.1.454.CMB.1.raw
  modified_base (307)..(307): a, c, t, g, unknown or other
  misc_feature (307)..(307): n is a, c, g, or t
  modified_base (402)..(402): a, c, t, g, unknown or other
  misc_feature (402)..(402): n is a, c, g, or t
  modified_base (425)..(425): a, c, t, g, unknown or other
  misc_feature (425)..(425): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccgaggggaagagcccaccctctcctgcagggccagtcagagtattagcagcaacttgcctggtaccagcagaaacctgggcaggctcccaggcctcctcatctatggtgcatccaccngggcccacgttggtactcccagccaggttcagtggctaggtgggtctgggacagtacgttcactctcacatcagcacgcctgcagtctagacgtntttgactatttattactgtcagntagttaataatactgtactcgtcgtacgacacggacacgtacgtaggaacgtaattaacggaactggtacgtctacgacctactacgttctgttacc

SEQ ID NO: 230098 - DNA, 739 bp, Homo sapiens
  misc_feature: GYAE6OF02J00KU.47.84.H07.1.454.CMB.1.raw
  modified_base (198)..(198): a, c, t, g, unknown or other
  misc_feature (198)..(198): n is a, c, g, or t
  modified_base (206)..(206): a, c, t, g, unknown or other
  misc_feature (206)..(206): n is a, c, g, or t
  modified_base (225)..(225): a, c, t, g, unknown or other
  misc_feature (225)..(225): n is a, c, g, or t
  modified_base (282)..(282): a, c, t, g, unknown or other
  misc_feature (282)..(282): n is a, c, g, or t
  modified_base (304)..(304): a, c, t, g, unknown or other
  misc_feature (304)..(304): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccatcggagaagttgtgttgacacagtctccagccaccctgtctttgctccaggggaaangccacctntcctgcagggccagtcagngtgttggcagctacttagcctggtaccaacagaacctggccagctcccaggctcctnatctatgatcgacatccaacgngggtccaacgtggcactccccagcctaggttccaggtcggacaggttgaggtccgtaggggaacctaggtaacctttcgaactcctaccgaacccgtagttaccgaacggtacctaacggtaccccgttaacgggacgtaccccgttaaggaaaccgttaccggttttacgggttaaaccttttaacgtttaacccgttagttaccgtaagtaccgtaacggttacggtttacggtaacgttttacccggttccgggtaccccgtttacccggtaccgttaacccttaaacccggttttccggggacccgggtaacggggttacccggtaagggggtacggtaaaccggtacgtaaacccggttaaaacgggtaccgtttaggggtaaccggtaccgtaaccggtacctaacccggttacgttacccgtttaccg

SEQ ID NO: 230099 - DNA, 751 bp, Homo sapiens
  misc_feature: GYAE6OF02FPLPB.47.84.H07.1.454.CMB.1.raw
  modified_base (196)..(196): a, c, t, g, unknown or other
  misc_feature (196)..(196): n is a, c, g, or t
  modified_base (303)..(303): a, c, t, g, unknown or other
  misc_feature (303)..(303): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagtgatgacgcagtctccagccacctgtctgtctctccagggaangccaccatctcctggtagggccgtcagagtattagcatcaacttagcctggtaccagcagagacctgggcaggctcccaggctcctcatctatgatgcatccgaacncgggccacgtggctacgtccccgagaccgtaggttaccaggtcggaccaggttcggggtactaggggaacctaggtacctttcgaaccgtttcctaccgtaaccctaattaccgacggaccgtaacggtcccgtaaacggtaccgtacccggttaggtaaacggttaccgtttttacgggtaaccttttttaacgtttaaccgttcggttaccgtaagggtacccgtaaggttccggtttacgggttaaccggttttccggtaccgggttccccgttcccggttacccgtttacccggttaacccggtttttccgggggaccggggttaaccggggggtaaccccggttaacggggggttacgggaacggtaaccggttacccggtaagggtaaccccggtaaacgggttcgggttaccgggtaccgtttaccgggaccctaacccgg

SEQ ID NO: 230100 - DNA, 631 bp, Homo sapiens
  misc_feature: GYAE6OF02I7IWJ.47.84.H07.1.454.CMB.1.raw
  modified_base (201)..(201): a, c, t, g, unknown or other
  misc_feature (201)..(201): n is a, c, g, or t
  modified_base (233)..(233): a, c, t, g, unknown or other
  misc_feature (233)..(233): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatgagatgacgcagtctccagccaccctgtctgtgtctaccgaggggaaaancgccctaccctctccgtgcagggtcagtcagngtgtgacagctacttagctggtaccaagacgaaacctggccaggcctcccgaggcctcctcgatctatgatgcaatccaacgtgggccacgtggccactcccgatacgtaggttcaggtcgacaggttcgggtctgggactagtaccttcgaaccttccgacaaccataccaggacacggtaccctaagcgccgttaggaacgtacgtttcggtacttttaagttactgttacagacctaggtcgttaagtcggtttcgtcggtcccttcccgtctacgttaacccggtttgggaccgggtacggtaccggtacggggttacggaaggtaaccctaacggtaaaccggtaaccggttcggtcggtacccttacgggtaccctaaccgtcgtttaccgg

SEQ ID NO: 230101 - DNA, 586 bp, Homo sapiens
  misc_feature: GYAE6OF02F9OG9.47.84.H07.1.454.CMB.1.raw
  modified_base (202)..(202): a, c, t, g, unknown or other
  misc_feature (202)..(202): n is a, c, g, or t
  modified_base (306)..(306): a, c, t, g, unknown or other
  misc_feature (306)..(306): n is a, c, g, or t
  modified_base (369)..(369): a, c, t, g, unknown or other
  misc_feature (369)..(369): n is a, c, g, or t
  modified_base (396)..(396): a, c, t, g, unknown or other
  misc_feature (396)..(396): n is a, c, g, or t
  modified_base (424)..(424): a, c, t, g, unknown or other
  misc_feature (424)..(424): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagcccaccctgtctgtgtctccgaaggggaaangcccaccctctcctgcagggccagtcagagtatagcagcaacttgcctggtaccagcaagaacctgggcaggcctcccgaggcctcctcattccgtagtcggtncactccgaccgacgggccctacgtcggtactccccgagccaggttcaggtgcaggtgggtcgngggacagtacgttcacgttcaccactntcagccagcctgacagtctaggaagttntttacgacttaattttactacgtcgtcagtactaagttaattaactacgtcgtaccgttcgtccgttacggaccaacgggacacggtacgtaaggtacgtaacgttaaaccggagttaggtacggtacttacggaccgtaacctacggttacctacgttacc

SEQ ID NO: 230102 - DNA, 521 bp, Homo sapiens
  misc_feature: GYAE6OF02HNSWE.47.84.H07.1.454.CMB.1.raw
  modified_base (197)..(197): a, c, t, g, unknown or other
  misc_feature (197)..(197): n is a, c, g, or t
  modified_base (254)..(254): a, c, t, g, unknown or other
  misc_feature (254)..(254): n is a, c, g, or t
  modified_base (292)..(292): a, c, t, g, unknown or other
  misc_feature (292)..(292): n is a, c, g, or t
  modified_base (372)..(372): a, c, t, g, unknown or other
  misc_feature (372)..(372): n is a, c, g, or t
  modified_base (410)..(410): a, c, t, g, unknown or other
  misc_feature (410)..(410): n is a, c, g, or t
  modified_base (420)..(420): a, c, t, g, unknown or other
  misc_feature (420)..(420): n is a, c, g, or t
tcagagctcacgtacacgaccggtgctcgatttagcagacgtctgtcgcggggaggaactgctcagttaggacccagagggaaccatggaagccccagctcagcttctcttcctcctgctactctggctcccagataccatcggagaagttgtgttgacacagtctccagccacctgtctttgtctccaggggaaangccaccctctcctgcagggccagtcagaatattcactcctattagcctggtaccaanagaaacctggtcaggctcccaggctcctcatctatgangcatccaacagggccacgtggcatcccagacaggttcagtggcaggtgggtctggggacagacttcactctcaccatccngcagctagagcctgaagactttggactttatactgttnagtcagcgtnagttctggtcctcgctcgtacttcggacggaggaccgtagggtcggagacgtacaaaccggacgtggtacggcttaggcacctagtacgttcgtacgttcg

SEQ ID NO: 230103 - DNA, 633 bp, Homo sapiens
  misc_feature: GYAE6OF02IAG1B.47.84.H07.1.454.CMB.1.raw
  modified_base (200)..(200): a, c, t, g, unknown or other
  misc_feature (200)..(200): n is a, c, g, or t
  modified_base (225)..(225): a, c, t, g, unknown or other
  misc_feature (225)..(225): n is a, c, g, or t
  modified_base (320)..(320): a, c, t, g, unknown or other
  misc_feature (320)..(320): n is a, c, g, or t
  modified_base (627)..(627): a, c, t, g, unknown or other
  misc_feature (627)..(627): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagagaccactggagaaatagtgatgacgcagtctccagccaccctgtctgtctctccgaggggaaanagccaccatctcctgtagggccgtnagtagtattagcatcaacttagcctggtaccagcagagaccgtgggccagggtcctccccgggcttcccgtcatcctatgtactcgccgtacccnccggacgggcctaccgttcggtttccccaggccctaggttcaggtcggcctaggtcgcgtcggtcgggaacaggtacgtttcacgttcctcgtaaccctacttacaaccgacgtccgtcgactacgtcgttagtaacgtattttacgtacgttaagttttaacttacgttacgtactacgtctaacggttactacgtaacttacgtcggcccgtaccttaccgtacccgttccggaaccgtagggaccacggtacgtaggaacgtaacgtaaacgtaactggtacgtcgtacgacctacgcgttctnttaccg

SEQ ID NO: 230104 - DNA, 749 bp, Homo sapiens
  misc_feature: GYAE6OF02IAD8C.47.84.H07.1.454.CMB.1.raw
  modified_base (236)..(236): a, c, t, g, unknown or other
  misc_feature (236)..(236): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccacctgtctgtgtctccgagggaaagacgccaccctctcctgcagggtcagtcagagtgtgacngctacttagtctggtaccaagacgaacctggccaggcctcccgaggctcctcatcgtggatcgctactacccgaacgcggggtcccgcggtcggcctacctccccgacggtcccgtagggtttccgagggtcgggtaccgaggggttcggggtcgtacggggtaaccacggttaacctttaccgacctttccgtacccgtaacccaacttaccggaacgaccctaaccgggtacccgtaacgggaccggttaccgttaacggtaaaggtttacgttttttcgtaaccgtttaagttttttaacgtttaacgttcggttaacctagtaaaccgtaaaacgtttaaaccgttaccggttcgggttaccccgttacccgtcgttacccgttaccggtttaccgggaaccggggttacgggaccggttagggggttaacggtacggtaacggttaaccggtaaacgtaacgttaggtacggcgttaccggaccgtacctacgttccgtacgtttccc

SEQ ID NO: 230105 - DNA, 595 bp, Homo sapiens
  misc_feature: GYAE6OF02FNYW5.47.84.H07.1.454.CMB.1.raw
  modified_base (201)..(201): a, c, t, g, unknown or other
  misc_feature (201)..(201): n is a, c, g, or t
  modified_base (376)..(376): a, c, t, g, unknown or other
  misc_feature (376)..(376): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagcccaccctgtctgtgtctccgaggggaaangccaccctctcctgcagggccagtcagagtattagcagacaacttgcctggtaccagcaagaaccgtgggcacggcctcccgaggcctcctcatctagtggtgacatcccgaacgcgggccacgttcggtacctccccgagtcctaggttcagggtcggctagggttcgggtcgnggggaacaggtacgttccacttcctccaacctgtccagccacggcctgacctagtctaggaagttctttagacttaattttactactgttacagtactaagttaacttaacgtacgttcggtccttacgtccgttaccggaccgtaagggtaccacggtacggtaggaacgttaacgttaaacggacgtggtgacgtacgacctactcttcgtagttcc

SEQ ID NO: 230106 - DNA, 634 bp, Homo sapiens
  misc_feature: GYAE6OF02F8R8F.47.84.H07.1.454.CMB.1.raw
  modified_base (199)..(199): a, c, t, g, unknown or other
  misc_feature (199)..(199): n is a, c, g, or t
  modified_base (304)..(304): a, c, t, g, unknown or other
  misc_feature (304)..(304): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagcccacctgtctgtgtctccgaggggaangccaccctctcctgcgagggccagtcagagtattagcagccaacttagcctggtaccagcaagaaccgtgggcacggtctcccaggcctcctcatctagtcggtnccactccgacgacgggcctacgttcggtacctcccgacgtccgtagggttccaggtggacctagggttcggggtacgtggggaccaaggtacgtttccaccttcgtaccaacctgtaccgaggtcccacggtcctgacctacgtcttaggtaagtttctttagaactttaattttacgttactgtacagtacttaagttaattaacttacgtcgggtaccttagtccgttccggaccgtaaacgggacctacggtacgtacgggtaactaacgttaaaccgtagttcggtcggtacttcggaccctaacgtacgttccgttacgttaccc

SEQ ID NO: 230107 - DNA, 593 bp, Homo sapiens
  misc_feature: GYAE6OF02I5T9B.47.84.H07.1.454.CMB.1.raw
  modified_base (258)..(258): a, c, t, g, unknown or other
  misc_feature (258)..(258): n is a, c, g, or t
  modified_base (365)..(365): a, c, t, g, unknown or other
  misc_feature (365)..(365): n is a, c, g, or t
  modified_base (402)..(402): a, c, t, g, unknown or other
  misc_feature (402)..(402): n is a, c, g, or t
  modified_base (404)..(404): a, c, t, g, unknown or other
  misc_feature (404)..(404): n is a, c, g, or t
  modified_base (408)..(408): a, c, t, g, unknown or other
  misc_feature (408)..(408): n is a, c, g, or t
  modified_base (418)..(418): a, c, t, g, unknown or other
  misc_feature (418)..(418): n is a, c, g, or t
  modified_base (426)..(426): a, c, t, g, unknown or other
  misc_feature (426)..(426): n is a, c, g, or t
  modified_base (428)..(428): a, c, t, g, unknown or other
  misc_feature (428)..(428): n is a, c, g, or t
  modified_base (433)..(433): a, c, t, g, unknown or other
  misc_feature (433)..(433): n is a, c, g, or t
  modified_base (439)..(440): a, c, t, g, unknown or other
  misc_feature (439)..(440): n is a, c, g, or t
  modified_base (443)..(443): a, c, t, g, unknown or other
  misc_feature (443)..(443): n is a, c, g, or t
  modified_base (460)..(460): a, c, t, g, unknown or other
  misc_feature (460)..(460): n is a, c, g, or t
  modified_base (479)..(479): a, c, t, g, unknown or other
  misc_feature (479)..(479): n is a, c, g, or t
  modified_base (485)..(485): a, c, t, g, unknown or other
  misc_feature (485)..(485): n is a, c, g, or t
tcagagctcacgtacacgaccggtgctcgatttagcagacgtctgtcgcgggccgattcaccgtctccagagacaattccaagaacaacgctatatttgcaaatgaacagcctgagacctgaggacacggctgtgtattacctgtacgagaccttatggcgggactactttgactactgggcagggaccctggtcaccgttctcctcagcctccaccaaggcccatcggtccttccccctggccaccctcctcaacgngtccacctcgtcggggggactacacggcggccccgttggggacttcgcccgtgggttacgaacgggtaccttaccttcccgtttaacggtgaacggcttccgtaggngtaccggggtctgggacgaacgtcggctaaggtagtnanctantcagctgacnacctgacncncgtcncgacgnngtnacgtgcagtcgtcacgncgtcgtaagctacggctcncgacgngtacgtacgtacgtcgtacgtcgtcgtacgtacgtcgtgtccgtacgtacgtacgtacgtacgtcgtacctacgtcgtcgtaccgtacgtacggtacgtacgtcgtcg

SEQ ID NO: 230108 - DNA, 627 bp, Homo sapiens
  misc_feature: GYAE6OF02H1ZJ2.47.84.H07.1.454.CMB.1.raw
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccacctgtctgtgtctccgaggggaaagacgcccaccctcacctgcacgggccagtcagtagtatagcagacaactgcctggtaccagcagaaccgtggcacggcctcccgaggcctcctcatctatgatcgcgtccaccgacggcctacgtcggttccacgccgtacggttcgacgtggcgtaggtcgggtcgtcggggactaggtacttaccgacgttcctacacctactccgacgtaccacggtacctacgtacgtaccgtagtaacgttacgtttacgggtacttttaacttacgtcgtacgtagtaccgtaggtcggtacgtcgttccgtacgcccgttaccgtcgttccgttacggttcggtcgggacgggtaccgaggggttcgacggtagtaccgtaaacggtacgttacggcggtacgtcgaccgtaccctacgttccgtgttaccg

SEQ ID NO: 230109 - DNA, 732 bp, Homo sapiens
  misc_feature: GYAE6OF02JROR3.47.84.H07.1.454.CMB.1.raw
  modified_base (298)..(298): a, c, t, g, unknown or other
  misc_feature (298)..(298): n is a, c, g, or t
  modified_base (307)..(307): a, c, t, g, unknown or other
  misc_feature (307)..(307): n is a, c, g, or t
tcagagctcacgtacacgaccggtgctcgatttagcagacgtctgtcgcgggggaggaactgctcagttaggacccagacggaaccatggaagccccagcgcagccttctcttcctcctgctactctggcctcccagattcccaccggagacatttgttttgacacagttctccagcccacccttgttctttgtcctaccgaggggaaagacgcccaccctctcctgcacgggtccagtcaggagttggttggcagctacttacgcgtcggtaccaacagaaacctggccagctaccnggtcctccnctatctatgagtcgcactccaacgacgggccacgtggcctactacccgacggtcctaaggttccgaacggtcggatacggtagtacgtccggtacgggaacctaggtacctcgtaaccgttaccacctaaacctcggtaccgtacggaccacggttccgtaaaggacccgtacccgtaaggtaacggttttaacttttaccgacgtttaaccgttttaactttacccggttattaccgtaacgtacggtacgtaaccggtttagaaccccggttagttaacccggttcccgttacccttagttaaccccgggttcggaaccggggggttacggtaccggtacgggggttagggtactaaaccgtcggtaaaacggccggtaacggttggtaacgtacggtccgaaccgtcgttacgaccgttccg

SEQ ID NO: 230110 - DNA, 753 bp, Homo sapiens
  misc_feature: GYAE6OF02I2TFS.47.84.H07.1.454.CMB.1.raw
  modified_base (212)..(212): a, c, t, g, unknown or other
  misc_feature (212)..(212): n is a, c, g, or t
  modified_base (260)..(260): a, c, t, g, unknown or other
  misc_feature (260)..(260): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtcctgtgtctccgagggaagcgcccacccttcnccctgcagggccagtcagagtgttggcagctactagcctggtaccaanacgaaacctggaccaggcctaccccgaggcctccctactattcctatgattgacctactccgaaacgccgggcctaacgtcggcctaaccgtaccccgaacggtcccgtaacgggtttaccaaggggtttaccggaccgtaagggttacggtaacgggtttaccggtaggggtaaaccctaaggttaaccctttaccccgaacgtttcccgtaccaacccgtaacgttaccgaaaccgtaccggaacgtcccgttaagggaccgtacccgttaagggtaacgtttacttttacggacccttttaacgtttttaccgttaacgttacggttactacggtaccgtacggtacccgttaagtaccgtaaccgttccggtacccttcggttacccgtacgggtttacccgggcggggtaaccggtacgggcggggttaggaaccgtagttacccgaggttaaccgtacggttcggtacgggcctacgacccgtaacg

SEQ ID NO: 230111 - DNA, 716 bp, Homo sapiens
  misc_feature: GYAE6OF02IAB6Z.47.84.H07.1.454.CMB.1.raw
  modified_base (197)..(197): a, c, t, g, unknown or other
  misc_feature (197)..(197): n is a, c, g, or t
tcagagctcacgtacacgaccggtgctcgatttagcagacgtctgtcgcgggggaggaacgtgctcagttaggacccagacggaaccatggaagcccagcgcagcttctctctcctgctactctggctccagataccactggagaatagagactgacgcagtctccagccacctgtctgtatcgacgaggggaaacngcccaccctctcctgacggaggcctagtcgagagtattcggacacggtacaaccgtttagcccgttaggtaccctaagcgtaaacgaaaccgttgggaccgaaggtctacccggacggtccttacctctacgttaccgttagtcggtacggaccttactaccccgacggaaccggggtccaggttaaccgttacgtaccccgaggtaccctagggttacgacggtacggtaccgaggtcggggtcttacgggacgttacaggtttcacgtcgtacacgtactacgacgtcgacgtcgtactcgacgtccgtaagaacggtttattgtaacggtttaactttacgtttaccgttacgttaggtaacgtagttaacgtaaacgtttacgtaacgccggttacccgttaacgttccgtaacgggtaccgtaacggtagacccgtggtaacggacttaaacggtaccggtaagttacggacggttacgtcggtaccaaaccggttgtaccgtacggtttaccg

SEQ ID NO: 230112 - DNA, 702 bp, Homo sapiens
  misc_feature: GYAE6OF02H8147.47.84.H07.1.454.CMB.1.raw
  modified_base (198)..(198): a, c, t, g, unknown or other
  misc_feature (198)..(198): n is a, c, g, or t
  modified_base (290)..(290): a, c, t, g, unknown or other
  misc_feature (290)..(290): n is a, c, g, or t
  modified_base (318)..(318): a, c, t, g, unknown or other
  misc_feature (318)..(318): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccacctgtctgtgtctccaggggaaanagccacctctctgcagggtcagtcagagttgtgacagtctacttagtctggtaaccaagacgtaaacctggaccaggtcctccgagcctctnatcgtggatgcactaccaacgcgggccngtcggacacctcccgagcctaggtttaccaggttcggacgtagggttacggggtacgtgggaactagggtacgtttacccacttccgtaaccctaacccgtaattaccgaaaacgtaccgtacccgttcggaaaccgtacgttcgttaaggtaaaacgtttagttttttacggaacgttttaagtttttaaacttacgtacggtttaccgaagtaccgttagttaacttacgtaactttaaccgcgggtccctaccttaccgtaacccgttaccgggtaccgaaaagggtccctaaccgggtacgttaacggggaaacttaaacggttaaaacccgtagttacgggttacggaccttacgaacccctaagtacctttggtaccg

SEQ ID NO: 230113 - DNA, 754 bp, Homo sapiens
  misc_feature: GYAE6OF02GRFDK.47.84.H07.1.454.CMB.1.raw
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccgaggggaaagagccaccctctcctgcagggccagtcagtagtattagcagcaacttagcctcggtaccagcaagaaacctgggcacggctcccaggcctcctcatctagtggtgcactcccgaccgacgggaccctacgtcgggttaacctccccgaacgtcccgtacgggtttacgagggttcgggacgtacggttggggttaccgtggggacgtaggtacggtttcaccgttcctaccaacccgtactacgaacggtaccaaccggtcccttacggacgttacggttccgttaggtaaacggttacttttttacggtaactttaaagtttttaacgtttaaccgttcggttacctaacggttaacgttaaagttaaacgtttaaacgttaaaccgtttccgggtaccctttaccggttccggtttaccccgggtaaccgtaaaccggggtacccgtacggttaaccggtagggtaaaacggtaaacggtttaaaaccggtaaccgttacgggttacgtacggttccgtaaccgaacccttacgttaccgttagtttaccccg

SEQ ID NO: 230114 - DNA, 681 bp, Homo sapiens
  misc_feature: GYAE6OF02FHIQW.47.84.H07.1.454.CMB.1.raw
  modified_base (200)..(200): a, c, t, g, unknown or other
  misc_feature (200)..(200): n is a, c, g, or t
  modified_base (308)..(308): a, c, t, g, unknown or other
  misc_feature (308)..(308): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccgaggggaaangcccacctttctcctgccagggtccagtccagtgtattagcagcctaacttacgccgtggtaccagcacgaacctgggcacggctccaggcctcctcatctatggtcnctactccgacgacgggccacgtcggtactccccgagccgtaggttccaggtcggacgtagggttcggggtacgtaggggacacggtacgtttaccaccgttcctccaaccgactacgacgcgtacgacccgtcggtcctacgttcgtacggtaacgtacgttttacgacctaaccgttactaccgtacgttacctaaacgtacggtaaaccggttaacccggttaaccccgtacgttaaccgttttacgggacccggaaccgggtaacctaaccgtacggtaacctacgtaacgtaaaccggtaacgtcggtacggtacctacggaccctaaccgtacgtaccgttacgtaccctttactaccgtttaccccg

SEQ ID NO: 230115 - DNA, 729 bp, Homo sapiens
  misc_feature: GYAE6OF02GG5NV.47.84.H07.1.454.CMB.1.raw
  modified_base (201)..(201): a, c, t, g, unknown or other
  misc_feature (201)..(201): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagcccaccctgtctgtgtctccgaggggaaangccaccctctcctgcgagggccagtcagagtattagcagctaactgcctggtaccagcaagaaccgtgggcaggcctccgaggcctcctcatctagtcggtgcactccaccgaggccacgtggtactccgagccgtaggttcgaggtggacgtaggttcgggtacgtacgggacaggtacgttcaccgttctaccaaccgtataccgaacgccgaacgtcccgtaggtccgtaacggttaccgttaacgggtaaacgttttacgtttttaacggaaccttttaaagtttttttaccgtaacgtttacggttacctaacgggttaaccttaaaggtttaaaccttaaaacggtttaaccgttcgggtacccctttacggtaccccggtttaccgggaacccggttaaaccggggtaccgtaccggtaacggttacggtaaaccgttaacggttaaaaccggtaacggtttacgggtaccggtacggttaccggtacccgtaaccgttacgttacccggttagttacccg

SEQ ID NO: 230116 - DNA, 713 bp, Homo sapiens
  misc_feature: GYAE6OF02HX08L.47.84.H07.1.454.CMB.1.raw
  modified_base (198)..(198): a, c, t, g, unknown or other
  misc_feature (198)..(198): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccacctgtctgtgtctcgaaggggaanacgccaccctctcctagcagggccagtcagtagtatagcagacaacttgacctggtaccagacaacggaaaccgtgggacaggcctaccgagcctacctacaacgttctaagttggtcgactacgtacccaacgtacggggaccctaacgtcggttaaccacccggacgtaccgtagggtttaccgacgggttcggtaccgtacgggttacggggtttccgtagggggaaccgttaaggtaagtttcccgaacgtttaccgtacccgtaacccgtaagtaccgtaaggaccaaccggttacccgttaacggaacggttctaacggtaagttacgtttttacggacctttaaattttactaacttggtaactagtactaagttaaacctaagttaaccgtcgtaccttcggtacttaccggagaaacggtactaacgaccgttacggaacgtaaacggttaacgtagtacgttacggtacgtcgaacccttcgtaacttcgtacttaccgttaccg

SEQ ID NO: 230117 - DNA, 597 bp, Homo sapiens
  misc_feature: GYAE6OF02I8PXU.47.84.H07.1.454.CMB.1.raw
  modified_base (217)..(217): a, c, t, g, unknown or other
  misc_feature (217)..(217): n is a, c, g, or t
  modified_base (416)..(416): a, c, t, g, unknown or other
  misc_feature (416)..(416): n is a, c, g, or t
  modified_base (583)..(583): a, c, t, g, unknown or other
  misc_feature (583)..(583): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccaggggaaagagccaccctctcctgccngggccagtcagagtattagcagcaacttagcctggtaccagcagaaacctgggcaggctcccgaggctcctcatctagtggtgcactccgaccgacgggccaacgtggtactcccgagccgacggtctagtggtcggacgtcgggtcggtcgagggtacgtacgtcgtacctacgtcctaaccactacgtaacgcgacncgtactcggcttacgtcgtaaggtatttagttacttaactttacgtttaacttacgtacgtacgacgtataacgttaattaacgtacgtcgtccgtcgtacggtccgaagaccgacgtacgacgtggaaacttaacgtaacgtacgtacgtacgacgtaccgtaccncgttactagttccg

SEQ ID NO: 230118 - DNA, 563 bp, Homo sapiens
  misc_feature: GYAE6OF02F70RP.47.84.H07.1.454.CMB.1.raw
  modified_base (201)..(201): a, c, t, g, unknown or other
  misc_feature (201)..(201): n is a, c, g, or t
  modified_base (234)..(234): a, c, t, g, unknown or other
  misc_feature (234)..(234): n is a, c, g, or t
  modified_base (261)..(261): a, c, t, g, unknown or other
  misc_feature (261)..(261): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagcccaccctgtctgtgtctccgaggggaaancgcccaccctctcctgcagggccagtcagaatnttcactcctacttagcctggtaccaanacgaacctggtcaggcctcccgaggcctcctcatctatgatgcatccaagcggcctagtggcacgtcccagactaggttcaggtcggcaggtgggtctacggggactacggtaccttccacttcctaccacctctacgacgccagcctagacgcgtagacgtacgttagtacttttatacttgtacagctagcgttgacggttcgtcgtccgttccgctccgtacgttcggcgggacggtacgtgggtaggactacgtacgaaacgtacgttgtacggtctaccggctaccgtatccgttcg

SEQ ID NO: 230119 - DNA, 656 bp, Homo sapiens
  misc_feature: GYAE6OF02GAZZP.47.84.H07.1.454.CMB.1.raw
  modified_base (320)..(320): a, c, t, g, unknown or other
  misc_feature (320)..(320): n is a, c, g, or t
  modified_base (351)..(351): a, c, t, g, unknown or other
  misc_feature (351)..(351): n is a, c, g, or t
  modified_base (386)..(386): a, c, t, g, unknown or other
  misc_feature (386)..(386): n is a, c, g, or t
  modified_base (405)..(405): a, c, t, g, unknown or other
  misc_feature (405)..(405): n is a, c, g, or t
  modified_base (584)..(584): a, c, t, g, unknown or other
  misc_feature (584)..(584): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagcccaccctgtcctgtgtctccgaggggaaagcgccaccgtctcctgcagggccagtcagagtatagcagaccaactttagcctagggtaccagtacaacgaaaccgtgggacacgggcctcccgaggcctccctacgatctagtggtcncacgtccaccgagggcctaacgtgggtaccncccagccgtaacgtcgtagtggctaggtgggtacngggaacagtagttcacctnaccacgatcgagccgacgcctcgacttacggtctaaggtaagttacgttttacgtaacttaacgtttttacttaacgtggtaccaggttaccgtaaagttaacgttaacgtaccgttcgggtacccttacggtaccgttaccggaacgaacggtaccctacgggtaactacgggttaanaaaccgtttaaaccgggtacgtagggttccgaccggttacgacccgtacgtaaccgttcgttaggttacccc

SEQ ID NO: 230120 - DNA, 627 bp, Homo sapiens
  misc_feature: GYAE6OF02FMZ1Q.47.84.H07.1.454.CMB.1.raw
  modified_base (199)..(199): a, c, t, g, unknown or other
  misc_feature (199)..(199): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagtgatgacgcagtctccagccaccctgtctgtctctccgaggggaangccaccctctcctgcagggccagtcagagtgttggcagctactacgctggtaccaacagaaacctggaccaggcctccccgaggcctcctcactcgtatgactgcactccgaacgacggggccagtcgggcactcccgagccaggttccaggttcggactaggtgacggtcgtaggggaactacggtacttccgaccgttctaccctaacacgttacagtaccacggtccctaaggactcccgtagaaacgttattttcggactttacgttttacgttacttcggtacaggtaccaggtacgtagactaacgtcgtaccctcgttacgacgtttccggggacggaccggggtaccgtagggggtacggacgtaacgtacgaacgggtacgtacgggttacggttacggacgttccggacgttaacccg

SEQ ID NO: 230121 - DNA, 626 bp, Homo sapiens
  misc_feature: GYAE6OF02I6CWE.47.84.H07.1.454.CMB.1.raw
  modified_base (197)..(197): a, c, t, g, unknown or other
  misc_feature (197)..(197): n is a, c, g, or t
  modified_base (295)..(295): a, c, t, g, unknown or other
  misc_feature (295)..(295): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccacctgtctgtgtctccagggaaangccaccctctcctgcagggccagtcagagtatagcacgacaacttagcctaggtaccagcaagaaacctgggcaggcctccgaggcctcctcatactntgatcggccgtccaccgacgggacccacgttcggttacccagcccgtaggttccgaggtcggactaggtcgtccggtcgtggggactagtacgttcaccttcgtaccaaccatcccgaaactacgcctaggactacgtcgtaggtaacgttagtttccggacttaagttttacttacgttgtactacgtcgttaatacgttactaacgtaaccgttcggaccgttaccttaccgtacccgttacgggaccgtaaaccggacaaccggtagtacggaaaggtaacctaaacggtacgttaggtacgtccgtacgacccaacttgttcttacg

SEQ ID NO: 230122 - DNA, 593 bp, Homo sapiens
  misc_feature: GYAE6OF02GLFVR.47.84.H07.1.454.CMB.1.raw
  modified_base (201)..(201): a, c, t, g, unknown or other
  misc_feature (201)..(201): n is a, c, g, or t
tcagagctcacgtacacgaccggtgctcgatttagcagacgtctgtcgcgggggagggaactgctcagttaggacccagacggaaccatggaagccccagcgcagcttctcttcctcctgctactctggctcccagataccactggagaaatagagatgacgcagtctccagcccaccctgtcctttgtctccaggggaanagccaccgtctcctgcagggccagtcagagtgttggcagcaactcttagcctggtaccagcagaaatctggccaggcctcccgaggcctcctctatttagtggtacactaacaacgacgggcccacgtcggctactccccgagacagtacttcacgcggcagtggacgtcgtacgggactagtacttcactctcacctactcagcacgacgtggacgcgtagtaacttagttttcgacgtagttatactactgtacgaagtagttagtaggttaggtactagtacgtaccggtacggttaccgaccggtaacgggaccggtaggggtaaggaacgttacggaacggtacgtaacgttggtacggtacgtacggaccgtaccgtagttacccg

SEQ ID NO: 230123 - DNA, 794 bp, Homo sapiens
  misc_feature: GYAE6OF02IDS30.47.84.H07.1.454.CMB.1.raw
  modified_base (149)..(149): a, c, t, g, unknown or other
  misc_feature (149)..(149): n is a, c, g, or t
  modified_base (465)..(465): a, c, t, g, unknown or other
  misc_feature (465)..(465): n is a, c, g, or t
  modified_base (518)..(518): a, c, t, g, unknown or other
  misc_feature (518)..(518): n is a, c, g, or t
tcagagctcacgtacacgaccggtgctcgatttagcagacgtctgtcgcgggggaggaactgctcagttaggacccagacggaaccatggaagcccccagcgcagcttctcttcctcctgctactctggctcccagataccactggaanaatagagatgacgcagtctccagcccaccttgtctgtgtcctaccgaaggggaaacacgcccaccccctctccctagacgacgggccctaggttcaagtaaacttcttaccaacctttccgttaactttacggcccgtttacggtaacccaaacgaaccgtaaaacccgtcggtaaccgaccgggtaccctaccccgtaacggtcccttaccctactaacgttacttaacgtacgtaacgttacgacctaacctacccgaaacggaccgggaccctacgtcggacctaccgtacccgagtaaccgtaggtaaccgnggtcgagtggtcggtcgtaggactacgtaccttcgacttccgtacaaccgttnaccgacgaccgtaccgtcgtaaacgtaccgttaccgtacggtaaacgttttaccggtttttacggtaaaccttttttaacgttacgttacggttacccacgggttaccggtaacggttcggtttaagttacccggtttccgtacccgggttccccttaccgttacgtttacccggttaccggtccggggtaacgggtaccggtaccgggaaggtacgtacgtaacgtaaccgtaaacgttcggtgttacggctacgccccttaagtcttaccgtcg

SEQ ID NO: 230124 - DNA, 613 bp, Homo sapiens
  misc_feature: GYAE6OF02FOZH8.47.84.H07.1.454.CMB.1.raw
  modified_base (200)..(200): a, c, t, g, unknown or other
  misc_feature (200)..(200): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagccaccctgtctgtgtctccgaggggaaanagccaccctctcctgcagggccagtcagagtattagcagcaacttagcctggtaccagcaagaaaccgtgggcaggcctcccagggccttacctcacttctagtggtcgcactcccaccgacgggcccaacgttcgggtactaccccgagcccgtaggttccaggtcggcgagggttcgggtcgtggggactaggtacgttccacttccgtaccacctataccgacgccgacgtcccgtcgcgtacgtacgtaggtaagttattttgaacttaattttaacttcgtagtctagtactaagtaattaacgtaacgttcggtacctcgtccgtacggtaacgacgggtacacggacgtagggtaacgtaacgttaacgaagtcgtaggactcggactaccgtagtcctagttccg

SEQ ID NO: 230125 - DNA, 753 bp, Homo sapiens
  misc_feature: GYAE6OF02J3E58.47.84.H07.1.454.CMB.1.raw
  modified_base (218)..(218): a, c, t, g, unknown or other
  misc_feature (218)..(218): n is a, c, g, or t
  modified_base (236)..(236): a, c, t, g, unknown or other
  misc_feature (236)..(236): n is a, c, g, or t
  modified_base (363)..(363): a, c, t, g, unknown or other
  misc_feature (363)..(363): n is a, c, g, or t
tcagagctcacgtacacgaccggtgctcgatttagcagacgtctgtcgcgggggagaactgctcagttaggacccagacggaaccatggaagccccagcgcagcttctcttcctcctgctactctggcctcccagataccactggagaaatagagatcgacgtcagtctaccgagccctaccgttgtcgtcgtcgtaccgtaccggaaaggggaaacnccgcccacccttctccgngcgacggccagtcagtagtatcggacacgctaacgttcgccgtaggtaaccagccaaacgggtaaccgtgggaccacggtccctacccgaggtccttaccctcgtacgttctaacgtcgggtaaccnccgtaaccgtccggaccggtacggtaccgtacgttaccggtaccctacccggacggtaccggttacggtcggtacggtacgggtacggttcgggttacgggtacgacggtaacgttacgtccgttaccctaccgtacccgaccgtacgtacgtaccgacgtccgtaccgtacgtcgtaccgttacgtacgttaacgttacgttacgttacgttacgtttacgttacgtccgtaaggtccacggtacgtacgtacgtacgtacgtacccgttccgtaccgttcgttaccggtacgggtaccggacgtacggggtacgtaggtaaccgtacgtaaccggtacggtaaccggtacgtcggtaccggaccgtacggtccgtaccgtaccgttcg

SEQ ID NO: 230126 - DNA, 781 bp, Homo sapiens
  misc_feature: GYAE6OF02JHD9L.47.84.H07.1.454.CMB.1.raw
  modified_base (201)..(201): a, c, t, g, unknown or other
  misc_feature (201)..(201): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagcccaccctgtctgtgtctccggagggaaancgcccaccctctcctgcgagggccagtcagacgtatgcagtaccaacttcgccgtagtaccacgacaacggtaaccgtgggaccacggtccctaccccgaggtcccttccctactaacgttcgtagttcgggtacgcctacgtaccccgaaccggcggtacctaacgttcgggtaccctccccgacggtaccgtaaggtttccaggggtcgtacgtacgggggttcgggttcgtacggggaacttacggtacgtttaccaccgtcccttaaccgaccctagtccgtagacccgtcgtacccgtaggtacctacggttacggtaagtacggtttagtttccgaaatttttaaccgtttttagttaccgtttacgtcctaacgggttactaaggttttaaccgttaaacgttaaccggttccggtaacccttccgggttaacccggtttaccgaaacccgggtaacgggtaccgtaaccggttaccggaacgggttaacgttaaaccggttaaaccggtacggttacgggtacgttaccgaccgtaaccggtaccctttacggtttccggttaccgttaccc

SEQ ID NO: 230127 - DNA, 815 bp, Homo sapiens
  misc_feature: GYAE6OF02J1ULE.47.84.H07.1.454.CMB.1.raw
  modified_base (198)..(198): a, c, t, g, unknown or other
  misc_feature (198)..(198): n is a, c, g, or t
  modified_base (210)..(210): a, c, t, g, unknown or other
  misc_feature (210)..(210): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggctcccagataccactggagaaatagagatgacgcagtctccagcccacctgtctgtgtctcgaagggaanagccacccttcncctgcgacggccagtcagagtagtacgcacgctaaacttcgccgtacggtacctagaccgaacggtaaaccgtcgggactacggcccttaccccggaggtcctcctacaacttcgtagtcggtcactactccccgacggaccgggtaccacggtacgttacctaccccgacgaccggttacgtacggtggtcgggtacgtacgggttacgggtacgttacgggggaaccttacgggaacgttttcccaaacccgttccgtacccgtaaccccgtaacggtaccgtaaccgggtacctaccggttaacccggtaccgtaccgtaaccgggtttaccggtaaaacgggttaacggtttaccgttttaacgggtaaactttttaaaccgttttaacgttaaccgttacgttaccggaaccggttaacgttaagttaacgtttaaccgttaacgtcccggttacggttacccgaccgtttacgggaacccgaacgggtaaccgtaccgtagggtaacggttaaccgttaaacggttaacccggtaaggttcgggtaaccgtcggttaaccgtaccgttaaccgtttaaccgttctttaaccggttaccc

SEQ ID NO: 230128 - DNA, 765 bp, Homo sapiens
  misc_feature: GYAE6OF02INFCV.47.84.H07.1.454.CMB.1.raw
  modified_base (202)..(202): a, c, t, g, unknown or other
  misc_feature (202)..(202): n is a, c, g, or t
  modified_base (754)..(754): a, c, t, g, unknown or other
  misc_feature (754)..(754): n is a, c, g, or t
tcagagctcacgtacacgaccggtgctcgatttagcagacgtctgtcgcgggggaggaactgctcagttaggacccagacggaaccatggaagccccagcgcagctttctcttcctcctgctactctggcctcccagactaccactggagaaatagagatgacgcagtctccagccaccctgtctgtgctccgaaggggaancgccaccccttctcctgcgacgggccagtcaaggtattaatgactaggactaaacgtttacgccgtaggtaaccgagtacaacgtaaaccggtgggaccacgggtccctacccgacgggtccctcccttacgacttccttaggtcgggtaccgactacctacccgaaccggtcgggccctaagttcggtaacctccgaccgtaccggtaggttcgaggtcgggtcgtacgggttcggggtcggttaacggggaactacgtacggtttaccaaccgttccctaaccgtacctacgtaccgtacgtaccggtaccgtccgtaacgtccgtaagttcgttaaacggtaaggtttttacgtttagtaacccttttaaatttttaccgttctacgttacgtaacggttacttaaacgttaaacgttaacgttacccgttggtaccctttccgtaacgtttaacccggaaacgttacggacctaaccggtggttaacggtaacgtaaccgttaacggtaacgttcggacggttccgtacgtaccgtaactccggtttntacgtttaccg

SEQ ID NO: 230129 - DNA, 676 bp, Homo sapiens
  misc_feature: GYAE6OF02IIA1P.47.84.H07.1.454.CMB.1.raw
  modified_base (174)..(174): a, c, t, g, unknown or other
  misc_feature (174)..(174): n is a, c, g, or t
  modified_base (192)..(192): a, c, t, g, unknown or other
  misc_feature (192)..(192): n is a, c, g, or t
  modified_base (205)..(205): a, c, t, g, unknown or other
  misc_feature (205)..(205): n is a, c, g, or t
  modified_base (297)..(297): a, c, t, g, unknown or other
  misc_feature (297)..(297): n is a, c, g, or t
  modified_base (341)..(341): a, c, t, g, unknown or other
  misc_feature (341)..(341): n is a, c, g, or t
  modified_base (348)..(348): a, c, t, g, unknown or other
  misc_feature (348)..(348): n is a, c, g, or t
tcagagctcacgtacacgaccggtgctcgatttagcagacgtctgtcgcgggggaggaactgctcagttaggacccagacggaaccatcggaagccccagcgcagcttctcttcctcctgctactctggctcccagactaccactggagaaactggaagatgacgcagtctcanccaccctgtctgtgtccnccgaggggaaacncgccacctctcctgcgacgggccagtcagaatattcactctactagctcgtacacagtaacctggtcagcctaccaggcctctcactctatnagtgcacgtccaacgcgggccacgtcggcactccagactgtacnggtcgtnaggttcggtcgtcggacagacttcgacttcacgtaccactacgacgtaccgaacgtcccgtaagacccgtccgtaacggtaacggttacgttttaacggtaacgttttacgttaacgtttcggtacgtacggaccgtaacggttcgtaagggtaaccgttcgttacggtcccttaccggtccgttaccgttaccggttttacgggaccggggttaaccgggtaccggtacggggtacggtaacgggtaccgtaacggtaaccggtaacggttaaccggttacggtaccgggtaaccggtttacgaccgtaaccggtacgttacccggg

SEQ ID NO: 230130 - DNA, 696 bp, Homo sapiens
  misc_feature: GYAE6OF02FK53G.47.84.H07.1.454.CMB.1.raw
tcagagctcacgtacacgaccggtgctcgatttagcagacgtctgtcgcgggggagggaactgctcagttaggacccagacggaaccatggaagccccagcgcaggcttctcttcctcctgctactctggctcccagataccactggagaaatagacgatgacgcagtctccagccacctgtctgtcgtctccgagggaagcgccctaccctctcctgcacgggccagtcagacgtatagcagtctaacgttacgcctggtaccagacgaacggaaccgtgggaccacggacctaccccgaggtcccttaccctactaacgttcctagtgtaacgtcgacctacgtaccgaacggtacgggccctacgtacgcctacctccgaagtaccgtagtacgtaggtcggacgtacggtacggttcgtacgggaacctacgtccttaccgtacgtcctaccgtaccgtatccgtaacgccgtaacgtaccgtaggccgtacgtagtacgttacgtttacgtacttttacgtctacgtacgacgtcgtacgtcgtgtaccgttacgttccggtaccttccggtcctacggttaccgttaccggggtcggtaccgggtacggtaacggggtcggtaacggtaccgttaacccggaaacgttccgggttacgtaccggtccgacggttaccctaccgttcccgg

SEQ ID NO: 230131 - DNA, 766 bp, Homo sapiens
  misc_feature: GYAE6OF02IY72R.47.84.H07.1.454.CMB.1.raw
  modified_base (205)..(205): a, c, t, g, unknown or other
  misc_feature (205)..(205): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactctggcctcccagactaccactggaagaaatagagatgacgcagtcctccagcccacctgtctgtcgtcctcgaagggtaanacgccgaccctctccgtgcgacggccagtcagtagtacttagcagactaacttacgccgttacggtaccagaccgaacgtaaaccggtcgggaccaacgggtccctacccggacgggtcccttacccttacgtacttaccgttacggtacgggtacgacccgtaacctacccgaaccggtaccgggtaccctacgtacgggtacccaaccgttacccgtacgaaccggttaccggttcgaggtaccgggacgttacgggtttcggtacggtacgggaacgtaacgttaccttaccgtacttaccgtaccctacgtacgtccgaacgtccgtacgtaccgtacggtaacgtaccgtagtaaaccgttcgtttacggttaaacttttacgtaccgttgtaccgtacgtacgacggttacgtcggttaccgtcgggtaccgtccctccgttacgttccggttacggttacccgggagggtacggtaaccgggtagggtcggaacgttaacgaaccgtaaacggttcggttcggacggtcctagggtacccctacgtaccgttcg

SEQ ID NO: 230132 - DNA, 781 bp, Homo sapiens
  misc_feature: GYAE6OF02H2R5W.47.84.H07.1.454.CMB.1.raw
  modified_base (188)..(188): a, c, t, g, unknown or other
  misc_feature (188)..(188): n is a, c, g, or t
  modified_base (203)..(203): a, c, t, g, unknown or other
  misc_feature (203)..(203): n is a, c, g, or t
  modified_base (217)..(217): a, c, t, g, unknown or other
  misc_feature (217)..(217): n is a, c, g, or t
  modified_base (320)..(320): a, c, t, g, unknown or other
  misc_feature (320)..(320): n is a, c, g, or t
  modified_base (560)..(560): a, c, t, g, unknown or other
  misc_feature (560)..(560): n is a, c, g, or t
tcagagctcacgtacacgaccggtgctcgatttagcagacgtctgtcgcgggggaggaactgctcagttaggacccagacggaaccatggaagccccagcgcagcttctcttcctctgctactctggctcccagactaccactggagaaatagagatgacgcagtctccagcccacctgtctgttacnctacgaaggggaaancgacccacccttcncctgaccgacgggaccctagtcgaagtagttaagtacgcgtaagtactaaacgtttcgcccggttacggaacccgtaacgacgtaaacgttaaaaccccgggngggtaccgtaaccgggccttacccccggaacgggtcccttaccctaacgttagttaccgtaggttccggtaggaccctaacctacccggaacccgtacggggtaccctaaccgttaccgggttaacctaccccggaacgttccggttaaaccggttcgtaacggggttacggacccggtaggttaccgggtcggtaacggacgttaaggtaccgttactaccttaccgaccacccgttanacgtacgaccgtcgactcgacgttacgtcgtaagtagttcgttagtaactttagtaacctttgcgtttaacgacttacgtaaagtttaaactaacgtaccgtttccgacccgttgttaaccggtcggaaccgttaacgacgtacgttacggtaggaaacttaaacgacgttacggtacgtaccggtacgtacgaccgtaattcgtaccgttagttaacccg

SEQ ID NO: 230133 - DNA, 389 bp, Homo sapiens
  misc_feature: GYAE6OF02H3DXD.47.84.H07.1.454.CMB.1.raw
  modified_base (270)..(270): a, c, t, g, unknown or other
  misc_feature (270)..(270): n is a, c, g, or t
  modified_base (331)..(331): a, c, t, g, unknown or other
  misc_feature (331)..(331): n is a, c, g, or t
  modified_base (337)..(337): a, c, t, g, unknown or other
  misc_feature (337)..(337): n is a, c, g, or t
  modified_base (360)..(360): a, c, t, g, unknown or other
  misc_feature (360)..(360): n is a, c, g, or t
  modified_base (362)..(389): a, c, t, g, unknown or other
  misc_feature (362)..(389): n is a, c, g, or t
tcagagctcacgtacacgaccggtgctcgatttagcagacgtctgtcgcggggccgattcaccgtctccagagacaattccaagaacacgctatatttgcaaatgaacagcctgagacctgaggacacggctgtgtattactgtacgagaccttatggcggggactactttgactactggggccaggaaccctggtcaccgtctcctcacgcctccaccaacgggtccccatccggtccttccccccgtggccacccctcctcccaagcncacctcgtgggggtacacgccggccctggcctgccgtggtacaaggactacttcctagtgnctctgngcgggctcggcaaggcgcaatgnannnnnnnnnnnnnnnnnnnnnnnnnnnn

SEQ ID NO: 230134 - DNA, 808 bp, Homo sapiens
  misc_feature: GYAE6OF02FOW6O.47.84.H07.1.454.CMB.1.raw
  modified_base (117)..(117): a, c, t, g, unknown or other
  misc_feature (117)..(117): n is a, c, g, or t
tcagagctcacgtacacgaccggtgctcgatttagcagacgtctgtcgcgggggaggaactgctcagttaggacccagacggaaccatggaagcccagcgcagcttctctcctcctnctactctgctccagataccatggagaaatagagaatgacgcagtctccagccctacccgtgtccgtgttacgtcgtacccgagggaaaacggagtacccaaccccgtcttcctggtaccaggggacccaaggttcacggtaacgtaatttacggacaggcccttaaacgtttacggccgttacggtacccgaacggacctaacggtaaaaccccgtaggggaccacgggtaccttccccgaaggggtcccttcccgtaccgaacttcgtaaccgtgggttcgacaaaccttccgaacccggacgggaccccgtacgttaccgggtaaacctccccgaccggaccgttaaggttccaagggccggaccggtaggttaaccggtacggtcggggaacccgaaggttaccgttaaccgttaccgttaccgcttaaaccgttacgtactaaccgggccggtacccgtacgtaccgacgtaccgttcgaagttaacgttcgtaccgtacgaacctttttaagaaccgtttgtaccttaccgtaaacgttcgtacgttactacgtaccttacccgggttacgtacggttccgtaaacccggggttacaccgggttaacggtaccgggttaaataacggtaaacccgtagtaccggaaggtcctacgggaacctcccgaatacgtttgttaaccctcg

SEQ ID NO: 230135 - DNA, 576 bp, Homo sapiens
  misc_feature: GYAE6OF02I3KWF.47.84.H07.1.454.CMB.1.raw
  modified_base (146)..(146): a, c, t, g, unknown or other
  misc_feature (146)..(146): n is a, c, g, or t
  modified_base (161)..(161): a, c, t, g, unknown or other
  misc_feature (161)..(161): n is a, c, g, or t
  modified_base (201)..(201): a, c, t, g, unknown or other
  misc_feature (201)..(201): n is a, c, g, or t
  modified_base (334)..(334): a, c, t, g, unknown or other
  misc_feature (334)..(334): n is a, c, g, or t
  modified_base (380)..(380): a, c, t, g, unknown or other
  misc_feature (380)..(380): n is a, c, g, or t
  modified_base (435)..(435): a, c, t, g, unknown or other
  misc_feature (435)..(435): n is a, c, g, or t
  modified_base (440)..(440): a, c, t, g, unknown or other
  misc_feature (440)..(440): n is a, c, g, or t
  modified_base (446)..(446): a, c, t, g, unknown or other
  misc_feature (446)..(446): n is a, c, g, or t
  modified_base (448)..(448): a, c, t, g, unknown or other
  misc_feature (448)..(448): n is a, c, g, or t
  modified_base (453)..(453): a, c, t, g, unknown or other
  misc_feature (453)..(453): n is a, c, g, or t
  modified_base (467)..(467): a, c, t, g, unknown or other
  misc_feature (467)..(467): n is a, c, g, or t
  modified_base (470)..(470): a, c, t, g, unknown or other
  misc_feature (470)..(470): n is a, c, g, or t
  modified_base (485)..(485): a, c, t, g, unknown or other
  misc_feature (485)..(485): n is a, c, g, or t
  modified_base (488)..(488): a, c, t, g, unknown or other
  misc_feature (488)..(488): n is a, c, g, or t
  modified_base (508)..(508): a, c, t, g, unknown or other
  misc_feature (508)..(508): n is a, c, g, or t
  modified_base (571)..(571): a, c, t, g, unknown or other
  misc_feature (571)..(571): n is a, c, g, or t
tcagagctcacgtacacgaccggtgctcgatttagcagacgtctgtcgcgggggaggaactgctcagttaggacccagacggaaccatggaagccccagcgcagcttctcttcctcctgctactcgtggctccagataccatgganaaatagagatgacgnagtctccagccaccctgtctgtgtcctaccgaggggaaancgccctaccctctcctgcgacgggcctagtcgagagtagttacgcagactaacttcgcctaggtaccagacaacgtaaccgtgggccacggcctacccgaggccctaccgttcattaccggtagtgggttacncaacgtcccgaaccggtacgggtcccacggtttagtccctacccgnggtacctacggttcaaggtcggcgtaggtcgggtctagggacagtacgtcactcncgacntacgcncncgtcngctagctagagttnttnattacttatctcgtntancgtattacagtcgtacgtcncgttacgtcggacgaaggcacgtagtcgaactaacgtacgagtcgcgtcgcacgtatcgttcngtacc

SEQ ID NO: 230136 - DNA, 731 bp, Homo sapiens
  misc_feature: GYAE6OF02G8DA6.47.84.H07.1.454.CMB.1.raw
  modified_base (201)..(201): a, c, t, g, unknown or other
  misc_feature (201)..(201): n is a, c, g, or t
tcagagctcacgtacacgaccggtgctcgatttagcagacgtctgtcgcgggggagaactgctcagttaggacccagacggaaccatggaagccccagcgcagcttctcttcctcctgctactctggcctcccagactaccactggagaaatgtgatgacgcagtcctccagcccacctgtctgtctctccgaagggaacncgccacatcctccgtggtacgggccgtcgaagtagttattagctacgtactaacgttacgccgtaggtaaccagcaagacgaccgtggcacggtcctacccgaggtccctcctactattacctagtgacttccggccgtacccaacggacgggtccctacggtttccggtaccacggccttagggttcaggtcggacgtggtcgccggttacggtacgggactaaggtacgttacccaccttctaccgacttacaccgtaacgacgttaccgtcggtacctggttaccgtaggtaaacgtttctttaacggtacttttaacgttttaccgtacgttaccgtacgtaaacgttcgtaaccgtttagtaaaccgtaccggtttacggtaccgaccccgtttaccgttaacccgttacccggttacccgggaacggtaaccgggacctaccgggtaaggtaacggtaaacgttaaaccgttaacggttacgtaggtacgaccgttacgaccccggtacttacgttccttaccg

SEQ ID NO: 230137 - DNA, 783 bp, Homo sapiens
  misc_feature: GYAE6OF02FJV96.47.84.H07.1.454.CMB.1.raw
  modified_base (109)..(109): a, c, t, g, unknown or other
  misc_feature (109)..(109): n is a, c, g, or t
  modified_base (200)..(200): a, c, t, g, unknown or other
  misc_feature (200)..(200): n is a, c, g, or t
tcagagctcacgtacacgaccggtgctcgatttagcagacgtctgtcgcgggggaggaactgctcagttaggacccagacggaaccatggaagccccagcgcagcttcncttcctcctgctactctggctcccagactaccactggacaaatagagatgacgcagtctccagccacctgtctgtgtcctccgagggaacncgccctacccgtctccgtgcgacgggccagtcgaagtacgttatacgcctagacctaacgtttacgccgttacggtaaccgacgcgtaaggtacggtaacccgtcgggggtacacgggtcccctacccgtcggtaaccctccgttaccaaacgtttctaacgttagacgttcggtacctaccccgtaccgaacgggtcccaacgtcggtaccacgtacccgtacgaacgtcggttacgtaacggccggtaccgtaagggttcgggttacggcggggtaaccgtacggtaaccttccgtaccgttacccacccgttaacctacgtaccgacgtaccgtaccgaccgttaacggaccgttaccgaacgtaacgttccggtttaacttacgttttaccttacgtgttaccgagttaccgagtaccggttagtaccgttcgtacggtccctaacgtcccgttacgttacgggttccgggtacggggtacccgtaacgggaccgggttaggtaaacccgggttctaaaccggggtaaccgtacgggttcgtacccggtagttcccggtaaccgtaccgtttaacccgg

SEQ ID NO: 230138 - DNA, 803 bp, Homo sapiens
  misc_feature: GYAE6OF02HGPIQ.47.84.H07.1.454.CMB.1.raw
  modified_base (164)..(164): a, c, t, g, unknown or other
  misc_feature (164)..(164): n is a, c, g, or t
  modified_base (201)..(201): a, c, t, g, unknown or other
  misc_feature (201)..(201): n is a, c, g, or t
tcagagctcacgtacacgaccggtgctcgatttagcagacgtctgtcgcgggggaggaactgctcagttaggacccagagggaaccatggaagccccagctcagcttctcttcctcctgctactctggcctccagattccaccggagaccattgttttagacanagtcctccagccacctgtctttgtctcgaaggggaancgccaccctctcctgcgagggccagtcgaagtgtgtggcaggtctacgtcgcctgtaaccaacgaacgtaaacccgtggacccacggtacccgtacccgtacgggtacctaccccttacgtacttaccggttactaggtaactcggcctaaactccccgaaacggtccggggacctaaccggtcggacctaccgtaccccggtagtaccggttacggttaccgtagggtacggaccgtaggtttacggaacggttccggttaacggggactaacgggttccccttaacgttaccccttccggtaaacccacccggttaacttaccggaaccgtacccgtaacggtaccccgttaacggaacccggttaaccgtaaggtaaacgtttacgttttaccgtaacccgtttaatttttaaccttacgttcgttaccgaagttaccggacgtacgggtaccttaccgaaccgttccgttaccgttcctaacccggtttgggtaccggaccggggtactaacgggtacgggcggttagaacggtaacccgtaagggtaccgttacggtcggtacgtaccggtacgacgtcccgtacggtcttttaccg

SEQ ID NO: 230139 - DNA, 944 bp, Homo sapiens
  misc_feature: GYAE6OF02HKT9P.47.84.H07.1.454.CMB.1.raw
  modified_base (249)..(249): a, c, t, g, unknown or other
  misc_feature (249)..(249): n is a, c, g, or t
tcagagctcacgtacacgaccggtgctcgatttagcagacgtctgtcgcgggggagaactgctcagttaggacccagacggaaccatggaacgccccagcgcagcttctcttcctcctgcttactctcggcctacccgagacgacccagtaggaataaagttagtagaagtacggaccgtcgtacgttcctaccgaccgtcccctacccgttgttaccttcgtccgtaccgtaacggaaggggaaaccnccgtacccaccgtacgttccgtaccggtagggtaccgggtaccgtacgtagttacgtagttacacgtaacttaccgtaacgttccgtaccggtagtaaccgagtacgaacggaccggtaccggtagggaccgtaccggtcccctaccggtaacggtcccttaccgtacgtaaccttacgttacggtaccgtcgtacccggtacccgtaccccgtaccgggtacccgtacccgttaccggtttacccggtacccgtacggttaccggttacggtacggtacggtcgggacgtttacgggggtcggttacggtacggtaacggtacgtttacgtcccgtaaccgtaccctaccgtaaccgtacgtacgaccgtaccggtaccgtaccgttaccgtcggttaaccgttaacggttaacggtttaacgtttacgttttaacggttaacgttttaaacgtttttaccgttaaacggttccgtaacgtaaacgttaaccgttaaggttaaaaccgttaccggtaccgttccgggttaacccgtttacggttaccccgggttaaccggtaaccggtaaaccggttacgtaaccgggttacgttaacgggtaaccgtttaaacggtaacggtaacggtttacggacgttacccgtaggttaccccgtacgtttcggttacccgtttcgtttaccctaaccccg

SEQ ID NO: 230140 - DNA, 723 bp, Homo sapiens
  misc_feature: GYAE6OF02IF267.47.84.H07.1.454.CMB.1.raw
  modified_base (145)..(145): a, c, t, g, unknown or other
  misc_feature (145)..(145): n is a, c, g, or t
  modified_base (169)..(169): a, c, t, g, unknown or other
  misc_feature (169)..(169): n is a, c, g, or t
  modified_base (183)..(183): a, c, t, g, unknown or other
  misc_feature (183)..(183): n is a, c, g, or t
  modified_base (196)..(196): a, c, t, g, unknown or other
  misc_feature (196)..(196): n is a, c, g, or t
tcagagctcacgtacacgaccggtgctcgatttagcagacgtctgtcgcgggggagaactgctcagttaggacccagacggaacatggaagccccagcgcagcttctcttcctcctgctactctggctccagactaccactgganaagtagagatgacgcagtctccancccacctgtctgtntactcgagggaancgccaccctctctgcgagggccagtcagtagttactacgcacgtactaacttacggccgttacggtaccagtaccgaacgaaaccggtggaccgacggtcccgtacccgaggtccctcctacgtacttacgttagtggtacgacctaccgtacccgacggaccggtcctacggtcggtacctcccgaacggtcgtacggtcgaggtacgggtaccgtagggttggtcggtagggatacggtacttcgtacctaccgttaccactactacgacgtacgtcgtacgtacaccgttaaacgtagtaacgttcgtttagaacccttaactttacgtacttagtaacccgaagtaaccggttaccggttaacccgtacccgttacgttaccggtttacggacccggtaacggtaacccgtaacgtacgtaacgtaccgtaacgtaacgtacggtacgttaccggacttacccgtaacctaccgttacttaccgtttaccgttacccgtactttccccgttaccgttaccccg

SEQ ID NO: 230141 - DNA, 144 bp, Homo sapiens
  misc_feature: GYAE6OF01C0SY7.51.13.B02.1.454.CMB.1.raw
  modified_base (128)..(144): a, c, t, g, unknown or other
  misc_feature (128)..(144): n is a, c, g, or t
tcagcgatcgtatacacgaccggtgctcgatttagtctagcgacttccgcgggctggcaaggcgcatagctgcctggtcaaggactacttcctcgtagcactctgagcgggctggcaaggcgcatagnnnnnnnnnnnnnnnnn

SEQ ID NO: 230142 - DNA, 130 bp, Homo sapiens
  misc_feature: GYAE6OF01BTU9Z.51.13.B02.1.454.CMB.1.raw
  modified_base (126)..(130): a, c, t, g, unknown or other
  misc_feature (126)..(130): n is a, c, g, or t
tcagcgatcgtatacacgaccggtgctcgatttagtctagcgacttccgcggctggcaaggcgcatagctgcctggtcaaggactacttcctcgtagcactctgagcggctggcaaggcgcatagnnnnn

SEQ ID NO: 230143 - DNA, 136 bp, Homo sapiens
  misc_feature: GYAE6OF01C7RZO.51.13.B02.1.454.CMB.1.raw
  modified_base (106)..(106): a, c, t, g, unknown or other
  misc_feature (106)..(106): n is a, c, g, or t
  modified_base (127)..(136): a, c, t, g, unknown or other
  misc_feature (127)..(136): n is a, c, g, or t
tcagcgatcgtatacacgaccggtgctcgatttagtctagcgacttccgcggctggcaaggcgcatagctgcctggtcaaggactacttcctcgtagcactctgancgggctggcaaggcgcatagnnnnnnnnnn

SEQ ID NO: 230144 - DNA, 358 bp, Homo sapiens
  misc_feature: GYAE6OF01BFNEO.51.13.B02.1.454.CMB.1.raw
  modified_base (167)..(167): a, c, t, g, unknown or other
  misc_feature (167)..(167): n is a, c, g, or t
  modified_base (201)..(201): a, c, t, g, unknown or other
  misc_feature (201)..(201): n is a, c, g, or t
  modified_base (219)..(219): a, c, t, g, unknown or other
  misc_feature (219)..(219): n is a, c, g, or t
  modified_base (237)..(237): a, c, t, g, unknown or other
  misc_feature (237)..(237): n is a, c, g, or t
  modified_base (249)..(249): a, c, t, g, unknown or other
  misc_feature (249)..(249): n is a, c, g, or t
  modified_base (261)..(261): a, c, t, g, unknown or other
  misc_feature (261)..(261): n is a, c, g, or t
  modified_base (271)..(271): a, c, t, g, unknown or other
  misc_feature (271)..(271): n is a, c, g, or t
  modified_base (296)..(296): a, c, t, g, unknown or other
  misc_feature (296)..(296): n is a, c, g, or t
  modified_base (298)..(298): a, c, t, g, unknown or other
  misc_feature (298)..(298): n is a, c, g, or t
  modified_base (300)..(300): a, c, t, g, unknown or other
  misc_feature (300)..(300): n is a, c, g, or t
  modified_base (302)..(302): a, c, t, g, unknown or other
  misc_feature (302)..(302): n is a, c, g, or t
  modified_base (304)..(358): a, c, t, g, unknown or other
  misc_feature (304)..(358): n is a, c, g, or t
tcagcgatcgtatacacgaccggtgctcgatttagtctagcgacttccgcgggctggcaaggcgcataggctggcaaggcgcataggctggcaaggcgcataggctggcaaggcgcataggctggcaaggcgcataggctggcaaggcgcataggctggcaaggcgnataggcctggcaaggcgcataggctggcaaggcncataggcctggcaaggcncataggctggcaggcgcntagctgctgganagctacgtccgngtacgctacncgcgacgcggcgcgcgagcgcgagngngngngnnnnnnnnnnnnnnnnnnnnnnnnnnnnnnnnnnnnnnnnnnnnnnnnnnnnnnn

SEQ ID NO: 230145 - DNA, 139 bp, Homo sapiens
  misc_feature: GYAE6OF01B22Y6.51.13.B02.1.454.CMB.1.raw
  modified_base (128)..(139): a, c, t, g, unknown or other
  misc_feature (128)..(139): n is a, c, g, or t
tcagcgatcgtatacacgaccggtgctcgatttagtctagcgacttccgcgggctggcaaggcgcatagctgcctggtcaaggactacttcctcgtagcactctgagcgggctggcaaggcgcatagnnnnnnnnnnnn

SEQ ID NO: 230146 - DNA, 150 bp, Homo sapiens
  misc_feature: GYAE6OF01B8BIG.51.13.B02.1.454.CMB.1.raw
  modified_base (128)..(150): a, c, t, g, unknown or other
  misc_feature (128)..(150): n is a, c, g, or t
tcagcgatcgtatacacgaccggtgctcgatttagtctagcgacttccgcgggctggcaaggcgcatagctgcctggtcaaggactacttcctcgtagcactctgagcgggctggcaaggcgcatagnnnnnnnnnnnnnnnnnnnnnnn

SEQ ID NO: 230147 - DNA, 139 bp, Homo sapiens; identical to SEQ ID NO: 230145
  misc_feature: GYAE6OF01EY88I.51.13.B02.1.454.CMB.1.raw
  modified_base (128)..(139): a, c, t, g, unknown or other
  misc_feature (128)..(139): n is a, c, g, or t

SEQ ID NO: 230148 - DNA, 146 bp, Homo sapiens
  misc_feature: GYAE6OF01D306K.51.13.B02.1.454.CMB.1.raw
  modified_base (128)..(146): a, c, t, g, unknown or other
  misc_feature (128)..(146): n is a, c, g, or t
tcagcgatcgtatacacgaccggtgctcgatttagtctagcgacttccgcgggctggcaaggcgcatagctgcctggtcaaggactacttcctcgtagcactctgagcgggctggcaaggcgcatagnnnnnnnnnnnnnnnnnnn

SEQ ID NO: 230149 - DNA, 132 bp, Homo sapiens
  misc_feature: GYAE6OF01C036G.51.13.B02.1.454.CMB.1.raw
  modified_base (128)..(132): a, c, t, g, unknown or other
  misc_feature (128)..(132): n is a, c, g, or t
tcagcgatcgtatacacgaccggtgctcgatttagtctagcgacttccgcgggctggcaaggcgcatagctgcctggtcaaggactacttcctcgtagcactctgagcgggctggcaaggcgcatagnnnnn

SEQ ID NO: 230150 - DNA, 150 bp, Homo sapiens; identical to SEQ ID NO: 230146
  misc_feature: GYAE6OF01B55Q7.51.13.B02.1.454.CMB.1.raw
  modified_base (128)..(150): a, c, t, g, unknown or other
  misc_feature (128)..(150): n is a, c, g, or t

SEQ ID NO: 230151 - DNA, 155 bp, Homo sapiens
  misc_feature: GYAE6OF01D3Y7Y.51.13.B02.1.454.CMB.1.raw
  modified_base (155)..(155): a, c, t, g, unknown or other
  misc_feature (155)..(155): n is a, c, g, or t
tcagcgatcgtatacacgaccggtgctcgatttagtctagcgacttccgcgggcacgaccggtgctcgatttagagtgctacgaagggaaggcagcgtcactctgttcccaccctcctctcgtagcactctgagcgggctggcaaggcgcatagn

SEQ ID NO: 230152 - DNA, 129 bp, Homo sapiens
  misc_feature: GYAE6OF01AMZ6S.51.13.B02.1.454.CMB.1.raw
  modified_base (128)..(129): a, c, t, g, unknown or other
  misc_feature (128)..(129): n is a, c, g, or t
tcagcgatcgtatacacgaccggtgctcgatttagtctagcgacttccgcgggctggcaaggcgcatagctgcctggtcaaggactacttcctcgtagcactctgagcgggctggcaaggcgcatagnn

SEQ ID NO: 230153 - DNA, 128 bp, Homo sapiens
  misc_feature: GYAE6OF01BARWE.51.13.B02.1.454.CMB.1.raw
  modified_base (128)..(128): a, c, t, g, unknown or other
  misc_feature (128)..(128): n is a, c, g, or t
tcagcgatcgtatacacgaccggtgctcgatttagtctagcgacttccgcgggctggcaaggcgcatagctgcctggtcaaggactacttcctcgtagcactctgagcgggctggcaaggcgcatagn

SEQ ID NO: 230154 - DNA, 136 bp, Homo sapiens
  misc_feature: GYAE6OF01DL8KS.51.13.B02.1.454.CMB.1.raw
  modified_base (128)..(136): a, c, t, g, unknown or other
  misc_feature (128)..(136): n is a, c, g, or t
tcagcgatcgtatacacgaccggtgctcgatttagtctagcgacttccgcgggctggcaaggcgcatagctgcctggtcaaggactacttcctcgtagcactctgagcgggctggcaaggcgcatagnnnnnnnnn

SEQ ID NO: 230155 - DNA, 135 bp, Homo sapiens
  misc_feature: GYAE6OF01E00S1.51.13.B02.1.454.CMB.1.raw
  modified_base (128)..(135): a, c, t, g, unknown or other
  misc_feature (128)..(135): n is a, c, g, or t
tcagcgatcgtatacacgaccggtgctcgatttagtctagcgacttccgcgggctggcaaggcgcatagctgcctggtcaaggactacttcctcgtagcactctgagcgggctggcaaggcgcatagnnnnnnnn

SEQ ID NO: 230156 - DNA, 139 bp, Homo sapiens; identical to SEQ ID NO: 230145
  misc_feature: GYAE6OF01BN8QA.51.13.B02.1.454.CMB.1.raw
  modified_base (128)..(139): a, c, t, g, unknown or other
  misc_feature (128)..(139): n is a, c, g, or t

SEQ ID NO: 230157 - DNA, 138 bp, Homo sapiens
  misc_feature: GYAE6OF01CFQ8R.51.13.B02.1.454.CMB.1.raw
  modified_base (128)..(138): a, c, t, g, unknown or other
  misc_feature (128)..(138): n is a, c, g, or t
tcagcgatcgtatacacgaccggtgctcgatttagtctagcgacttccgcgggctggcaaggcgcatagctgcctggtcaaggactacttcctcgtagcactctgagcgggctggcaaggcgcatagnnnnnnnnnnn

SEQ ID NO: 230158 - DNA, 151 bp, Homo sapiens
  misc_feature: GYAE6OF01CZKP1.51.13.B02.1.454.CMB.1.raw
  modified_base (128)..(151): a, c, t, g, unknown or other
  misc_feature (128)..(151): n is a, c, g, or t
tcagcgatcgtatacacgaccggtgctcgatttagtctagcgacttccgcgggctggcaaggcgcatagctgcctggtcaaggactacttcctcgtagcactctgagcgggctggcaaggcgcatagnnnnnnnnnnnnnnnnnnnnnnnn

SEQ ID NO: 230159 - DNA, 492 bp, Homo sapiens
  misc_feature: GYAE6OF01AC8LJ.51.13.B02.1.454.CMB.1.raw
  modified_base (311)..(311): a, c, t, g, unknown or other
  misc_feature (311)..(311): n is a, c, g, or t
  modified_base (470)..(470): a, c, t, g, unknown or other
  misc_feature (470)..(470): n is a, c, g, or t
tcagcgatcgtatacacgaccggtgctcgatttagtctagcgacttccgcgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccngggacagcccctaaactcctgatcctcgatgcatccactttggaacaggggtcccatcaaggttcagtggaagtggctctgggacagtattttacttcaccatcagcaggctgcagccctgaagacattgacaactatattactagtcaactgtaactntatagtcctcccgtcttacccg

SEQ ID NO: 230160 - DNA, 180 bp, Homo sapiens
  misc_feature: GYAE6OF01CAY73.51.13.B02.1.454.CMB.1.raw
  modified_base (128)..(128): a, c, t, g, unknown or other
  misc_feature (128)..(128): n is a, c, g, or t
  modified_base (135)..(180): a, c, t, g, unknown or other
  misc_feature (135)..(180): n is a, c, g, or t
tcagcgatcgtatacacgaccggtgctcgatttagtctagcgacttccgcggggctggcaaggcgcatacgctggccctggtcaaggacctacttcctcgtagctactctgagcgggctggcaaggcncatagcnnnnnnnnnnnnnnnnnnnnnnnnnnnnnnnnnnnnnnnnnnnnnn

SEQ ID NO: 230161 - DNA, 458 bp, Homo sapiens
  misc_feature: GYAE6OF01B50H8.51.13.B02.1.454.CMB.1.raw
  modified_base (132)..(132): a, c, t, g, unknown or other
  misc_feature (132)..(132): n is a, c, g, or t
  modified_base (185)..(185): a, c, t, g, unknown or other
  misc_feature (185)..(185): n is a, c, g, or t
  modified_base (213)..(213): a, c, t, g, unknown or other
  misc_feature (213)..(213): n is a, c, g, or t
  modified_base (237)..(237): a, c, t, g, unknown or other
  misc_feature (237)..(237): n is a, c, g, or t
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
  modified_base (258)..(258): a, c, t, g, unknown or other
  misc_feature (258)..(258): n is a, c, g, or t
  modified_base (267)..(267): a, c, t, g, unknown or other
  misc_feature (267)..(267): n is a, c, g, or t
  modified_base (273)..(273): a, c, t, g, unknown or other
  misc_feature (273)..(273): n is a, c, g, or t
  modified_base (278)..(278): a, c, t, g, unknown or other
  misc_feature (278)..(278): n is a, c, g, or t
  modified_base (303)..(303): a, c, t, g, unknown or other
  misc_feature (303)..(303): n is a, c, g, or t
  modified_base (311)..(311): a, c, t, g, unknown or other
  misc_feature (311)..(311): n is a, c, g, or t
  modified_base (318)..(318): a, c, t, g, unknown or other
  misc_feature (318)..(318): n is a, c, g, or t
  modified_base (326)..(326): a, c, t, g, unknown or other
  misc_feature (326)..(326): n is a, c, g, or t
  modified_base (330)..(330): a, c, t, g, unknown or other
  misc_feature (330)..(330): n is a, c, g, or t
  modified_base (342)..(342): a, c, t, g, unknown or other
  misc_feature (342)..(342): n is a, c, g, or t
  modified_base (344)..(344): a, c, t, g, unknown or other
  misc_feature (344)..(344): n is a, c, g, or t
  modified_base (350)..(350): a, c, t, g, unknown or other
  misc_feature (350)..(350): n is a, c, g, or t
  modified_base (356)..(356): a, c, t, g, unknown or other
  misc_feature (356)..(356): n is a, c, g, or t
  modified_base (362)..(362): a, c, t, g, unknown or other
  misc_feature (362)..(362): n is a, c, g, or t
  modified_base (369)..(369): a, c, t, g, unknown or other
  misc_feature (369)..(369): n is a, c, g, or t
  modified_base (372)..(372): a, c, t, g, unknown or other
  misc_feature (372)..(372): n is a, c, g, or t
  modified_base (390)..(390): a, c, t, g, unknown or other
  misc_feature (390)..(390): n is a, c, g, or t
  modified_base (402)..(402): a, c, t, g, unknown or other
  misc_feature (402)..(402): n is a, c, g, or t
  modified_base (422)..(422): a, c, t, g, unknown or other
  misc_feature (422)..(422): n is a, c, g, or t
  modified_base (435)..(435): a, c, t, g, unknown or other
  misc_feature (435)..(435): n is a, c, g, or t
  modified_base (453)..(453): a, c, t, g, unknown or other
  misc_feature (453)..(453): n is a, c, g, or t
  modified_base (455)..(455): a, c, t, g, unknown or other
  misc_feature (455)..(455): n is a, c, g, or t
tcagcgatcgtatacacgaccggtgctcgatttagtctagcgacttccgcgggctggcaaggcgcataggctggcaaggcgcataggctggcaaggcgcataggctggcaaggcgcataggctggcaaggcncataggctggcaggcgcataggctggcaaggcgcatacggctggcaacgggcncgattaggctagcaaggcgctaatgcgngcaaggtcgatgagctgccgaagngtcanggtcnggcaggctacngagctgganacgganctaanggactgacgtgacagctagctggcncgaagtcnggggacncggtacgngacnggacagttacgngnccgagntcgganactagngcgacgnagngagacgacgacgacgagngcgacgcgacgngagagcgacgcgagtcgagngagacgacgagcncgagcgacgcgacagcgngngag

SEQ ID NO: 230162 - DNA, 130 bp, Homo sapiens
  misc_feature: GYAE6OF01DZYBK.51.13.B02.1.454.CMB.1.raw
  modified_base (129)..(130): a, c, t, g, unknown or other
  misc_feature (129)..(130): n is a, c, g, or t
tcagcgatcgtatacacgaccggtgctcgatttagtctagcgacttccgcgggctggcaaggcgcatagctgcctggtcaaggactacttcctcgtagcactctgagccgggctggcaaggcgcatagnn

SEQ ID NO: 230163 - DNA, 130 bp, Homo sapiens
  misc_feature: GYAE6OF01DOGS9.51.13.B02.1.454.CMB.1.raw
  modified_base (128)..(130): a, c, t, g, unknown or other
  misc_feature (128)..(130): n is a, c, g, or t
tcagcgatcgtatacacgaccggtgctcgatttagtctagcgacttccgcgggctggcaaggcgcatagctgcctggtcaaggactacttcctcgtagcactctgagcgggctggcaaggcgcatagnnn

SEQ ID NO: 230164 - DNA, 155 bp, Homo sapiens
  misc_feature: GYAE6OF01AQK31.51.13.B02.1.454.CMB.1.raw
  modified_base (128)..(155): a, c, t, g, unknown or other
  misc_feature (128)..(155): n is a, c, g, or t
tcagcgatcgtatacacgaccggtgctcgatttagtctagcgacttccgcgggctggcaaggcgcatagctgcctggtcaaggactacttcctcgtagcactctgagcgggctggcaaggcgcatagnnnnnnnnnnnnnnnnnnnnnnnnnnnn

SEQ ID NO: 230165 - DNA, 154 bp, Homo sapiens
  misc_feature: GYAE6OF02H544F.51.13.B02.1.454.CMB.1.raw
  modified_base (128)..(154): a, c, t, g, unknown or other
  misc_feature (128)..(154): n is a, c, g, or t
tcagcgatcgtatacacgaccggtgctcgatttagtctagcgacttccgcgggctggcaaggcgcatagctgcctggtcaaggactacttcctcgtagcactctgagcgggctggcaaggcgcatagnnnnnnnnnnnnnnnnnnnnnnnnnnn

SEQ ID NO: 230166 - DNA, 154 bp, Homo sapiens; identical to SEQ ID NO: 230165
  misc_feature: GYAE6OF02JBRBB.51.13.B02.1.454.CMB.1.raw
  modified_base (128)..(154): a, c, t, g, unknown or other
  misc_feature (128)..(154): n is a, c, g, or t

SEQ ID NO: 230167 - DNA, 129 bp, Homo sapiens
  misc_feature: GYAE6OF02GD5IL.51.13.B02.1.454.CMB.1.raw
  modified_base (107)..(107): a, c, t, g, unknown or other
  misc_feature (107)..(107): n is a, c, g, or t
  modified_base (128)..(129): a, c, t, g, unknown or other
  misc_feature (128)..(129): n is a, c, g, or t
tcagcgatcgtatacacgaccggtgctcgatttagtctagcgacttccgcgggctggcaaggcgcatagctgcctggtcaaggactacttcctcgtagcactctgancgggctggcaaggcgcatagnn

SEQ ID NO: 230168 - DNA, 157 bp, Homo sapiens
  misc_feature: GYAE6OF02IOOWQ.51.13.B02.1.454.CMB.1.raw
  modified_base (157)..(157): a, c, t, g, unknown or other
  misc_feature (157)..(157): n is a, c, g, or t
tcagcgatcgtatacacgaccggtgctcgatttagtctagcgacttccgcgggcacgaccggtgctcgatttagagtgctacgaagggaaagggcagcgtcactctgttcccaccctcctctcgtagcactctgagcgggctggcaaggcgcatagn

SEQ ID NO: 230169 - DNA, 154 bp, Homo sapiens; identical to SEQ ID NO: 230165
  misc_feature: GYAE6OF02F5D9H.51.13.B02.1.454.CMB.1.raw
  modified_base (128)..(154): a, c, t, g, unknown or other
  misc_feature (128)..(154): n is a, c, g, or t

SEQ ID NO: 230170 - DNA, 144 bp, Homo sapiens
  misc_feature: GYAE6OF02GQNES.51.13.B02.1.454.CMB.1.raw
  modified_base (127)..(144): a, c, t, g, unknown or other
  misc_feature (127)..(144): n is a, c, g, or t
tcagcgatcgtatacacgaccggtgctcgatttagtctagcgacttccgcggctggcaaggcgcatagctgcctggtcaaggactacttcctcgtagcactctgagcgggctggcaaggcgcatagnnnnnnnnnnnnnnnnnn

SEQ ID NO: 230171 - DNA, 140 bp, Homo sapiens
  misc_feature: GYAE6OF02F94GH.51.13.B02.1.454.CMB.1.raw
  modified_base (126)..(140): a, c, t, g, unknown or other
  misc_feature (126)..(140): n is a, c, g, or t
tcagcgatcgtatacacgaccggtgctcgatttagtctagcgacttccgcggctggcaaggcgcatagctgcctggtcaaggactacttcctcgtagcactctgagcggctggcaaggcgcatagnnnnnnnnnnnnnnn

SEQ ID NO: 230172 - DNA, 135 bp, Homo sapiens; identical to SEQ ID NO: 230155
  misc_feature: GYAE6OF02IM3HX.51.13.B02.1.454.CMB.1.raw
  modified_base (128)..(135): a, c, t, g, unknown or other
  misc_feature (128)..(135): n is a, c, g, or t

SEQ ID NO: 230173 - DNA, 145 bp, Homo sapiens
  misc_feature: GYAE6OF02FXENQ.51.13.B02.1.454.CMB.1.raw
  modified_base (128)..(145): a, c, t, g, unknown or other
  misc_feature (128)..(145): n is a, c, g, or t
tcagcgatcgtatacacgaccggtgctcgatttagtctagcgacttccgcgggctggcaaggcgcatagctgcctggtcaaggactacttcctcgtagcactctgagcgggctggcaaggcgcatagnnnnnnnnnnnnnnnnnn

SEQ ID NO: 230174 - DNA, 150 bp, Homo sapiens; identical to SEQ ID NO: 230146
  misc_feature: GYAE6OF02HME08.51.13.B02.1.454.CMB.1.raw
  modified_base (128)..(150): a, c, t, g, unknown or other
  misc_feature (128)..(150): n is a, c, g, or t

SEQ ID NO: 230175 - DNA, 139 bp, Homo sapiens; identical to SEQ ID NO: 230145
  misc_feature: GYAE6OF02JD1KL.51.13.B02.1.454.CMB.1.raw
  modified_base (128)..(139): a, c, t, g, unknown or other
  misc_feature (128)..(139): n is a, c, g, or t

SEQ ID NO: 230176 - DNA, 157 bp, Homo sapiens; identical to SEQ ID NO: 230168
  misc_feature: GYAE6OF02H07P9.51.13.B02.1.454.CMB.1.raw
  modified_base (157)..(157): a, c, t, g, unknown or other
  misc_feature (157)..(157): n is a, c, g, or t

SEQ ID NO: 230177 - DNA, 144 bp, Homo sapiens; identical to SEQ ID NO: 230141
  misc_feature: GYAE6OF02FIQF4.51.13.B02.1.454.CMB.1.raw
  modified_base (128)..(144): a, c, t, g, unknown or other
  misc_feature (128)..(144): n is a, c, g, or t

SEQ ID NO: 230178 - DNA, 149 bp, Homo sapiens
  misc_feature: GYAE6OF02IIFK6.51.13.B02.1.454.CMB.1.raw
  modified_base (128)..(149): a, c, t, g, unknown or other
  misc_feature (128)..(149): n is a, c, g, or t
tcagcgatcgtatacacgaccggtgctcgatttagtctagcgacttccgcgggctggcaaggcgcatagctgcctggtcaaggactacttcctcgtagcactctgagcgggctggcaaggcgcatagnnnnnnnnnnnnnnnnnnnnnn

SEQ ID NO: 230179 - DNA, 125 bp, Homo sapiens
  misc_feature: GYAE6OF02HI4PY.51.13.B02.1.454.CMB.1.raw
tcagcgatcgtatacacgaccggtgctcgatttagtctagcgacttccgcgggcacgaccggtgctcgatttggtctaggactctggggtacgcactcgtctgagcgggctggcaaggcgcatag

SEQ ID NO: 230180 - DNA, 554 bp, Homo sapiens
  misc_feature: GYAE6OF02HUSFK.51.13.B02.1.454.CMB.1.raw
  modified_base (107)..(107): a, c, t, g, unknown or other
  misc_feature (107)..(107): n is a, c, g, or t
  modified_base (128)..(129): a, c, t, g, unknown or other
  misc_feature (128)..(129): n is a, c, g, or t
  modified_base (131)..(131): a, c, t, g, unknown or other
  misc_feature (131)..(131): n is a, c, g, or t
  modified_base (133)..(133): a, c, t, g, unknown or other
  misc_feature (133)..(133): n is a, c, g, or t
  modified_base (138)..(138): a, c, t, g, unknown or other
  misc_feature (138)..(138): n is a, c, g, or t
  modified_base (142)..(142): a, c, t, g, unknown or other
  misc_feature (142)..(142): n is a, c, g, or t
  modified_base (144)..(144): a, c, t, g, unknown or other
  misc_feature (144)..(144): n is a, c, g, or t
  modified_base (151)..(152): a, c, t, g, unknown or other
  misc_feature (151)..(152): n is a, c, g, or t
  modified_base (162)..(162): a, c, t, g, unknown or other
  misc_feature (162)..(162): n is a, c, g, or t
  modified_base (165)..(165): a, c, t, g, unknown or other
  misc_feature (165)..(165): n is a, c, g, or t
  modified_base (177)..(177): a, c, t, g, unknown or other
  misc_feature (177)..(177): n is a, c, g, or t
  modified_base (179)..(179): a, c, t, g, unknown or other
  misc_feature (179)..(179): n is a, c, g, or t
  modified_base (181)..(181): a, c, t, g, unknown or other
  misc_feature (181)..(181): n is a, c, g, or t
  modified_base (187)..(187): a, c, t, g, unknown or other
  misc_feature (187)..(187): n is a, c, g, or t
  modified_base (190)..(190): a, c, t, g, unknown or other
  misc_feature (190)..(190): n is a, c, g, or t
  modified_base (210)..(210): a, c, t, g, unknown or other
  misc_feature (210)..(210): n is a, c, g, or t
  modified_base (212)..(212): a, c, t, g, unknown or other
  misc_feature (212)..(212): n is a, c, g, or t
  modified_base (217)..(217): a, c, t, g, unknown or other
  misc_feature (217)..(217): n is a, c, g, or t
  modified_base (220)..(220): a, c, t, g, unknown or other
  misc_feature (220)..(220): n is a, c, g, or t
  modified_base (236)..(236): a, c, t, g, unknown or other
  misc_feature (236)..(236): n is a, c, g, or t
  modified_base (251)..(251): a, c, t, g, unknown or other
  misc_feature (251)..(251): n is a, c, g, or t
  modified_base (253)..(253): a, c, t, g, unknown or other
  misc_feature (253)..(253): n is a, c, g, or t
  modified_base (257)..(257): a, c, t, g, unknown or other
  misc_feature (257)..(257): n is a, c, g, or t
tcagcgatcgtatacacgaccggtgctcgatttagtctagcgacttccgcgggctggcaaggcgcatagctgcctggtcaaggactacttcctcgtagcactctgancggctggcaaggcgcatagcnncngnagctntctnancgatctnncgctgcagcncancgcagctgcagntntncgtagnatntagcgtacgacgagtcagcntnacagntcncgacgactctacgtcngtactctagtcacgngngcgngacgacgtacgtacgtacgtcgtcgtcgtcgtcgtacgtacgtacgtacgtcgtacgtacgtacgtcgtacgtacgtacgacgtacgacgtacgtacgacgtacgtacgtacgtcgacgtacgtacgtacgtacgtacgtacgtacgtacgtacgtacgtacgtacgtacgtacgtacgtacgtacgtacgtacgtacgtacgtacgtacgtacgtacgtacgtacgtacgtacgtcgtacgtacgtacgtacgacgtaccgtcgtacgtacgtccgtacgtacgtaccgtacgtcg

SEQ ID NO: 230181 - DNA, 145 bp, Homo sapiens; identical to SEQ ID NO: 230173
  misc_feature: GYAE6OF02FSB2F.51.13.B02.1.454.CMB.1.raw
  modified_base (128)..(145): a, c, t, g, unknown or other
  misc_feature (128)..(145): n is a, c, g, or t

SEQ ID NO: 230182 - DNA, 133 bp, Homo sapiens
  misc_feature: GYAE6OF02H61QA.51.13.B02.1.454.CMB.1.raw
  modified_base (128)..(133): a, c, t, g, unknown or other
  misc_feature (128)..(133): n is a, c, g, or t
tcagcgatcgtatacacgaccggtgctcgatttagtctagcgacttccgcgggctggcaaggcgcatagctgcctggtcaaggactacttcctcgtagcactctgagcgggctggcaaggcgcatagnnnnnn

SEQ ID NO: 230183 - DNA, 137 bp, Homo sapiens
  misc_feature: GYAE6OF02GX946.51.13.B02.1.454.CMB.1.raw
  modified_base (128)..(137): a, c, t, g, unknown or other
  misc_feature (128)..(137): n is a, c, g, or t
tcagcgatcgtatacacgaccggtgctcgatttagtctagcgacttccgcgggctggcaaggcgcatagctgcctggtcaaggactacttcctcgtagcactctgagcgggctggcaaggcgcatagnnnnnnnnnn

SEQ ID NO: 230184 - DNA, 215 bp, Homo sapiens
  misc_feature: GYAE6OF01AYQQH.21.12.B01.1.454.CMB.1.raw
  modified_base (213)..(215): a, c, t, g, unknown or other
  misc_feature (213)..(215): n is a, c, g, or t
tcagtcgtcgctcgcacgaccggtgctcgatttagtagtgtagatttgggttcggggacactggtcaccgtctcttcagcctccaccaagggcccatcggtcttcccctggcgccctgctccaggagcacctccgagagcacagcggccctgggctgcctggtcaaggactacttcccgagcgacgactgagcgggctggcaaggcgcatagnnn

SEQ ID NO: 230185 - DNA, 217 bp, Homo sapiens
  misc_feature: GYAE6OF01DIQ5Y.21.12.B01.1.454.CMB.1.raw
  modified_base (214)..(217): a, c, t, g, unknown or other
  misc_feature (214)..(217): n is a, c, g, or t
tcagtcgtcgctcgcacgaccggtgctcgatttagtagtgtagatttgggttcggggacactggtcaccgtctcttcagcctccaccaagggcccatcggtcttccccctggcgccctgctccaggagcacctccgagagcacagcggccctgggctgcctggtcaaggactacttcccgagcgacgactgagcgggctggcaaggcgcatagnnnn

SEQ ID NO: 230186 - DNA, 215 bp, Homo sapiens
  misc_feature: GYAE6OF01A11N3.21.12.B01.1.454.CMB.1.raw
  modified_base (214)..(215): a, c, t, g, unknown or other
  misc_feature (214)..(215): n is a, c, g, or t
tcagtcgtcgctcgcacgaccggtgctcgatttagtagtgtagatttgggttcggggacactggtcaccgtctcttcagcctccaccaagggcccatcggtcttccccctggcgccctgctccaggagcacctccgagagcacagcggccctgggctgcctggtcaaggactacttcccgagcgacgactgagcgggctggcaaggcgcatagnn

SEQ ID NO: 230187 - DNA, 217 bp, Homo sapiens
  misc_feature: GYAE6OF02IEKNM.21.12.B01.1.454.CMB.1.raw
  modified_base (213)..(217): a, c, t, g, unknown or other
  misc_feature (213)..(217): n is a, c, g, or t
tcagtcgtcgctcgcacgaccggtgctcgatttagtagtgtagatttgggttcggggacactggtcaccgtctcttcagcctccaccaagggcccatcggtcttcccctggcgccctgctccaggagcacctccgagagcacagcggccctgggctgcctggtcaaggactacttcccgagcgacgactgagcgggctggcaaggcgcatagnnnnn

SEQ ID NO: 230188 - DNA, 177 bp, Homo sapiens
  misc_feature: GYAE6OF01BHYBK.3.4.A04.1.454.CMB.1.raw
  modified_base (173)..(177): a, c, t, g, unknown or other
  misc_feature (173)..(177): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccagtggtagtttgggctggaggcgggctggacgaaggcgcatagnnnnn

SEQ ID NO: 230189 - DNA, 511 bp, Homo sapiens
  misc_feature: GYAE6OF01A51K8.3.4.A04.1.454.CMB.1.raw
tcagagacgcactccacgaccggtgctcgatttagagtagtgatcaggggtgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaaccgggactctggggtcccagacagattcagcggcagtgggtcaggcactgattcacactagaaatcagcagggtgaggctgagatgttgggtttatactgcatgacaaggtacaacacgtggccctccggacgttcggccacgggaccaagggtcggaaatcgaaacgataggtggcctgcaccatctgtcttctac

SEQ ID NO: 230190 - DNA, 562 bp, Homo sapiens
  misc_feature: GYAE6OF01COQI8.3.4.A04.1.454.CMB.1.raw
  modified_base (173)..(173): a, c, t, g, unknown or other
  misc_feature (173)..(173): n is a, c, g, or t
  modified_base (323)..(323): a, c, t, g, unknown or other
  misc_feature (323)..(323): n is a, c, g, or t
  modified_base (329)..(329): a, c, t, g, unknown or other
  misc_feature (329)..(329): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcgtgtttcgcgtagctcttaagaggtntcagtgcaggtgcagctggtgagtcgtggggagcgtggcccagcctgggagtccaggactctcctgtacagtctctggattcaccttaggttactatgctatgcacgtgggtccgccggtctccgaggcaaggggctggagtgggtgacngtttanactcagtgagtggagacgagtaacgtacgtacgacgacgtacgtcgtacggacggacgtacgtactacctacgtactaccgacgacgaactaactaccgaacgaacgacgtacgtacgtactactacgtaacaacgtaacgaacgacgacgtacgagacgtacgtacgacggacgacgtacgtagtagttacgttagtagtgagagagtagtagtagtaggtgtaagtaacgg

SEQ ID NO: 230191 - DNA, 506 bp, Homo sapiens
  misc_feature: GYAE6OF01AH1JU.3.4.A04.1.454.CMB.1.raw
  modified_base (336)..(336): a, c, t, g, unknown or other
  misc_feature (336)..(336): n is a, c, g, or t
  modified_base (473)..(473): a, c, t, g, unknown or other
  misc_feature (473)..(473): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtctgggggagcgtggcccagcctgggaggtcccaggactctcctgtacagtctctggattcaccttaggttactatgctatgcacgtgggtccgccgggctccaggcaaggggctggagtgggtgcagttanatccatgatggagcagtaatcctacgcagactccgtgaacgggccgattcaccatctcagagacaattccaagacacgctgtatctgacaaatgaacagcctagagacgctaggaggaccacggctagtgtattacnggtgacgagagtagtgagtgggtgagttaacgg

SEQ ID NO: 230192 - DNA, 530 bp, Homo sapiens
  misc_feature: GYAE6OF01CB75H.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtgggggaggcgtggcccagcctgggaggtcccaggaactctcctgtacagtctctggattcaccttaggttactatgctatgcactgggtccgccgggctccaggcaaggggctgggagtgggtggcagttatatcccatgatgggagcaagtaaatcctagcagactccgtgaagggccgattcacatctcagagacaattccaagaacacgctgtatctgacaaatgaaacacggacctaggaagacgactaggaacggacacggtctggtcgtattacgtgttggacgagagtataggagttgggtcgtaattaaccggg

SEQ ID NO: 230193 - DNA, 536 bp, Homo sapiens
  misc_feature: GYAE6OF01B2NK4.3.4.A04.1.454.CMB.1.raw
  modified_base (409)..(409): a, c, t, g, unknown or other
  misc_feature (409)..(409): n is a, c, g, or t
  modified_base (457)..(457): a, c, t, g, unknown or other
  misc_feature (457)..(457): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtctgggggaggcgtggcccaggcctggggaggtcccgaggaactctcctgtacagtctctggattcaccttaggttactatgctatgcactgggtccgccgggctccgaggcaaggggctgggagtgggtggcagttatatccatgatggagcagtaaatcctacgcagactccggtagaacgggccagttccacatctccaganacaattaccaagaacacgctagactctgacaaatcgaacagcctgagngctagacggacacggctggtagttacttagtggtacgcggaagagtaacgtggtagtggggttacgtagttaaaccggg

SEQ ID NO: 230194 - DNA, 511 bp, Homo sapiens
  misc_feature: GYAE6OF01BJ81C.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtgggggaggcgtggcccagccgtgggaggtcccaggactctcctgtacagtctctggattcaccttaggttactatgctatgcactgggtccgccgggctccaggcaaggggctgggagtgggtggcagttatatcccatgatgggaggcagtaaatcctacgcagactccgtgaagggccgattcaccatctcaagagacaattccaagaacacgctagtatctgaccaaatgaaccagccctagagagctagaggacacggctgtgtattactgtgcgagagtatgagtgggtgagtaacgg

SEQ ID NO: 230195 - DNA, 532 bp, Homo sapiens
  misc_feature: GYAE6OF01BTUFD.3.4.A04.1.454.CMB.1.raw
  modified_base (372)..(372): a, c, t, g, unknown or other
  misc_feature (372)..(372): n is a, c, g, or t
tcagagacgcactccacgaccggtgctcgatttagagtagtgatcagggggatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaaccgggactcgtggggtcccagaccagattcagcggcagtgggtcaggcactgatttcanactagaaatcagcagggtggaggctggaggtattggtttaggggtttattacgtgacagtgacgaaggtacacgacgtcggcctccgacgttcgacgccgaacggaccgaaggtagaaacacgaaacgatggtcgctgacacctatcgtcgtcttctacg

SEQ ID NO: 230196 - DNA, 509 bp, Homo sapiens
  misc_feature: GYAE6OF01EHCE4.3.4.A04.1.454.CMB.1.raw
  modified_base (401)..(401): a, c, t, g, unknown or other
  misc_feature (401)..(401): n is a, c, g, or t
  modified_base (440)..(440): a, c, t, g, unknown or other
  misc_feature (440)..(440): n is a, c, g, or t
  modified_base (477)..(477): a, c, t, g, unknown or other
  misc_feature (477)..(477): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtgggggagcgtggcccagcctgggaggtcccaggaactctcctgtacagtctctggattcacctttaggtactatgctatgcactgggtccgccgggctccgaggcaaggggctgggagtgggtgcagttatatccatgatggagcagtaaatcctagcagactccgtgaacggccgattcaccatctccaganacaattaccaagaacacgctagtatctgacaaatgaacngacctgagacgctaggaggacacggctgtgtattagngtgcgagagtataggatcgggtgagttaacgg

SEQ ID NO: 230197 - DNA, 530 bp, Homo sapiens
  misc_feature: GYAE6OF01DUYPN.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtgggggagcgtggcccagcctgggaggtcccaggaactctcctgtacagtctctggattcaccttaggttactatgctatgcactggggtccgccgggctccgaggcgaaggggctgggagtgggtggcagttatatccatgatggaggcaagtaaactcctaacgcagactccgtaggaacgggccaattccaccatcctccagagaacaattccaagaacacgctagtatctgacaaagtgaacacgcctaggagagtctaggaacggacacggctaggtgtaattagtggtgacgagagtatgagtgggtgagttaacgg

SEQ ID NO: 230198 - DNA, 512 bp, Homo sapiens
  misc_feature: GYAE6OF01DMMPY.3.4.A04.1.454.CMB.1.raw
tcagagacgcactccacgaccggtgctcgatttagagtagtgatcagggtgatcaggactcctcagttcaccttctcacaatgaggctccctgctcagctcctgggctgctaatgctctgggtcccaggatccagtggggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaaccgggactctggggtccccagacagattcagcggcagtgggtcaggcactgatttcacactgaaaatcagcagggtgaggctagaggattgttggggtttattacgtgtcagtgacaaggtacacactcggcctccggacgttcggccacgggaccaaggtgaaatcgaaacgactgtggctgcaccatctgtcttctac

SEQ ID NO: 230199 - DNA, 526 bp, Homo sapiens
  misc_feature: GYAE6OF01DELW8.3.4.A04.1.454.CMB.1.raw
  modified_base (299)..(299): a, c, t, g, unknown or other
  misc_feature (299)..(299): n is a, c, g, or t
  modified_base (340)..(340): a, c, t, g, unknown or other
  misc_feature (340)..(340): n is a, c, g, or t
  modified_base (477)..(477): a, c, t, g, unknown or other
  misc_feature (477)..(477): n is a, c, g, or t
  modified_base (505)..(505): a, c, t, g, unknown or other
  misc_feature (505)..(505): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtgggggagcgtggcccagcctgggagtcccaggaactctcctgtacagtctctggacttcaccttaggttactatgctatgcactgggtccnccgggctccgaggcaaggggctggagtgggtgcagttatanccatgatgggagcaagtaaactcctacgcagactccgtagaagggccgattccacctatctaccaagacgaactaattaccaaagaaccacgctagtactctagacaaatgaacagcctagagagctggaaggaccncggctgtagtatactggtgacgagacgnttagagtgggtctagtaacgg

SEQ ID NO: 230200 - DNA, 631 bp, Homo sapiens
  misc_feature: GYAE6OF01C519H.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagtcgttgggttttcctcgttgtcttacttttaagaggttgtccagtgccaggtgcagctgggtggagtcggtgggggagcggtcggcccaggccgtggggacgtcccaggacctctcctgtacagtctctggattcaccttaggttactatgtctatgcacgtcgggtccgccgggctccgaggcgaaggggctagggagtggggtggcagttactatccatgagtggaggacaagtaactcctacgacagtactcgtaggaacgggtccgactcgacactctaccagacgaactaacttaccaacgaacacgtactagtactctagaactaaagtacgaacgacgacgtagacggtacgacgtaggaacgggacgacgggtaccgttaggttacggtttaacgtttacttacgggttcggtaacgggtaaggtaacggtaaggtacgggtaaggttacggggttacgtaagtttaaaaccggggg

SEQ ID NO: 230201 - DNA, 516 bp, Homo sapiens
  misc_feature: GYAE6OF01B50LO.3.4.A04.1.454.CMB.1.raw
  modified_base (364)..(364): a, c, t, g, unknown or other
  misc_feature (364)..(364): n is a, c, g, or t
  modified_base (378)..(378): a, c, t, g, unknown or other
  misc_feature (378)..(378): n is a, c, g, or t
  modified_base (391)..(391): a, c, t, g, unknown or other
  misc_feature (391)..(391): n is a, c, g, or t
  modified_base (394)..(394): a, c, t, g, unknown or other
  misc_feature (394)..(394): n is a, c, g, or t
  modified_base (477)..(477): a, c, t, g, unknown or other
  misc_feature (477)..(477): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtgggggaggcgtggcccagcctgggaggtcccaggaactctcctgtacagtctctggattcaccttaggttactatgctatgcactgggtccgccgggctccgaggcaaggggctgggagtgggtggcagttatatcccatgatggaggcagtaaancctagcagactcgngaaggccatcacntcncagagacattaccaagaacacgctgtatctgacaaatcgaacacgcctgagagcgtagacggacacgggctagtgtattacgnggtgcggaagagtagtgagtgggtcgtaagttaaacggg

SEQ ID NO: 230202 - DNA, 583 bp, Homo sapiens
  misc_feature: GYAE6OF01DQR1N.3.4.A04.1.454.CMB.1.raw
  modified_base (158)..(158): a, c, t, g, unknown or other
  misc_feature (158)..(158): n is a, c, g, or t
  modified_base (348)..(348): a, c, t, g, unknown or other
  misc_feature (348)..(348): n is a, c, g, or t
  modified_base (384)..(384): a, c, t, g, unknown or other
  misc_feature (384)..(384): n is a, c, g, or t
  modified_base (397)..(397): a, c, t, g, unknown or other
  misc_feature (397)..(397): n is a, c, g, or t
  modified_base (452)..(452): a, c, t, g, unknown or other
  misc_feature (452)..(452): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttccncgttgctcttttaagaggtgtccagtgccaggtgcagctggtggagtcgtgggggagcgtggcccaggcctggggacgtcccaggaactctcctgtacagtctctggattcaccttaggttactatgctagtgcacgtgggtccgccgggctccgaggcgaaggggctgggacgtggggtgcgagttatntcccatcgatggagcaagtaactcacgcagactcgngacggccatcacntctcagacgacaacttacaagaacgacgactcgtatcgtagactaaatcgaaacncgaccgtacgaagagccgtagggacggtaccgacggtccgtagggttacgtaacgtttacggttggtacgggtaccgtaaggtaacgtaagttacgggaaggttcggggtaacggtaagtttaaaccgggg

SEQ ID NO: 230203 - DNA, 624 bp, Homo sapiens
  misc_feature: GYAE6OF01A4P7P.3.4.A04.1.454.CMB.1.raw
tcagagacgcactccacgaccggtgctcgatttagagtagtgatcaggggtgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaaccgggctcgtggggtcccagacagatcagcgcaggtggtcaggcactgtatttcacactagaaatcgagcgagggtggagcgtaggaggtagttggttaggggtttattacgtgctagtggacgtaaggtaccaacgtaccgtcgggtcccgttacccggtaaccggtttccgggacccgtaaccggggaacccgtaaacggggtaacgggtaaaacgtaacccggaaaaaccggtaacgtacgggttacgggaccgttacggacccgtaaacccgtacgttaccgtttcgttcccgtttccgtaacccg

SEQ ID NO: 230204 - DNA, 554 bp, Homo sapiens
  misc_feature: GYAE6OF01A5UDD.3.4.A04.1.454.CMB.1.raw
  modified_base (525)..(525): a, c, t, g, unknown or other
  misc_feature (525)..(525): n is a, c, g, or t
  modified_base (547)..(547): a, c, t, g, unknown or other
  misc_feature (547)..(547): n is a, c, g, or t
tcagagacgcactccacgaccggtgctcgatttagagtagtgatcagggggatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacagtgatggaaacacctacttgaattggttcagcagaggccaggccaatctccgaaggccgaccttaatttataaggtttctaaccgggacttcgtggggtaccccagacagtattcgagcggcaggtgggtcaggcactgtatttcactactagaaatcagcgagggtggagggctaggaggtagttggttggggtttattacgtgacagtagactaaggtacacgtactcggaccctccggacgttcggaccgacgggaccaagggtacggaaactacgaaacgtactggnggctgcacacttctagtcttcncttcccg

SEQ ID NO: 230205 - DNA, 588 bp, Homo sapiens
  misc_feature: GYAE6OF01BE82Z.3.4.A04.1.454.CMB.1.raw
  modified_base (341)..(341): a, c, t, g, unknown or other
  misc_feature (341)..(341): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcgtggtttcgtcgtaggctctttaagaggtgtccagtgccaggtgcagctggtggagtcgtgggggagcgtggcccagccgtgggaggtcccaggaactctcctgtacagtctctggattcaccttaggttactatgctatgcacgtgggtccgccgggctccgaggcaaggggctgggagtgggtggcagttanatccatgagtggagcaagtaaactccgtacgcacgactccggtggaacgggccgattcgaccatcctacagacgacaattccaaagtaacacgctagtactcgtagactaaagtcgaactacgccgttagaacgtacgcgtacggaacggaccgtacgggtcctaggttacgttaacgtttacgtggttcggtaacggaggtaaggtagtcgggtaagttacggggtaccgtaaggttaaaccgggg

SEQ ID NO: 230206 - DNA, 673 bp, Homo sapiens
  misc_feature: GYAE6OF01BXG8X.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttcttttaagaggtgtccagtgccaggtgcagctgggtggagtcgtgggggagcgtggcccagccgtggggacgtcccaggaacctctcctgtacagtctctggattcaccttaggttactatgctatgctacgtgggtccgccgggctccgaggcgaagggggctgggaggtggggtggcgtaggtttatactcccatggatgggaggcaaggttaaaactccgtaacggcaagaccgtaccggtaggaaacgggccgtaactttccaaccgtactccgtaccgaagaacgaacctaaatttacccgaaacgtaacaaccgtacctacgtaacttccgtacgacctaaaagtcgaaaccaacggtacccgtagaacggacgacgtaggaacgggaaccgtaccgggtacgttagggttacgttaacgttttaaccggtaggttacgggacggtaacggaaggtagtagggtaaggttcgggggttacgtaaacggtttaaaaccggg

SEQ ID NO: 230207 - DNA, 561 bp, Homo sapiens
  misc_feature: GYAE6OF01CMCRN.3.4.A04.1.454.CMB.1.raw
  modified_base (407)..(407): a, c, t, g, unknown or other
  misc_feature (407)..(407): n is a, c, g, or t
  modified_base (410)..(410): a, c, t, g, unknown or other
  misc_feature (410)..(410): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctgggtggagtcgtgggggaggcgtggcccagcctggggagtcccaggaactctcctgtacagtctctggattcaccttaggttactatgctatgcactggggtccgccgggctccgaggcgaagggggctgggaggtggggtggcaggttatactccatgatgggaggcaagtaaactcctaacgcaagactcgtgaacgggccatcaccntcncagacacaactccaagaacacgctagtatctagactaaatcgaacagtaccctagagacgacgtagaacggacgaccgggtctaggtagttaagtttacgtggtcgacggaagagtagtaggaagttcgggggtacctaaggttaaccggg

SEQ ID NO: 230208 - DNA, 647 bp, Homo sapiens
  misc_feature: GYAE6OF01DNNQ7.3.4.A04.1.454.CMB.1.raw
  modified_base (250)..(250): a, c, t, g, unknown or other
  misc_feature (250)..(250): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatgggagtttgggctgagctgggttttcctcgttgcttcttttaagaggtgtccagtgccaggtgcagctgggtggagtcgtgggggagcgtggcccagccgtgggacgtcccaggactcncctgtacagtctctggacttcaccttaggttactatgctatgcacgtgggtccgccgggctccgaggcaaggggctgggaggtgggtggctagttatactccagtgatggggaggcaagtaaactcctaacgcagactcgtaggaagggcctatcaccatcctaccgagacgaacaaacttaccgaaagaaccacggctagtaacttcgtagactaaaagtacgaaaccgagacccgtaggaacggaacggtaccgtagggtaacgggaaacccgtacggggtacctttagggttaacgtttaacgtttaaacggttcggtacgggtaaccggtaaggtaaacgggtaggttaagggaaggtttacggggggtaacgtaaacggtttaaaaccgggg

SEQ ID NO: 230209 - DNA, 622 bp, Homo sapiens
  misc_feature: GYAE6OF01C3B5T.3.4.A04.1.454.CMB.1.raw
  modified_base (158)..(158): a, c, t, g, unknown or other
  misc_feature (158)..(158): n is a, c, g, or t
  modified_base (360)..(360): a, c, t, g, unknown or other
  misc_feature (360)..(360): n is a, c, g, or t
  modified_base (392)..(392): a, c, t, g, unknown or other
  misc_feature (392)..(392): n is a, c, g, or t
  modified_base (399)..(399): a, c, t, g, unknown or other
  misc_feature (399)..(399): n is a, c, g, or t
  modified_base (418)..(418): a, c, t, g, unknown or other
  misc_feature (418)..(418): n is a, c, g, or t
tcagagacgcactccacgaccggtgctcgatttagagtagtgatcagggggatcaggactcctcagttcaccttctcacaatgaggctccctgctcagctccgtggggctgctaatgctctgggtcccaggatccgaggtgggatgttgtgatgactnatctccactctccctcgcccgtcctacccgttggaccacggcccggtcctccatcctcctgctaggtctaagtacaaacgccttacgtatacgagtgagtacgaaactcctatgtattggttcagcaggacgccaggacaactcacaggcacttaattagtaagtttccgacggactgtcgggaccagacatgtacgagcgngtaggtggacaggctacgtagtacttccgaanaacgtanaaaagtcgagacggagggnggacgtagagtaggtagtttaggttagggtttattaacgtgtagtagtagacgtaaggtaactacgtaacgtcggtaccgtaccggttacgtacccgggtacgaaccgggaaccgtaagggtacgaaaacgtaccgaaaaacggtcgtaggttacggcgttacggacctaccgtacttacgtcgttcttccgtaactttccccg

SEQ ID NO: 230210 - DNA, 530 bp, Homo sapiens
  misc_feature: GYAE6OF01AGXK6.3.4.A04.1.454.CMB.1.raw
  modified_base (192)..(192): a, c, t, g, unknown or other
  misc_feature (192)..(192): n is a, c, g, or t
  modified_base (406)..(406): a, c, t, g, unknown or other
  misc_feature (406)..(406): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtncagctggtggagtcgtgggggagcgtggcccagccgtgggaggtcccaggactctcctgtacagtctctggacttcaccttaggttactatgctatgcacgtgggtccgccgggctccgaggcgaaggggctgggaggtgggtggctagttatacgtcccagtgatggaggcagtaaactcctacgcagactccgtagacgggccatcacatcncagacgacaataccaagaacacgctgtatctagacaaatagaacacgccgtagagagcgagacggacgacggctgtagtattacgtgtcgacgaggagtagtgagtcgggtacgtagttaacgg

SEQ ID NO: 230211 - DNA, 626 bp, Homo sapiens
  misc_feature: GYAE6OF01D1V5R.3.4.A04.1.454.CMB.1.raw
  modified_base (174)..(174): a, c, t, g, unknown or other
  misc_feature (174)..(174): n is a, c, g, or t
  modified_base (253)..(253): a, c, t, g, unknown or other
  misc_feature (253)..(253): n is a, c, g, or t
  modified_base (349)..(349): a, c, t, g, unknown or other
  misc_feature (349)..(349): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcgtggtttctcgtgctctttaagaggtntcagtgccaggtgcagctggtggagtcgtgggggaggcgtggcccagccgtgggacggtcccaggacctctcctgtacngtctctggattcaccttaggttactatgctatgcacgtgggtcccgcgggctccgagggcgaagggggctagggagtgggtcggctaggttatacnccatgagtcgggagactaagtaaactccgtaacgcacgtcgtaccggtaggaacgggccgtaacttccaacctacgtcctaccgagaacgaactaaacgttacccgaaacgtaaccgaccgtacgttacgtaactcgtacgtaaccaaagtacgaaacgacgtaccgtaggacgacgtacgtggaacggaaccgtacgggtcttaggtcgttaaacgttacgtaggtcggacgaagtaagggtctagggtaaggtcgggttaccgaagttaaacggg

SEQ ID NO: 230212 - DNA, 604 bp, Homo sapiens
  misc_feature: GYAE6OF01EADSL.3.4.A04.1.454.CMB.1.raw
  modified_base (344)..(344): a, c, t, g, unknown or other
  misc_feature (344)..(344): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttcttttaagaggtgtccagtgccaggtgcagctggtggagtcgtgggggagcgtggcccagcctgggacgtcccaggaactctcctgtacagtctctggattcacttaggttactatgctatgctacgtcgggtccgccgggctccgaggcgaggggcgtggagtgggtgctagttanatccatgagtggagacagtaaactccgtacgcagtacgtccgtaggaacgggcccgtattaccaacctactcctaccgagaacgaactaacttacccaaagtaaccacgtactagtactacgtagtaactaaagtacgaaacgacgtacccgtaggaacggagaccgtaggaaccgggaaccgacggtcgtaggttacgttactttacgtggtcggacgtaaggaagtagtaggtaaggtcgggtagtaagttaaacggg

SEQ ID NO: 230213 - DNA, 545 bp, Homo sapiens
  misc_feature: GYAE6OF01D3FEO.3.4.A04.1.454.CMB.1.raw
  modified_base (258)..(258): a, c, t, g, unknown or other
  misc_feature (258)..(258): n is a, c, g, or t
  modified_base (481)..(481): a, c, t, g, unknown or other
  misc_feature (481)..(481): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttcttttaagaggtgtccagtgccaggtgcagcgtggtggagtcgtgggggagcgtggcccagccgtgggacgtcccaggactctcctgtacngtctctggattcaccttaggttactatgctatgcacgtgggtccgccgggctccgaggcaaggggctggagtgggtgctagttatatcccatgagtggaggcagtaaatccgtacgcagacctccggtagaacgggccgattccacctatcctaccaagacgaacaacttaccgaacgaacaccgtctagtatctagacaaagtgaacagcctagagagacgngacggacgacggctagtacgtattacgtgtcgacgagagtataggatgggtcgaagttaacggg

SEQ ID NO: 230214 - DNA, 591 bp, Homo sapiens
  misc_feature: GYAE6OF01A7BVY.3.4.A04.1.454.CMB.1.raw
  modified_base (260)..(260): a, c, t, g, unknown or other
  misc_feature (260)..(260): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttcttttaagaggtgtccagtgccaggtgcagctgggtggagtcgtgggggagcgtggcccagccgtggggacggtcccaggactctcctgtacngtctctggattcaccttaggttactatgctatgcacgtggggtccgccgggctccgaggcgaaggggctgggaggtgggtggcagttatactccatgagtgggagcaagtaaactcctacgcagtacctccgtaggaacgggcctattccaccactcctaccaagacgaacctaattacccaaagaaccacgctagtactctagactaaatcgaacacgccgtagacgacgcgtacggaacggaccgacggcgttaggttagttaacgtttacgtaggtggacggtaaggaagtagtaggtaggttaggggtacgtaaggttaaaccgggg

SEQ ID NO: 230215 - DNA, 756 bp, Homo sapiens
  misc_feature: GYAE6OF01CZ3NG.3.4.A04.1.454.CMB.1.raw
tcagagacgcactccacgaccggtgctcgatttagagtagtgatcagggggatcaggactcctcagttcaccttctcacaatgaggctccctgctcagctcctggggctgctaatgctctgggtcccaggatccagtggggatgttgtgatgactcagtctccactctccctgcccgtcacccttggacacgccggcctccatcctcctgcaggtctagtcaaagcctagtatacagtgataggaaactacctacttgaattggttacagcagaggccgaggctaatcgtaccaaggccgtaccttaaagtttagtaaacggtttctaaaccgggacttccggtcgggtacccagtacagtacttcgaggcggacaggtcgggtacaggctacgtgtatttaccgaactaacgtaagaaaactcgaacggtacggtaaggggtcggaaggacgttaagggtaagggtaagttttgggtttagggggtttttaaacttacggtacggtactaacggttacggaacgtaaacgggtaaccaaccgtaaccggttacgggtaccccgttacccggtaaccgggtttcccgggaacccggtaaccgggggtaaacccgaaaaggggttaacgggtaaaaaccgtaaaccggtaaaaacccgggtaaacgttaggggtaaccggtaccgttaccgggaacctaaacccgttaacggtttcccttacgggtttacccttaaccgttaacccgtttcccccgg

SEQ ID NO: 230216 - DNA, 638 bp, Homo sapiens
  misc_feature: GYAE6OF01A73P7.3.4.A04.1.454.CMB.1.raw
  modified_base (150)..(150): a, c, t, g, unknown or other
  misc_feature (150)..(150): n is a, c, g, or t
  modified_base (170)..(170): a, c, t, g, unknown or other
  misc_feature (170)..(170): n is a, c, g, or t
  modified_base (173)..(175): a, c, t, g, unknown or other
  misc_feature (173)..(175): n is a, c, g, or t
  modified_base (177)..(177): a, c, t, g, unknown or other
  misc_feature (177)..(177): n is a, c, g, or t
  modified_base (179)..(183): a, c, t, g, unknown or other
  misc_feature (179)..(183): n is a, c, g, or t
  modified_base (185)..(185): a, c, t, g, unknown or other
  misc_feature (185)..(185): n is a, c, g, or t
  modified_base (187)..(189): a, c, t, g, unknown or other
  misc_feature (187)..(189): n is a, c, g, or t
  modified_base (192)..(194): a, c, t, g, unknown or other
  misc_feature (192)..(194): n is a, c, g, or t
  modified_base (198)..(198): a, c, t, g, unknown or other
  misc_feature (198)..(198): n is a, c, g, or t
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
  modified_base (220)..(221): a, c, t, g, unknown or other
  misc_feature (220)..(221): n is a, c, g, or t
  modified_base (225)..(225): a, c, t, g, unknown or other
  misc_feature (225)..(225): n is a, c, g, or t
  modified_base (246)..(246): a, c, t, g, unknown or other
  misc_feature (246)..(246): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcggngttcgctaggctcttagagntcnnncngnnnnngngnnnggnnngccngcnggagtccagacnctctgcnnctcngatcactgtatatgctatgcncgtggccgcgggctccaggcgaagggctggagtgggtgcgtagttatacgtccaagtgtagtaggaggacaaggtaaacttccgtaacggaccaaagtaccttccggtaggaacggggcccgtaacgtttccgaacccgtaacgtttcctacccgaacggtaaacgtaaacgtaaccgttaaccgaaaccgtaacgtacccgtacgttacgtacgttacgtacgtaacgtaacgtaacgaacgtaccgtaccgtacggtaacgtacggtacggtacggtaacgggtaaccggtaacggtacggtacggttacgttaacgttacggttacggtacggtacggtaaggtaaggtaaggtacggtagggtacgggttacggttaaggtaaacggg

SEQ ID NO: 230217 - DNA, 515 bp, Homo sapiens
  misc_feature: GYAE6OF01BMPTT.3.4.A04.1.454.CMB.1.raw
  modified_base (489)..(489): a, c, t, g, unknown or other
  misc_feature (489)..(489): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtgggggaggcgtggcccagcctgggaggtcccaggactctcctgtacagtctctggattcaccttaggttactatgctatgcactgggtccgccgggctccaggcaaggggctgggagtgggtggcagttatactccatgatggaggcagtaaactcctacgcagactccgtgaagggccgatcaccatctccagacgacaattaccaagaacacgctagtatctgacaatcgaacacgacctagagagcgtagacggacgacggcgtgtgtattagtgtgngagagtatgagtgggtgtagtaacgg

SEQ ID NO: 230218 - DNA, 771 bp, Homo sapiens
  misc_feature: GYAE6OF01EFJIJ.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgctcttttaagaggtgtccagtgccaggtgcagcgtggtggagtcgtgggggaggcgtggccccagcccgtgggacggtcccaggactctcctgtacagtctctggattcaccttaggttactatgctatgcacgtcgggtccgccgggctccgaggcgaagggctgggaggtgggtgctaggttatacgtcctagtggagtgggaaggctaaggttaaactcccgtaacggacctaaggacccgttaccggtaggaacgggtcccgtaacttcccaacctagttccctacccgaaggaaaccgaaccgtaaacttaaccccgaaacgtaaaccctaaccggtaccgttacggtttaactaccgttaacggaacctaaaacgtacggtaaaacccgacggtaccccgttaagggaaccggtaacggtaccgttacgggaaccggggtaaccgaacccgggttaccggtttaacgggtttacggtttaaaccggttttaacggttacgggttaacccgggaaccggggtaaaggtaaaccgggttaggtttaacggggtaaacgggtttccgggggttaaacgtaaaccggggttttaaaaacccgggg

SEQ ID NO: 230219 - DNA, 510 bp, Homo sapiens
  misc_feature: GYAE6OF01B7GHC.3.4.A04.1.454.CMB.1.raw
  modified_base (375)..(375): a, c, t, g, unknown or other
  misc_feature (375)..(375): n is a, c, g, or t
  modified_base (429)..(429): a, c, t, g, unknown or other
  misc_feature (429)..(429): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtgggggaggcgtggcccagcctgggagtcccaggactctcctgtacagtctctggattcaccttaggttactatgctatgcactgggtccgccgggctccaggcaaggggctgggagtggggtggcagttatatcccatgatgggagcagtaaatccagcagactcgngaggccatcacatctcagagacaattaccaagaacacgctagtactctgacaangaacagcctagagagctaggaggaccgaggctagttgtattacgtgtggcgagagtagtgagtggggtcgtaagtaacggg

SEQ ID NO: 230220 - DNA, 503 bp, Homo sapiens
  misc_feature: GYAE6OF01BWY15.3.4.A04.1.454.CMB.1.raw
  modified_base (258)..(258): a, c, t, g, unknown or other
  misc_feature (258)..(258): n is a, c, g, or t
  modified_base (403)..(403): a, c, t, g, unknown or other
  misc_feature (403)..(403): n is a, c, g, or t
  modified_base (405)..(405): a, c, t, g, unknown or other
  misc_feature (405)..(405): n is a, c, g, or t
  modified_base (419)..(419): a, c, t, g, unknown or other
  misc_feature (419)..(419): n is a, c, g, or t
  modified_base (422)..(422): a, c, t, g, unknown or other
  misc_feature (422)..(422): n is a, c, g, or t
  modified_base (438)..(438): a, c, t, g, unknown or other
  misc_feature (438)..(438): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgctcttttaagaggtgtccagtgccaggtgcagctgggtggagtcgtgggggagcgtggcccagccgtgggacggtcccaggactctcctgtacngtctctggattcaccttaggttactatgctatgcacgtgggtccgccgggctccgaggcaaggggctgggagtgggtggctagttatactccatgagtggaggcaagtaaatccagcagactccgtgacggcgatcacatctcananacatacaagacacnctntatcagacaatgaacngctgagagctagacgacgacggctgtgtattactggtcgagagagatgagtgggtagagtaacgg

SEQ ID NO: 230221 - DNA, 562 bp, Homo sapiens
  misc_feature: GYAE6OF01A8XJC.3.4.A04.1.454.CMB.1.raw
  modified_base (387)..(387): a, c, t, g, unknown or other
  misc_feature (387)..(387): n is a, c, g, or t
  modified_base (403)..(403): a, c, t, g, unknown or other
  misc_feature (403)..(403): n is a, c, g, or t
  modified_base (408)..(408): a, c, t, g, unknown or other
  misc_feature (408)..(408): n is a, c, g, or t
  modified_base (423)..(423): a, c, t, g, unknown or other
  misc_feature (423)..(423): n is a, c, g, or t
tcagagacgcactccacgaccggtgctcgatttagagtagtgatcgaggggagctctgggagacgagcccagcactggaagtcgccggtgtttccattcggtgatcatcactgaacacagaggactcaccatggagtttgggctgagctgggttttcctcgttgcttcttttaagaggtgtccagtgccaggtgcagctgggtggagtcgtgggggagcgtggcccagcctgggacgtcccaggaactctctgtacagtctctggattcaccttaggttactatgctatgcacgtcgggtccgccgggctccgaggcaagggggctgggagtgggtggctagttatactccgatgatgggagcaagtaaactccgtaagcagctcgngacgggcatcacatcncaganacaatccaagacacnctatatctagacaatcgaacagaccctagacgtacgtcgtaggacggacacgggtctaggtagttaacttacggtaggttcggacggtaaggaggtaacgttaggaaggttcggggttaacgtaaggtttaaacccggg

SEQ ID NO: 230222 - DNA, 736 bp, Homo sapiens
  misc_feature: GYAE6OF01DE755.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgctcttttaagagtgtccagtgccaggtgcagctggtggagtcgtgggggagcgtggcccagcctgggagtcccaggaactctcctgtaccagtctcgtggacttcaccttaggttactatgctatgcacgtgggtccgcgggctccgaggcgaggggctgggagtcgggtggcaggttatactccagtgaagtgggacggactaaagttaaactccgtaacggcgtaagaccgttccggtaaggaacgggtccggtaactttaccgaaccctaacttacctacccgaagtaacgtaaaccgtaaacgtttaacccgaaaacgaaaccgtaaccggtaccttacgggttaacttaccgttacgaaacctaaaacggttacgaaacccgtacggtaaccccgttagggaaacggtaacgtaccgtagggaacgggtaaaacccgtacggggtacccgtttagggttacggtttaaagtttaacccggttgggtttaccgggaccggtaaagggaaggttaacggttaaggtagggtttaacgggggttacggtaaacggttttaaaaccggggg

SEQ ID NO: 230223 - DNA, 626 bp, Homo sapiens
  misc_feature: GYAE6OF01CWAPT.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtgggggagcggtggcccaggccgtggggagtcccaggactctcctgtacagtctctggattcaccttaggttactatgctatgcacgtgggtccgccgggctccgaggcgaaggggctggagtgggtggcgagttatagtcccatgagtgggacggcaagtaaactccgtacgcacgaccgtccggtaggaacgggtccgagttaccaccgtactacctaccgaagtaacgaactaaacgttaccgaacgaaactacgtactagttactacgtacgaacaaacgttacgaaactacggtaccgtaggacgtacggactacggacggaccggtacggtcgttaggtacggtttattacggtggtacggacggtaaggaacggtagtagggtaggtacggggttagtaaggttaaaccggg

SEQ ID NO: 230224 - DNA, 601 bp, Homo sapiens
  misc_feature: GYAE6OF01DU1YT.3.4.A04.1.454.CMB.1.raw
  modified_base (424)..(424): a, c, t, g, unknown or other
  misc_feature (424)..(424): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttcttttaagaggtgtccagtgccaggtgcagctggtggagtcgtggggggagcgtggcccagccgtggggacggtcccaggactctcctgtacagtctctggattcaccttaggttactatgctatgcacgtgggtccgccgggctccgaggcgaaggggctgggagtggggtgctagttatatccatgagtgggaggcagtaaactcctacgcagactccggtaggaacgggccgattccacctatcctaccaaganaactaacttaccaagaaccacgctagtactcgtacactaaatacgaacacgaccgtgaacggacgtacgtaggaacgggaccgtacgggtaccgttaggttacggtttaaactttacggttcggttacggacggtaaggagtagtaggtagttcggggtacgtaagttaaaccgggg

SEQ ID NO: 230225 - DNA, 603 bp, Homo sapiens
  misc_feature: GYAE6OF01CCG62.3.4.A04.1.454.CMB.1.raw
  modified_base (339)..(339): a, c, t, g, unknown or other
  misc_feature (339)..(339): n is a, c, g, or t
  modified_base (350)..(350): a, c, t, g, unknown or other
  misc_feature (350)..(350): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctggagcttgggttttcctcgttgcttcttttaagaggtgtccagtgccaggtgcagctgggtggagtcgtgggggagcgtggcccagccgtgggaggtcccaggactctcctgtacagtctctggacttcacttaggttactatgctatgctacgtcgggtccgccggctccgaggcgaaggggctgggagtcgggngtcgtagttanactccagtgagtgggagactaagtaaactcctaacgcacgactcgtaggacggccgattcacctatcctaccgaagaacgtaactaaacttaccaaagaacctacgcttagtactactagaactaaatacgaaaccacggacctaggaacgacgtacgtacgaacgggacgtacggtccttaggtagttaacttaagtggtacggacgtaaggacgtagtaggtaagttacggggtagtaaacgttaaacggg

SEQ ID NO: 230226 - DNA, 684 bp, Homo sapiens
  misc_feature: GYAE6OF01CM0YB.3.4.A04.1.454.CMB.1.raw
  modified_base (265)..(265): a, c, t, g, unknown or other
  misc_feature (265)..(265): n is a, c, g, or t
  modified_base (548)..(548): a, c, t, g, unknown or other
  misc_feature (548)..(548): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcgtgggttttcctcgttgcttcttttaagaggtgtccagtgccaggtgcagctggtggagtcgtggggggagcgtggcccaggccgtggggacgtcccgaggtacctccgtcctgtacngtctcgtggtacttcctaacgtttaggttactagtgtactatcgctacggtcggggtcccgccgggtctaccggaggacggaagggggtctgggaggttggggacgtcgtaagtttactacgtccgagttgagtgggagtactaaagtaactccgtaacgacgaacgtaccgttaccggtaacgggaaccgggtaccgtacgtaccgacctacgtacctaccgtaagaacgtaaactaaacgttaaccgaaacgaaccgtaccgtacgttacgtactacgtanaaactaaacgtaacgaacgtacgtccgtaaggacgacgtacgtaggaacgaccggtacgtcgttagttacgttaacgttgtaggtcgacgaagtacgtagttaggtagggttcggtaacgtaacgtttaaacgggg

SEQ ID NO: 230227 - DNA, 577 bp, Homo sapiens
  misc_feature: GYAE6OF01DINWC.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgcttcttttaagaggtgtccagtgccaggtgcagctggtggagtcgtgggggagcgtggcccagcctggggagtcccaggaactctcctgtacagtctctggattcaccttaggttactatgctatgcacgtggggtcccgcgggcctccgaggcaagggggctgggagtggggtggctagttatactcccatgagtgggaggcaagtaaatcctacgcaagaccgtccgtaggaacgggccaattccaacctatctaccagagaacaattaccaagaacacgctagtactctagacaaagtcgaaacacgcctagagagtcgtaggaacggaaccacgggcttaggtacgtaacgtttacgtggtcggacggaaggtagagttaggtaggttcggggtacgtaaggttaaacgg

SEQ ID NO: 230228 - DNA, 710 bp, Homo sapiens
  misc_feature: GYAE6OF01ESCSM.3.4.A04.1.454.CMB.1.raw
  modified_base (258)..(258): a, c, t, g, unknown or other
  misc_feature (258)..(258): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttcttttaagaggtgtccagtgccaggtgcgagcgtggtggagtcgtgggggagcgtggcccagccgtgggacgtcccaggactctctgtacngtctctggattctaccttagttacatgactagtgctacgtcgggtccgccggctaccgaggaccggaagggcgtgggtacggtgggtaggcgtaagttactactcctaagtcgtaagtgggaaggactaaggttaaactccgtaacgccaacgacgttaccggaggaacggtccgtacttaccgacctactacctacgaaggtaacaaacgtaaccttaaccgaaacgaaccgtaccgtacttacgtaactccttaagaacctaaagtaccgaaaccgacgtacccgtaaggaacggtacgtaccggtaagggtaaccgggaacggtaccgggtacgtttaggttacgtttaaacgtttacgggttacggtacgggttaacggaaacggttaggtaaacggttagggttaaagggtttcgggggtaaacgttaaacgggtttaaaaccgggg

SEQ ID NO: 230229 - DNA, 568 bp, Homo sapiens
  misc_feature: GYAE6OF01DIBRM.3.4.A04.1.454.CMB.1.raw
tcagagacgcactccacgaccggtgctcgatttagagtagtgatcagggggagctctgggagacgagcccagcactggaagtcgccggtgtttccattcggtgatcatcactgaacacagaggactcaccatggagtttgggctgagcttgggttttcctcgttgctcttttaagaggtgtccagtgccaggtgcagctggtggagtcgtggggggagcgtggcccagcctggggaggtcccaggaacctctcctgtacagtctctggattcacctttaggttactatgctatgcacgtgggtcccgcgggctccgaggcgaaggggctgggagtggggtgcagttatatccatgatgggaggcaagtaaactcctaagcaagactccggtaggaacgggccgattccaccatctaccagagaactaaacttccaaagtaacacgactagtatctagacaaatagaacagaccgtagaaggacgcgtaggaaggaccgaacggtccgtaggtgttaatttacgtgtcggacgtaggagtagttaggagtacgggtgtaagttaaacgg

SEQ ID NO: 230230 - DNA, 691 bp, Homo sapiens
  misc_feature: GYAE6OF01AIN4N.3.4.A04.1.454.CMB.1.raw
  modified_base (180)..(180): a, c, t, g, unknown or other
  misc_feature (180)..(180): n is a, c, g, or t
  modified_base (263)..(263): a, c, t, g, unknown or other
  misc_feature (263)..(263): n is a, c, g, or t
tcagagacgcactccacgaccggtgctcgatttagagtagtgatcagggggagctctgggagacgagcccagcactggaagtcgccggtgtttccattcggtgatcatcactgaacacagaggactcaccatggagtttgggctgagcttgggttttcctcgttgctcttttaagaggtntccagtgccaggtgcagcgtgggtggagtcgtggggggagcggtggcccaggccgtggggacgtcccaggtactctctgtacngtctctggattcaccttaggttactatgtctatgctacgtcgggtccggccggctccgaggcgaaggggctgggaggtggggtggcgtagttactacgtccctagtgacgtagggagacgtaagtaaactccgtacggacgtacggtaccgtccggttaggacgggtaccgtacgttaccaacccgtacttaccgtaccgaacggaacgaacctaaacttaacccgaaacgaaacctaccgtaacgtacgttaacttaccgtagtaaaccgaaacgtaacgaaacgaccgtaccgtaggaacgaaggtaccggtacgggaacgggaaccggtacgggtcggttaacgttaggtttacgttaacggttggtaccggaccgtaggaagtaggtaggtaagggttacgggtagtaaacggtttaaacgggg

SEQ ID NO: 230231 - DNA, 595 bp, Homo sapiens
  misc_feature: GYAE6OF01CO4IK.3.4.A04.1.454.CMB.1.raw
  modified_base (332)..(332): a, c, t, g, unknown or other
  misc_feature (332)..(332): n is a, c, g, or t
  modified_base (341)..(341): a, c, t, g, unknown or other
  misc_feature (341)..(341): n is a, c, g, or t
  modified_base (420)..(420): a, c, t, g, unknown or other
  misc_feature (420)..(420): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggtttcctcgttgctctttaagaggtgtccagtgccaggtgcagctggtggagtcgtgggggagcgtggcccagccgtgggagtcccaggactctcctgtacagtctctggattcaccttaggttacatgctatgcacgtgggtccgccggtcctccgaggcgaaggggctgggacgtggggngctagttanactccaagtgagtggaggcaaggtaactcgacgcagactcgtagaacgggcatcacactctcagacgaacataccgaanacacgctagtactctagtacaagttcgaacgtacggacctagggtaacgacgtcgtacggaacggtacgaacggtccgttaggttacggttacttaaccggtcggttaacgggccggtaaaggtaggtaacgttaacggggagtttacggggtccggttaaagtttaaaccgggg

SEQ ID NO: 230232 - DNA, 529 bp, Homo sapiens
  misc_feature: GYAE6OF01DS98T.3.4.A04.1.454.CMB.1.raw
  modified_base (379)..(379): a, c, t, g, unknown or other
  misc_feature (379)..(379): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtctgggggaggcgtggcccagcctgggaggtcccaggaactctcctgtacagtctctggattcaccttaggttactatgctatgcactgggtcccgcgggctccaggcaaggggctgggagtgggtggcagttatatcccatgatggaggcaagtaaatcctagcagactccggngaacgggccgattccaccatctccagagacaattccaagaacacgctgtatctagacaaatgaacagacctagagagctggaacggaccacggtctaggttcgttattacgtggtgacggagaggtataggagtgggtcgtagttaacgg

SEQ ID NO: 230233 - DNA, 612 bp, Homo sapiens
  misc_feature: GYAE6OF01D23NY.3.4.A04.1.454.CMB.1.raw
  modified_base (464)..(464): a, c, t, g, unknown or other
  misc_feature (464)..(464): n is a, c, g, or t
tcagagacgcactccacgaccggtgctcgatttagagtagtgatcagggggagctctgggagacgagcccagcactggaagtagccggtgtttccattcggtgatcatcactgaacacagaggactcaccatggagtttgggctgagctgggttttcctcgttgcttcttttaagaggtgtccagtgccaggtgcagctgggtggagtcgtgggggagcgtggcccagcctgggagtcccaggactctcctgtacagtctctggattcaccttaggttactatgctatgcacgtgggtccgccgggctccgaggcgaaggggctgggaggtgggtgctagttatacgtccatgatggagacaagtaaatcccgtacgcacgactccggtaggaacgggccgtattccacctactctacccgaagacgaactaacttaaccgaacgaaccacgctagtactctanacaaatacgaacacgacctagaacgtagaccgtaggaacggaccgtacggtccgttaggttacgtttaacgttacgttagggtacggtaccggaaggtaaggtagttacgggtaaggttcggggttacggtaaacgtttaaaccgggg

SEQ ID NO: 230234 - DNA, 591 bp, Homo sapiens
  misc_feature: GYAE6OF01CL130.3.4.A04.1.454.CMB.1.raw
tcagagacgcactccacgaccggtgctcgatttagagtagtgatcagggggatcaggactcctcagttcaccttctcacaatgaggctccctgctcagctcctggggctgctaatgctctgggtcccaggatccagtggggatgttgtgatgactcagtctccactctccctgcccgtcacccttggacacgcccggcctccatctcctgcaggtctagtcaaagcctcgtatacagtgatggaaacacctacttagaattgttcagcagaggccaggccaatctaccaaggcgaccttaatttataacggtttcaaccggtactcgtgggtacccagacagattcgagcggcgaggtgggtcaggcacgtgtatttcactactagaaatcgagcgagggtggaggcgtaggaggtagttgggtttaggggtttaattacgtagtacgtacgtagacgtaaaggtacaacgtacgtcggacccttaccgggtaccgttccgggaccgtacgggaaccgaaggtacggaaaactacgaaacgtacgtagaggcgtacgacctaccgtatcgttacgtcttcgtacttccccg

SEQ ID NO: 230235 - DNA, 577 bp, Homo sapiens
  misc_feature: GYAE6OF01B1I8F.3.4.A04.1.454.CMB.1.raw
  modified_base (260)..(260): a, c, t, g, unknown or other
  misc_feature (260)..(260): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttcttttaagaggtgtccagtgccaggtgcagcgtgggtggagtcgtgggggaggcgtggcccagccgtgggacgtcccaggactctcctgtacngtctctggattcaccttaggttactatgctatgcacgtgggtccgccgggctccgaggcgaaggggctgggaggtggggtggctagttatactcccagtcgagtgggagcaagtaaactccgtacgcagactccgtaggaacgggcctactcacctatcctcaagacgaacaacttaccaagaacacgctagtactctagacaaatcgaaacacgaccgtaggaagacgacgtaggaacggtacacgggtctaggttacgtacgttagtggtcgacggtaagagtagtaggtagttcgggtacgtaagttaaacggg

SEQ ID NO: 230236 - DNA, 542 bp, Homo sapiens
  misc_feature: GYAE6OF01BINXA.3.4.A04.1.454.CMB.1.raw
  modified_base (175)..(175): a, c, t, g, unknown or other
  misc_feature (175)..(175): n is a, c, g, or t
  modified_base (182)..(182): a, c, t, g, unknown or other
  misc_feature (182)..(182): n is a, c, g, or t
  modified_base (188)..(188): a, c, t, g, unknown or other
  misc_feature (188)..(188): n is a, c, g, or t
  modified_base (198)..(198): a, c, t, g, unknown or other
  misc_feature (198)..(198): n is a, c, g, or t
  modified_base (203)..(203): a, c, t, g, unknown or other
  misc_feature (203)..(203): n is a, c, g, or t
  modified_base (207)..(207): a, c, t, g, unknown or other
  misc_feature (207)..(207): n is a, c, g, or t
  modified_base (240)..(240): a, c, t, g, unknown or other
  misc_feature (240)..(240): n is a, c, g, or t
  modified_base (306)..(306): a, c, t, g, unknown or other
  misc_feature (306)..(306): n is a, c, g, or t
  modified_base (324)..(324): a, c, t, g, unknown or other
  misc_feature (324)..(324): n is a, c, g, or t
  modified_base (331)..(331): a, c, t, g, unknown or other
  misc_feature (331)..(331): n is a, c, g, or t
  modified_base (333)..(333): a, c, t, g, unknown or other
  misc_feature (333)..(333): n is a, c, g, or t
  modified_base (338)..(338): a, c, t, g, unknown or other
  misc_feature (338)..(338): n is a, c, g, or t
  modified_base (389)..(389): a, c, t, g, unknown or other
  misc_feature (389)..(389): n is a, c, g, or t
  modified_base (415)..(415): a, c, t, g, unknown or other
  misc_feature (415)..(415): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcggtgtttcgcgtaggctcttaagtaggncagtgcngtgcanctgtgagtcnggggngcgngccagcctgggagtcccaggactctcctgtacngtctcgtggactttcaccttaggttactatgactatgcacgttggccgcggcctcgaggcgagggntggagtgggtgctagtancctcagngngtggngactatactcacgacacgtacgtcggagacgctactccactactcacgaanacaactaacgtacgaacgactacgtntacgtactacgtacaacaacgtaacgaacgacgacgtacgagtacgacgacgacgacgacgtacgtagttacgttacgttagtacggtcggagtagagtagtacgtaggtacggtagtaagtaacgg

SEQ ID NO: 230237 - DNA, 557 bp, Homo sapiens
  misc_feature: GYAE6OF01D0RDG.3.4.A04.1.454.CMB.1.raw
  modified_base (175)..(175): a, c, t, g, unknown or other
  misc_feature (175)..(175): n is a, c, g, or t
  modified_base (177)..(177): a, c, t, g, unknown or other
  misc_feature (177)..(177): n is a, c, g, or t
  modified_base (184)..(185): a, c, t, g, unknown or other
  misc_feature (184)..(185): n is a, c, g, or t
  modified_base (197)..(197): a, c, t, g, unknown or other
  misc_feature (197)..(197): n is a, c, g, or t
  modified_base (234)..(234): a, c, t, g, unknown or other
  misc_feature (234)..(234): n is a, c, g, or t
  modified_base (239)..(239): a, c, t, g, unknown or other
  misc_feature (239)..(239): n is a, c, g, or t
  modified_base (283)..(283): a, c, t, g, unknown or other
  misc_feature (283)..(283): n is a, c, g, or t
  modified_base (286)..(286): a, c, t, g, unknown or other
  misc_feature (286)..(286): n is a, c, g, or t
  modified_base (296)..(296): a, c, t, g, unknown or other
  misc_feature (296)..(296): n is a, c, g, or t
  modified_base (313)..(313): a, c, t, g, unknown or other
  misc_feature (313)..(313): n is a, c, g, or t
  modified_base (380)..(380): a, c, t, g, unknown or other
  misc_feature (380)..(380): n is a, c, g, or t
  modified_base (386)..(386): a, c, t, g, unknown or other
  misc_feature (386)..(386): n is a, c, g, or t
  modified_base (419)..(419): a, c, t, g, unknown or other
  misc_feature (419)..(419): n is a, c, g, or t
tcagagacgcactccacgaccggtgctcgatttagagtagtgatcagggggagctctgggagacgagcccagcactggaagtcgccggtgtttccattcggtgatcatcactgaacacagaggactcaccatggagtttgggctgagcggtgtttcgctaggctcttaagaggtncntgcagtnnagctgtgagcgnggggagcgtgccagcgtggagccaggactctctgtangtctnggtattcaccttaggttaacatgctatgcacgtggtccgcggcncgnggacagggcnggtgtgggagcaagttnacgtccatgagtgaggtacagtaaatcgaacgcaacgactcgaggaacggctacttacacctactcnccaganaacaactaccgaagaacgctagtatattcgaanacaatacgaactacgaccgtaggagacgtacgaggaaccgtaacggtacggttacgttagttaacgttacgttacggttacgtacgggacgtaggtacgtaggtacgggtaggttacggtacgtaacggttaaacggg

SEQ ID NO: 230238 - DNA, 531 bp, Homo sapiens
  misc_feature: GYAE6OF01CQSJZ.3.4.A04.1.454.CMB.1.raw
  modified_base (355)..(355): a, c, t, g, unknown or other
  misc_feature (355)..(355): n is a, c, g, or t
  modified_base (363)..(363): a, c, t, g, unknown or other
  misc_feature (363)..(363): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtgggggagcgtggcccagcctgggacgtcccaggactctcctgtacagtctctggattcaccttaggttactatgctatgcacgtgggtccgcgggctccgaggcgaaggggctgggagtgggtgcaggttatatccatgagtggagnaagtaacncctacgcagactcgtagaggccgattcaccatcctacgagacgaactaactacaagaacacgctagtactctagacaagtagaacacgacctagagacgcgtacgaaggacgacggctgtacgtattagtgtggacgagagtagtaggagtgggtgaagttaaacggg

SEQ ID NO: 230239 - DNA, 560 bp, Homo sapiens
  misc_feature: GYAE6OF01CFA6B.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttcttttaagaggtgtccagtgccaggtgcagctggtggagtcgtgggggagcgtggcccagcctgggagtcccaggactctcctgtacagtctctggattcaccttaggttactatgctatgcactgggtccgccgggctccgaggcaaggggctgggagtggggtggcagttatactcccatcgatggaggacaagtaaactcctacgcagactccgtagaacgggccgattcaccactctccagacaacaacttaccaagaacacgctagtatctgaacaatacgaaacagacctagagagcgtagacggacgacggctaggttacgttaacgttacgtaggttgaccggtaagacggtaagtagtaggtacgggtgtaacggttaaacggg

SEQ ID NO: 230240 - DNA, 513 bp, Homo sapiens
  misc_feature: GYAE6OF01DZI37.3.4.A04.1.454.CMB.1.raw
  modified_base (158)..(158): a, c, t, g, unknown or other
  misc_feature (158)..(158): n is a, c, g, or t
  modified_base (364)..(364): a, c, t, g, unknown or other
  misc_feature (364)..(364): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttccncgttgcttcttttaagaggtgtccagtgccaggtgcagctgggtggagtcgtggggggagcgtggcccagcctggggacggtcccaggaactctcctgtacagtctctggattcaccttaggttactatgctatgcactgggtccgcgggctccgaggcaaggggctggagtgggtggcagttatatccatgatggagcagtaaancctacgcagactccggtgaacgggccattcaccatctcagagaacaattccaagaccacgctgtactctgacaatagaacagcctagagacgctaggaggacacggtctgtgtattacgtggtgcgagagatggatgggtgagtaacgg

SEQ ID NO: 230241 - DNA, 572 bp, Homo sapiens
  misc_feature: GYAE6OF01B566Y.3.4.A04.1.454.CMB.1.raw
  modified_base (332)..(332): a, c, t, g, unknown or other
  misc_feature (332)..(332): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcgtggtttcgtcgtaggctctttaagaggtgtccagtgccaggtgcagctggtggagtcgtgggggaggcgtggcccagcctgggaggtcccaggactctcctgtacagtctctggattcaccttaggttactatgctatgcactgggtccgccgggctccgaggcgaaggggctggagtgggtgnaggttatatccatgatggaggcagtaatcctacgcagactcgtgaaggccgattcgacctatcaccgagaacgacaattccgaagtaacaacggtctagtaacttccgtagtaaccgaaataacgtaacaacgtaccgtacgaggtacggaccgtaggaacggaaccgacggtaccgtagtagttacgttacgtacggtggtcgaggacgtagtagtagtacggtcggtagttaaacggg

SEQ ID NO: 230242 - DNA, 616 bp, Homo sapiens
  misc_feature: GYAE6OF01DMRHP.3.4.A04.1.454.CMB.1.raw
  modified_base (178)..(178): a, c, t, g, unknown or other
  misc_feature (178)..(178): n is a, c, g, or t
  modified_base (263)..(263): a, c, t, g, unknown or other
  misc_feature (263)..(263): n is a, c, g, or t
  modified_base (294)..(294): a, c, t, g, unknown or other
  misc_feature (294)..(294): n is a, c, g, or t
tcagagacgcactccacgaccggtgctcgatttagagtagtgatcaggggagctctgggagacgagccctagcactggaagtcgccggtgtttccattcggtgatcatcactgaacacaggaggactcaccatggagtttgggctgagcttgggttttcctcgttgcttcttttaagnggtgtccagtgccaggtgacagcgtgggtggagtcgtgggggagcgtggcccaggccgtgggacgtcccaggactctcctgtacngtctgtggattcacttaggttactatgctancgcacgtcgggtaccgccggctccgaggccgaaggggctgggacggttagggtggactagttatactccgtatcgagtggaggtctaagtaactcctacgacacgtacctccggtagaacgggtccgtattaccacactcgtacacgaacgaactaacttaccgaaacgaacgtacgctagtactctagaactaagtcgaaactcgacgtaggaacgacgtacgtacggacggtaacgaccggtcgttaggttacgttacttacgtggttacgacggtaaggagtacgtaggtaggtacgggttaacgtagtttaaacgggg

SEQ ID NO: 230243 - DNA, 593 bp, Homo sapiens
  misc_feature: GYAE6OF01D9LRY.3.4.A04.1.454.CMB.1.raw
  modified_base (308)..(308): a, c, t, g, unknown or other
  misc_feature (308)..(308): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcgtggtttcgcgtaggctctttaagagttgtccagtgccaggtgcagctggtggagtcgtgggggagcgtggcccagcctgggacgtcccaggactctcctgtacagtctctggacttcacttaggttactatgctatgctacgtggtccgccgggctccgnggcgagggctggagtgggtggctaggttatactccatgagtggagcagtaaactcgtacgcacgtactcggtagaagggccgtattccacctactcctccaagacgaacgtaacttaccgaaagaacaacgtctagtactcgtacgactaaatcgaaacgacgtccgtagaacggcgtacgtaggacggaaccgtcggtacgttacgttaggttacttaccggttagtaggaccggtaaggtacggtacgttaaggtaggttgggtaaccgtagttaaaccgggg

SEQ ID NO: 230244 - DNA, 528 bp, Homo sapiens
  misc_feature: GYAE6OF01DNX7H.3.4.A04.1.454.CMB.1.raw
  modified_base (338)..(338): a, c, t, g, unknown or other
  misc_feature (338)..(338): n is a, c, g, or t
  modified_base (446)..(446): a, c, t, g, unknown or other
  misc_feature (446)..(446): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttcttttaagaggtgtccagtgccaggtgcagctggtggagtcgtgggggagcgtggcccagcctgggaggtcccaggaactctcctgtacagtctctggattcaccttaggttactatgctatgcactgggtccgccgggctccaggcaggggctggagtgggtggcagttntatccatgatggaggcaagtaaactcctacgcagactccgtgaacgggcgattcactatctaccagagaacaattacccaaagaacaccgctagtactctagactaanagaacagcctgagagctaggagaccaggcttgtgttattacggtgtgacggagagtacgtagagtggggtgtagtaaacggg

SEQ ID NO: 230245 - DNA, 589 bp, Homo sapiens
  misc_feature: GYAE6OF01CO0DV.3.4.A04.1.454.CMB.1.raw
  modified_base (158)..(158): a, c, t, g, unknown or other
  misc_feature (158)..(158): n is a, c, g, or t
  modified_base (375)..(375): a, c, t, g, unknown or other
  misc_feature (375)..(375): n is a, c, g, or t
  modified_base (388)..(388): a, c, t, g, unknown or other
  misc_feature (388)..(388): n is a, c, g, or t
  modified_base (399)..(399): a, c, t, g, unknown or other
  misc_feature (399)..(399): n is a, c, g, or t
  modified_base (402)..(402): a, c, t, g, unknown or other
  misc_feature (402)..(402): n is a, c, g, or t
  modified_base (405)..(405): a, c, t, g, unknown or other
  misc_feature (405)..(405): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttccncgttgcttcttttaagaggtgtccagtgccaggtgcagctggtggagtcgtgggggagcgtggcccagcctggggacgtcccaggacctctcctgtacagtctctggattcaccttaggttactatgctatgccacgtcggggtccgccgggctccgaggcgaaggggctgggaggtgggtggactaggttatactccatggatgggagcagtaacnctagcagactcgngaggcatcacntcncanacacatccaagaccacgtctagtatctagacaagtacgaacacggtaccgtaggaacgacggtacgtaggaacgggaccgtaccgggtacgttggttacgttagtttacccggttaggtcgggaaccgtaaggtaacggtacggttaggtaaggttcggggttacgtaaggtttaaacccgggg

SEQ ID NO: 230246 - DNA, 590 bp, Homo sapiens
  misc_feature: GYAE6OF01BBC8V.3.4.A04.1.454.CMB.1.raw
  modified_base (176)..(176): a, c, t, g, unknown or other
  misc_feature (176)..(176): n is a, c, g, or t
  modified_base (256)..(256): a, c, t, g, unknown or other
  misc_feature (256)..(256): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttcttttaagnggtgtccagtgccaggtgcagctggtggagtcgtgggggagcgtggcccagccgtgggacgtcccaggactctctgtacngtctctggattcaccttaggttactatgctatgcactgggtccgccgggctccgaggcaaggggctagggacgtggggtggcaggttatactcccgatcgatggaggcaagtaaatccgtacgcagactcgtagaagggccgtatcacctacgtctaccgagagacgtaaattaccgaagaaccacgctagtaatcctagactaaagtgtaaaccaggtaccctaggaacgacggtcgtaagggaacggacgaacgggtccttaggtcgttaactttagtggttcggaccgtaagtaggacgttaggaggttgggtacggtaaggttaaacggg

SEQ ID NO: 230247 - DNA, 570 bp, Homo sapiens
  misc_feature: GYAE6OF01CHJ3Q.3.4.A04.1.454.CMB.1.raw
  modified_base (422)..(422): a, c, t, g, unknown or other
  misc_feature (422)..(422): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttactcttttaagaggtgtccagtgccaggtgcagctggtggagtcgtggggggaggcgtggcccagccgtgggacggtcccaggaactctcctgtacagtctctggattcaccttaggttactatgctatgcacgtcgggtccgccgggctccgaggcgaaggggctgggaggtgggtggcaggttatactccatgatgggagcagtaactcctacgcagacctcggtaggaacgggccattccacctactcctaccaganactaacttaccaacgacacgtctagtactctagactaaagtcgaacacgcctagagagtcgtaggacggacgacggcttggtacgttagttacgtggtcggcggagaggtagtaggtacgtagggtcgtaagttacggttaaacgggg

SEQ ID NO: 230248 - DNA, 639 bp, Homo sapiens
  misc_feature: GYAE6OF01B4PYP.3.4.A04.1.454.CMB.1.raw
tcagagacgcactccacgaccggtgctcgatttagagtagtgatcaggggtgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaaccgggactcgtcgggtcccagacagattcagcggctaggtcgggtcaggcactgtatttcactactagaaaatcaaggcgaaggggtgggaggcgtggaaggtagttgggtttaggggttttaattacgttgacgtagtggactaagggtacaaccgtacggtcggtccctaccggtaccggttccgggtacccgaaccggggtaacccgaaacggggttaggaaaaccgttaaccgaaaaacccgggtaacgttacgggttacgggtaccctacggacctaaacccgtacgttacccttacgggtttcccttacgttaaccccg

SEQ ID NO: 230249 - DNA, 812 bp, Homo sapiens
  misc_feature: GYAE6OF01EC137.3.4.A04.1.454.CMB.1.raw
tcagagacgcactccacgaccggtgctcgatttagagtagtgatcagggggatcaggactcctcagttcaccttctcacaatgaggctccctgctcagctcctggggctgctaatgctctgggtcccaggatccagtggggatgttgtgatgactcagtctccactctccctgcccgtcacccttggacagcccggcctccatcctcctgcaggtctagtacaaagtcctacgtatacagtgatggaaaacctacctacttagtaatttggtttacagacgaggacggccaggacctaaatccgtaccgaagggccgtacctttaaagttttaacgttaaacgggttttaccgtaaaccgggtacttcggttcggggtaccccaagtaacgaagtacgttaccgaggtccggtacgtaggttggggtacaagggtcctaacgttacgtaacgttttaccaaacctaacggttaaagtaaaacgttcgaacgggtcgggtaacgggggtgggtaacggtacgtagggtaaaggggttagttttaggggttttagggggtttttaactttacgtcggtacgtagttcgaaccgtaaagggtacctaaccgaccggttaccgggacccgtttacccgggtaaccggtttacccgggaaccccgggtaaccggggaaaccggttaaaacgggtaacggtaaaacccgtaaagtaaaaccccggtaaggttagggtacggtacccgttacggaacccgtaaacccgttacgttaccccgtttacggttttacccgttactacccgtttaccccccgg

SEQ ID NO: 230250 - DNA, 647 bp, Homo sapiens
  misc_feature: GYAE6OF01D4UFE.3.4.A04.1.454.CMB.1.raw
  modified_base (260)..(260): a, c, t, g, unknown or other
  misc_feature (260)..(260): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagtcttgggttttcctcgttgcttcttttaagaggtgtccagtgccaggtgcagctgggtggagtcgtgggggagcgtggcccagccgtgggacgtcccaggaactctcctgtacngtctctggattcacttaggttactatgctatgcacgtgggtccgccgggctccgaggcgaaggggctaggaggtgggtggctaggttatacgtcccagtcgagtcgggaaggactaaggtaaactccgtaacgccgaaggaccgtaccggtagggaacgggtcccgtaattaccgacctaactccgtaccgaagaacgacgtaaacttaccgaaagtaaaccacggtacttacggtaactccgtaaggaacctaaagtacggaaacctacgaccgtaggaacggcgtacggacggacggaacgcggtacgttaggtaccgttagttacgtggtcgacggtaggtaacgtacggttggtaaaggtcggggtacgtaaggttaaacggg

SEQ ID NO: 230251 - DNA, 586 bp, Homo sapiens
  misc_feature: GYAE6OF01BYFLZ.3.4.A04.1.454.CMB.1.raw
tcagagacgcactccacgaccggtgctcgatttagagtagtgatcaggggagctctgggagacgagcccagcactggaagtcgccggtgtttccattcggtgatcatcaccgaacacagaggactcaccatggagtttgggctgagctgggttttcctcgttgctcttttaagaggtgtccagtgccaggtgcagctggtggagtcgtgggggagcgtggcccagccgtgggacggtcccaggaactctcctgtacagtctctggattcacctttaggtactatgctatgcacgtcgggtccgccgggctccgaggcgaaggggctggagtgggtgctagttatactccatgagtggagcagtaaactccgtagcagacctcggtagaacgggcctaattccacatcctacagacaactaactacccaagaaccacgtctagtactctagacaaatgaacagcctagagacgcgtaggacggacgacggtcgtaggttagttacgttaccgtgggtacggtcggaaaggtaggtacgttagggaacggttagggggtaacgtaaggtttaacgggttaaacggggg

SEQ ID NO: 230252 - DNA, 674 bp, Homo sapiens
  misc_feature: GYAE6OF01CM03U.3.4.A04.1.454.CMB.1.raw
tcagagacgcactccacgaccggtgctcgatttagagtagtgatcagggggagctctgggagacgagcccagcactggaagtcgccggtgtttccattcggtgatcatcactgaacacagaggactcaccatggagtttgggctgagcttgggttttcctcgttgcttcttttaagaggtgtccagtgccaggtgcagctgggtggagtcgtgggggagcgtcggcccagccgtggggacggtcccaggaacctctacctgtacagtctcgtggtacttctaacctttaggttactatgcttatgcacgtcgggtccgccgggctccgaggcgaaggggctgggagtggggtgcgtagttatactccagtagtagtgggaggtacaaaggttaaactccgtaacgcaaggtaccgtaccggtaggaacgggtccgtaacgttaccacctagtcctacccgaagaacgtaacctaaactttacccgaaagaaacccgtaaccgtaccgtacggttactaccgttagaacctaaaagttacgaaaccgaacgtacccgtaggaacggtacggtacgtagggtaacgggacgtaccggtacttagtaaacgttacgttacgtggttacgacggtaaggtagtacgtaggaagttcgggtaacgtaaggttaaacggg

SEQ ID NO: 230253 - DNA, 516 bp, Homo sapiens
  misc_feature: GYAE6OF01CV0ZF.3.4.A04.1.454.CMB.1.raw
  modified_base (365)..(365): a, c, t, g, unknown or other
  misc_feature (365)..(365): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgctcttttaagaggtgtccagtgccaggtgcagctggtggagtcgtggggggagcgtggcccagcctggggagtcccaggaactctcctgtacagtctctggattcaccttaggttactatgctatgcactgggtccgccgggctccgaggcaaggggctgggagtggggtggcagttatatcccatgatggagcagtaaancctagcagactccgtgaacgggccgattcaccatctccagacgacaattccaagaacacgctagtactctagacaaagtgaacagcctagagagctggaggacacggctgtgtattactggtgcgagacgatagagtgggtgagttaacgg

SEQ ID NO: 230254 - DNA, 614 bp, Homo sapiens
  misc_feature: GYAE6OF01DCGWL.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagtcttgggttttcctcgttgcttcttttaagaggtgtccagtgccaggtgcagctggtggagtcgtgggggagcgtcggcccaggccgtggggacggtcccaaggaacctctcctgtactagtctctggattcacttaggttactatgctatgctacgtcgggtccgccgggctccgacggcgaaggggcgtgggaggtgggtggcgaggttatactcccagtgatgggaggacagtaaactccgtacgacgacgtactccggtagaacggggacctattaccgacctacgtaccctccaagacgaacaacttaccgaaacgaaacaccgtacgtagtactactaggactaaacgtagaaaccagaccctaggagaacgtgacggaacggtacgaccggtcgtagttacgttacgttaagtcggtggacggtagaggtataggaagtcggggttagtaagttaaacggg

SEQ ID NO: 230255 - DNA, 509 bp, Homo sapiens
  misc_feature: GYAE6OF01C1W0H.3.4.A04.1.454.CMB.1.raw
  modified_base (347)..(347): a, c, t, g, unknown or other
  misc_feature (347)..(347): n is a, c, g, or t
  modified_base (368)..(368): a, c, t, g, unknown or other
  misc_feature (368)..(368): n is a, c, g, or t
  modified_base (431)..(431): a, c, t, g, unknown or other
  misc_feature (431)..(431): n is a, c, g, or t
  modified_base (477)..(477): a, c, t, g, unknown or other
  misc_feature (477)..(477): n is a, c, g, or t
tcagagacgcactccacgaccggtgctcgatttagagtagtgatcagggggagctctgggagacgagcccagcactggaagtcgccggtgtttccattcggtgatcatcactgaacacagaggactcaccatggagtttgggctgagcttgggttttcctcgttgcttcttttaagaggtgtccagtgccaggtgcagctgggtggagtcgtggggggagcggtggcccagccgtggggagtcccaggaactctcctgtacagtctctggattcaccttaggttactatgctatgcacgtgggtccgccgggctccgaggcaaggggctggagtgggtggcagttanatccatgatggagcaagtaancctacgcagactccgtgaacgggcattcacatcacagagacaatccaagaacacgctgtatcnacaatcgaacagcctagagagcagaggacacggctgtagtattagngtgacgagagatagagtgggcgtagttaacgg

SEQ ID NO: 230256 - DNA, 665 bp, Homo sapiens
  misc_feature: GYAE6OF01BMUL0.3.4.A04.1.454.CMB.1.raw
  modified_base (278)..(278): a, c, t, g, unknown or other
  misc_feature (278)..(278): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcgttgggtttttcctcgttgcttacgtttttaaggaggtgtccaggtcgccgagggtgcaggcgtgggtggaggtcgtggggggagcggtcggcccaggccgtggggacgtcccaggacctctccgtgtacngtctctggacttccactttaggttactagtcgtactatgcgtacgtcgggtccgccggctccgaggcgaaggggctagggaggtgggtcggactagttactacgtccagtcggagtagggacggactaaaggtaactccgtaacgacacggtacctccggtaggaacgggtccgtaacgttccaaccgtactcctaccgaagaacgtaacctaacgttaccgaacgaaccgacgtacgtagtactcgtacgaactaagtcgaactacgacgtagacgtacgcgtaggaacggaccgtacggtcgttaggtacgttaacgttagttaggtacggacgtaacggaaggttacgtacggtaaggttcgggtaacgtagggtttaaacggg

SEQ ID NO: 230257 - DNA, 792 bp, Homo sapiens
  misc_feature: GYAE6OF01CVQCC.3.4.A04.1.454.CMB.1.raw
  modified_base (309)..(309): a, c, t, g, unknown or other
  misc_feature (309)..(309): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttcttttaagaggtgtccagtgccaggtgcagctgggtggagtcgtgggggagcgtggcccagccgtgggacgtcccaggactctcctgtacagtctctggacttcaccttaggttactatgactagtcgaacgtcgggtcccnccgtagtccgtccggaaggggaacggggtcgtgggaggtggggtcggacctaacgttgaaacgccgaaggtacgtagggaaagttaggaaagtaaaactttacgtaagttggtacggtaccttcggtaggttagggaacggggggaactacgtttaccgaaccgttacgttttaccgaagtaacgaaacccgaaaccggaaccgaaaacgtaaccttacctaagtttacgtaacttaccgtacgtaaccgtaaagttacgggaacgtaaccgtacccgtacggaaccggtaaccccggaacgggtaaccgtaaccgggttcgtttaggttttttaaccgtttacgtacggttcgggtacccgggtcccggttaggggtaccgttaaacggttaacccgggtaaaaaccgttaccggggtaaccggggggtaacccgtaaaccgggggtaaaccccgttcccgggttacccgttaacccccggg

SEQ ID NO: 230258 - DNA, 553 bp, Homo sapiens
  misc_feature: GYAE6OF01AW4MJ.3.4.A04.1.454.CMB.1.raw
  modified_base (263)..(263): a, c, t, g, unknown or other
  misc_feature (263)..(263): n is a, c, g, or t
  modified_base (349)..(349): a, c, t, g, unknown or other
  misc_feature (349)..(349): n is a, c, g, or t
  modified_base (390)..(390): a, c, t, g, unknown or other
  misc_feature (390)..(390): n is a, c, g, or t
  modified_base (439)..(439): a, c, t, g, unknown or other
  misc_feature (439)..(439): n is a, c, g, or t
  modified_base (489)..(489): a, c, t, g, unknown or other
  misc_feature (489)..(489): n is a, c, g, or t
  modified_base (521)..(521): a, c, t, g, unknown or other
  misc_feature (521)..(521): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgcttcttttaagaggtgtccagtgccaggtgcagtcgtgggtggagtcgtgggggagcgtggcccagccgtggggacggtcccaggaacctctcctgtacngtctctggattcaccttaggttactatgctatgcactgggtccgccgggctccgaggcgaaggggctggagtgggtgcgtagttanactcccagtgagtggagcagtaactccgacgcagacctcgngaacgggcctattcacctatctaccagtacactaactacaacgacacgntagtatctgaacaatcgaacacggcctaggacacgacgtagacggaaccncgggtatgtagtaacttcgtggtgacgtaagngtaagtggaagtcgggtacgaagttaaccggg

SEQ ID NO: 230259 - DNA, 598 bp, Homo sapiens
  misc_feature: GYAE6OF01CF9GW.3.4.A04.1.454.CMB.1.raw
  modified_base (161)..(161): a, c, t, g, unknown or other
  misc_feature (161)..(161): n is a, c, g, or t
  modified_base (177)..(177): a, c, t, g, unknown or other
  misc_feature (177)..(177): n is a, c, g, or t
  modified_base (445)..(445): a, c, t, g, unknown or other
  misc_feature (445)..(445): n is a, c, g, or t
  modified_base (452)..(452): a, c, t, g, unknown or other
  misc_feature (452)..(452): n is a, c, g, or t
tcagagacgcactccacgaccggtgctcgatttagagtagtgatcagggggagctctgggagacgagcccagcactggaagtcgccggtgtttccattcggtgatcatcactgaacacagaggactcaaccatgggagtttgggctgagctgggttttccncgttgctcttttaagnggtgtccagtgccaggtgcagctgggtggagtcgtgggggagcgtggcccagccgtgggacgtcccaggacctctcctgtacagtctctggatcacttaggttactatgcttatgcactggggtccgccgggctccgacggcgaacggggtcctgggaggtcggggtgggcaggttatacttcccgagtcgagtggaggcaaggtaaactccgtacgcaacgacttccgaggacgggcgattccacatctccagaagacaacttcaanaacgacnctagtactctagaccctaaagtcgtaacacggtaccctagggaagtacggacgtacggaacggacggaccggtacgtagttggtaacttagtcggtggaccgtaggaggtactagggtagttacggggtacgtaagttaaaccggg

SEQ ID NO: 230260 - DNA, 773 bp, Homo sapiens
  misc_feature: GYAE6OF01ENDIJ.3.4.A04.1.454.CMB.1.raw
tcagagacgcactccacgaccggtgctcgatttagagtagtgatcagggggagctctgggagacgagcccagcactggaagtcgccggtgtttccattcggtgatcatcactgaacacagaggactcaccatggagtttgggctgagcttgggttttcctcgttgcttcttttaagaggtgtccagtgccaggtgcagcgtgggtggagtcggtgggggaggcggtcggcccgaggccgtggggacggtcccgaggaacctcgtcctgtacagtctcgtggtacttccaccttacaagttaattagtgcttatcgaccgtacggtcggggtcccgcgacgggccgtccggggacgaacggggggcccggtagggttggggtcggtacgtaaggtttagtacttacgttagtaggtaagtaaggggaaaagtaggttacgtaaacggttaaccgtacggacgtacgtaacccgttccggtacggaccggtaacggggtacctaattttactacgtacttccgtaaccgaagtacgtaacctacggttaccaacgtaaaaccgaacccttaaacccgtaattacttaccgtaagtaaacctaaaaggtaccgaaacctacgtacccgttagaaccgtaacccgtagggaacggacccgtaaccggtcttaacttaacgtttaacgttacggttaggtaacggaccgggtaaggaaccggggtaccggggtacccgggttaaccggggaacccgttaagggtccgggtacccgggg

SEQ ID NO: 230261 - DNA, 546 bp, Homo sapiens
  misc_feature: GYAE6OF01ASYT6.3.4.A04.1.454.CMB.1.raw
  modified_base (166)..(166): a, c, t, g, unknown or other
  misc_feature (166)..(166): n is a, c, g, or t
  modified_base (367)..(367): a, c, t, g, unknown or other
  misc_feature (367)..(367): n is a, c, g, or t
  modified_base (401)..(401): a, c, t, g, unknown or other
  misc_feature (401)..(401): n is a, c, g, or t
  modified_base (427)..(427): a, c, t, g, unknown or other
  misc_feature (427)..(427): n is a, c, g, or t
  modified_base (450)..(450): a, c, t, g, unknown or other
  misc_feature (450)..(450): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctnttttaagaggtgtccagtgccaggtgcagctggtggagtctggggggagcgtggcccagccgtgggacggtcccaggaactctcctgtacagtctctggattcaccttaggttactatgctatgcacgtgggtccgccgggctccaggcaaggggctgggagtggggtggcagttatactccatgatgggaggcagtaaanccgtacgcagctccgtgaacgggcctattcaccntcctcagacgacaactaccaagaacncgctagtatctgacaatcgaacncgacctgagtgcgtagaggacgacggcgttaggtagttattacgttggtggaccggaggaacgtagtggaaggttcggggtacgtaagttaacggg

SEQ ID NO: 230262 - DNA, 568 bp, Homo sapiens
  misc_feature: GYAE6OF01D7RZL.3.4.A04.1.454.CMB.1.raw
tcagagacgcactccacgaccggtgctcgatttagagtagtgatcagggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtgggggagcgtggcccagcctggggacgtcccaggaactctcctgtacagtctctggattcaccttaggttactatgctatgctacgtcggggtcccgccgggctccgaggcgaaggggctgggaggtgggtggctagttatactccagtcgagtgggaggctaagtaaactcctacgcagactcggaggaacggccgattcacctactcctacgaagacgaactaacttaccaagaaccacgtctagtactctagactaaagtcgaacacgacctagagacgcgtaggacggacgacggtctagttgtaacttacgtggtcgacgagagtagtaggtaggtcgggtagtagttaacggg

SEQ ID NO: 230263 - DNA, 523 bp, Homo sapiens
  misc_feature: GYAE6OF01E4XG2.3.4.A04.1.454.CMB.1.raw
  modified_base (399)..(399): a, c, t, g, unknown or other
  misc_feature (399)..(399): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgctcttttaagaggtgtccagtgccaggtgcagctggtggagtcgtgggggaggcgtggcccagccgtggggacggtcccaggactctcctgtacagtctctggattcaccttaggttactatgctatgcactgggtccgccgggctccaggcaaggggctgggagtgggtggcagttatatcccatgatggagcagtaaatcctagcagactccgtgaagggccattcaccatcncagagacaattccaagacacgctagtatctagcaaagtcgaacaggccctagagagcgtgaggacacggtctgtagtattagtggttcgcggaagagtatggaagtgggtacgtagtaaacggg

SEQ ID NO: 230264 - DNA, 612 bp, Homo sapiens
  misc_feature: GYAE6OF01CRNEZ.3.4.A04.1.454.CMB.1.raw
  modified_base (156)..(156): a, c, t, g, unknown or other
  misc_feature (156)..(156): n is a, c, g, or t
  modified_base (175)..(175): a, c, t, g, unknown or other
  misc_feature (175)..(175): n is a, c, g, or t
  modified_base (252)..(252): a, c, t, g, unknown or other
  misc_feature (252)..(252): n is a, c, g, or t
  modified_base (504)..(504): a, c, t, g, unknown or other
  misc_feature (504)..(504): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcgtggtttcncgttgctctttaagaggtntccagtgccaggtgcagcgtggtggagtcgtgggggagcgtggcccagccgtgggacgtccaggactctcctgtacngtctctggacttctacttaggttactatcgctatcgctacgtcgggtcccgcgggcctccggaggcgaaggggctgggacggttggggtcggactaggttactacgttacccagtacggagtagggacggtactaaaggttaaactcccgtaacgcgtaacgaccgtccggtaggacggtccgtacttaccgacctactaccgtaccgaagacgtaactaactaccgaacgaacacgtctacgtactcgtanacgtaagtacgaactacgacgtagagacgtacgtaggacgacgcggtacgtgtacgttactagtggtacgacgagaggtagtaggtaggtcggtacgtagttaacggg

SEQ ID NO: 230265 - DNA, 612 bp, Homo sapiens
  misc_feature: GYAE6OF01EHSVI.3.4.A04.1.454.CMB.1.raw
  modified_base (158)..(158): a, c, t, g, unknown or other
  misc_feature (158)..(158): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttccncgttgcttcttttaagaggtgtccagtgccaggtgcagcgtggtggagtcgtgggggagcgtggcccagccgtgggacggtccccaggactctacctgtacagtctctggattcaccttaggttactatgctatgcacgtgggtccgccgggctccgaggcgaaggggctgggagtgggtggcgtagttatatcccaatgagtgggaggacaagtaaactccgtacgcaagactaccggtgaagggtccgattacaccatctaccagacgacaatccaagacacgctgtatcgtacgactaagtacgaaactacggacccgtaggaacggacgtacgtagggtaaccggaaccggtaacccgggtcggttaaccggttagggttaactttacggttaggtcggaacggtaggaacggtgttacggtaggttcgggtacgtaaggttaaaccggg

SEQ ID NO: 230266 - DNA, 637 bp, Homo sapiens
  misc_feature: GYAE6OF01DCPHD.3.4.A04.1.454.CMB.1.raw
  modified_base (193)..(193): a, c, t, g, unknown or other
  misc_feature (193)..(193): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatgggagtttgggctgagcgttgggtttcctcgttgcttctttaagaggtgtcagtgccaggtncagcgtggtggagtcgtgggggagcgtcggcccagccgtgggacggtcccaggaacctctcctgtaccagtctctggtattctaccttaggttactagtgctatgctacgtcgggtccgcggctccgaggcgaaggggctggaggtgggtgctaagttatactaccagtgagtgggaaggactaaggtaaactcctaggcctaacgtaccgttcggtaggaacgggtccgtaattaccgaccctagttccaccgtaaggaacgtaaactaaacgttacccgaaacgtaaccgtaccggtaccttggtaaaccttcgtagaacctaaagtacgaaacccgtacgtacccgtaggaacgacgttcgacggaacggacgacggtcgtgttacgtactagtggtacgacgtagacgtgtaaggtgtacgggtactaaggttaaacggg

SEQ ID NO: 230267 - DNA, 615 bp, Homo sapiens
  misc_feature: GYAE6OF01BBDZG.3.4.A04.1.454.CMB.1.raw
  modified_base (261)..(261): a, c, t, g, unknown or other
  misc_feature (261)..(261): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttcttttaagaggtgtccagtgccaggtgcagctggtggagtcgtgggggagcgtggcccagccgtggggacggtcccaggactctcctgtaaacngtctctggtattccaccttaggttactatgctatgctacgtggggtccgccgggctccgagggtcgaaggggtctgggaggtgggtggctaggtttatactccgatggatgggagcaagtaaactcctagcagtacctccggtaggaacgggtccagttccaacccgtatcctaccaagacgaactaacttacccaaagacacgctagtatctagactaaatacgaacgacaccgtagaagagtacgtaggacggtaaccgacggtactggttagttaacttaggttggtaacggaccggaaaggtacggtagtacgggttagggtacgggttaacggtaagtttaaaccgggg

SEQ ID NO: 230268 - DNA, 777 bp, Homo sapiens
  misc_feature: GYAE6OF01BR7I6.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggtagtttgggctgagtcgttgggttttcctcgttgcttacttttaagaggtgtccagtgccgaggtgcagtcgtgggtggaggtcggtggggggaggtcggtcggccccgaggtcccggtaggggacggtaccccgaaggaaccttcgtccgtgtacagttcctcgtacggtactttaccgtaccgttttaaggttacctagttgtcttaagtcgaccgtacgtcgggggttcccggcccggggtccttccggacgggacgaaggggcgttgggaggtggggtgacgtagtttaatacgtccagtagagtgggaacgtactaaagtaaacgttcccgtaacggacgaacgtacccgttaccgggtaaaggaaccgggggtaccctaacgtttacccaacccgttacgttaccgtacccgtaaggaaccgtaactaaacctttaccgaaacgtaaccgtaccggacgttacgtaccttacgtaacgaaacgtaacgtaacggaaacctaccggcgttaaggaacgtacggacgtaccgaaggtaccggtagtccggttaaggttagtaaacctttggacggttcggaacgtagtaaacggtagtacggttaaggttacggggtaacgttaaggtttaaaccggggg

SEQ ID NO: 230269 - DNA, 723 bp, Homo sapiens
  misc_feature: GYAE6OF01BXMGB.3.4.A04.1.454.CMB.1.raw
  modified_base (474)..(474): a, c, t, g, unknown or other
  misc_feature (474)..(474): n is a, c, g, or t
tcagagacgcactccacgaccggtgctcgatttagagtagtgatcagggggatcaggactcctcagttcaccttctcacaatgaggctccctgctcagctcctggggctgctaatgctctgggtcccaggatccagtggggatgttgtgatgactcagtctccactctccctcgcccgtcacccgttggacacgcccggcctccatcctcctgcaggtctagtacaaacgcctcgtatacgaggtgaagtacggaaaacctacccttacttagtaagtttggtttccagtcaggacggccgaggcccaatcgtaccgaagggccgtacccttaaattttacgtaaacggttttccgtaaacccggggtaccgtcgttacgggggtccctaaggaccaggtacttcgacggcggcacggttgggccgaggcacgtgtatttcactactgaagtaagttagcgtaggggtggaggntggaggtagttgggttagggttatttttaagttcgtagtctagttcgaaccgtaaggtcctaacgtaccgtaccggttccgggtaacccgtttaacgttaccggttttacgggacccgggtaaacgggggtaaccctaaacgggtacggtaacggggtaactaacggttaaaccgtaaaaccggtaaccgggttggttaccgggtaaccgttacgggaaccctaacccgtgtttcccggtttaacccgg

SEQ ID NO: 230270 - DNA, 609 bp, Homo sapiens
  misc_feature: GYAE6OF01DFMKB.3.4.A04.1.454.CMB.1.raw
  modified_base (267)..(267): a, c, t, g, unknown or other
  misc_feature (267)..(267): n is a, c, g, or t
  modified_base (420)..(420): a, c, t, g, unknown or other
  misc_feature (420)..(420): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagtcttgggttttcctcgttgtcttacttttaagaggtgtccagtcgccaggtgcagctgggtggagtcgtgggggagcgtggccaggccgtggggacggtcccaggaacctctcctgtaccngtctcgtggattcaccttaggttactatgctatgcacgtcgggtcccgccgggtcctccgaggcgaaggggctgggaggtggggtggtacagttatactccatgagtggagacaagtaaactcacgcagtactcgtaggacgcgatcacatcnccaagacgaacaataccaaacgacacgtctagtaactctagaacctaaagtcgaaacgcgacccgtagaaacggtagacgtagggaacggtaccgaacggtccgttagttacggtactttaacgttggtacggacggaaagtacggtaacgttagggaagttccggggtaaactaaggtttaaaccggg

SEQ ID NO: 230271 - DNA, 675 bp, Homo sapiens
  misc_feature: GYAE6OF01DV3N4.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttcttttaagaggtgtccagtgccaggtgcagctggtggagtcgtgggggaggcgtggcccagcctgggacggtcccaggaacctctcctgtacagtctctggattcaccttaggttactatgctaatgctacgtcgggtccgccgggcctccgaggcgaaggggctgggaggtgggtgcgtagttatactccatgagtgggacgactaagtaaactcctaacgcaagtaccgtccggtaggaaacgggtcctaattccgaacctactccgtaccaaggaacgaaacctaaacttacccgaaagaaacctaccgtaccttaggttaacttacgtacgaacctaaaagttacgaaaccgtaacggtacccgttaggaacggacggtaccgtagggaacggtaaccgaaccgggtcttagggttacgttaacgtttaacggttcggttcggaccggtaaggaacgtaacggttaggtaagggttacggggtacggtaagtttaaaaccgggg

SEQ ID NO: 230272 - DNA, 583 bp, Homo sapiens
  misc_feature: GYAE6OF01A42OF.3.4.A04.1.454.CMB.1.raw
  modified_base (260)..(260): a, c, t, g, unknown or other
  misc_feature (260)..(260): n is a, c, g, or t
  modified_base (348)..(348): a, c, t, g, unknown or other
  misc_feature (348)..(348): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagtcttgggttttcctcgttgcttcttttaagaggtgtccagtgccaggtgcagctggtggagtcgtgggggagcgtcggcccagccgtgggacggtcccaggactctcctgtacngtctctggattcaccttaggttactatgctatgcacgtgggtccgccggctccgaggcaagggggctgggagtggggtggctagttanactcccatcgatgggagcaagtaaactccgtacgcagactccggaggaacgggccagttccaccatcctacagacgaacattaaccaagaacacgctacgtactctagactaaatcgaaacgacgtacctaggaagagtacgtaggaacggaccacgggaccttgggtacgttacttacgtggtcgaggtaacgaggtaagtggtaaggttcgggtacgtaagtttaaaccgggg

SEQ ID NO: 230273 - DNA, 583 bp, Homo sapiens
  misc_feature: GYAE6OF01B6WU9.3.4.A04.1.454.CMB.1.raw
  modified_base (261)..(261): a, c, t, g, unknown or other
  misc_feature (261)..(261): n is a, c, g, or t
  modified_base (372)..(372): a, c, t, g, unknown or other
  misc_feature (372)..(372): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttcttttaagaggtgtccagtgccaggtgcagctgggtggagtcgtggggggagcgtggcccaggccgtggggacgtcccaggactctcctgtacngtctctggattcaccttaggttactatgctatgcacgtgggtccgccgggctccgaggcgaaggggctgggaggtggggtggctagttatatacccgatggatgggacggnaagtaaactcctaacgcaagtaccgtcggaggaacgggaccgtacgttaccacctacgtcctaccagaacgaccaattacccaaagaaccacgtctagtactctagaaccaaatacgaacacgctagagagcgtaggaacgcgacggctaggtgtaacgttagtaggtcggacgaaggacgtagtgtaggtcgggtagtaagttaaacggg

SEQ ID NO: 230274 - DNA, 596 bp, Homo sapiens
  misc_feature: GYAE6OF01BS5FO.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtgggggagcgtggcccagccgtggggacgtcccaggaactctcctgtacagtctctggattcaccttaggttacctatgctatgcacgtggggtccgccgggctccgaggcaaggggctgggagtgggtggctagttatactccatgatgggaggacaagttaaacgtccctaacgcaacgaccgtccggtacggaacggggtcccgtattaccaaccctatcctacccgaagaacgactaaacttccgaaacgaaccgaacgtctacgtactcgtagacaaagtcgaaacacgcctagagacgcgtacgacggacgacggtcgtagttagttacttacgtggtacggcgtaagacgtagtggtagttcgggtacgtaagttaaacggg

SEQ ID NO: 230275 - DNA, 612 bp, Homo sapiens
  misc_feature: GYAE6OF01BSXV1.3.4.A04.1.454.CMB.1.raw
  modified_base (258)..(258): a, c, t, g, unknown or other
  misc_feature (258)..(258): n is a, c, g, or t
tcagagacgcactccacgaccggtgctcgatttagagtagtgatcagggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctgggtggagtcgtgggggagcgtggcccagccgtgggacggtcccaggactctcctgtacngtctctggattcaccttaggttactatgctatgcacgtcgggtccgccgggctccgaggcgaaggggctgggagtggggtggctagttatactccatgatgggagcaagtaaactcctacgcacgactcccggtaggaacgggtcccgtattacccacctactacctaccgaagtaacgaactaaattacccgaaagaaccacgtctagtactcgtagtacaaacgtcgaaactacgctaggagacgacgtagacgggtaaccacgggtcgttaggttcgttaaacgttacgtgggtgacgggaaggtaacgtaaggtaggtaacggttaggggtacgtaagtttaaacggggg

SEQ ID NO: 230276 - DNA, 583 bp, Homo sapiens
  misc_feature: GYAE6OF01ER1I8.3.4.A04.1.454.CMB.1.raw
  modified_base (256)..(256): a, c, t, g, unknown or other
  misc_feature (256)..(256): n is a, c, g, or t
  modified_base (489)..(489): a, c, t, g, unknown or other
  misc_feature (489)..(489): n is a, c, g, or t
tcagagacgcactccacgaccggtgctcgatttagagtagtgatcaggggagctctgggagacgagcccagcactggaagtcgccggtgtttccattcggtgatcatcactgaacacagagactcaccatggagtttgggctgagctgggttttcctcgttgcttcttttaagaggtgtccagtgccaggtgcagctggtggagtcgtgggggagcgtggcccagccgtgggacggtcccaggactctcctgtacngtctctggattcacctttaggttactatgctatgctacgtgggtccgccgggctccgaggcgaaggggctgggagtgggtggctagttatctcccagtgagtggagcaagtaaactccgtaagcagtaccgtcggtaggaacgggtcccgattccaacctcgtacctaccgagaacgtaacaacttacccgaaacgaaccgtaccgcttagtactcgtagacaaatcgaaacncgacctagacgtagacgtagacggacgacggtgtgttacgtagtttacgtggtcgacggagtacgtagtaggagtcgggttacaggtttaacgg

SEQ ID NO: 230277 - DNA, 668 bp, Homo sapiens
  misc_feature: GYAE6OF01ENHXC.3.4.A04.1.454.CMB.1.raw
  modified_base (271)..(271): a, c, t, g, unknown or other
  misc_feature (271)..(271): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagtcttgggttttcctcgttgcttacttttaaggaggttgtccagtcgccgaggtgcagcgtgggtggagtcgtggggggaggcggtcggcccaggccgtgggacggtcccaggactctcctgtacngtctctggattcaccttagtactatgctatgctacgtgggtccggccgggtctaccgaggccgaaggggctgggaggtgggtgcgtagttactactccgatggagtgggaaggactaagtaaacgtccgtacgacgacgtacgtccggtaagggaacgggccctagttaccaaccctatcctaccaaggaccgtaacgtaacttaacccgaaagaacctacgaccgttagtactctacgaactaaatacgaaactacgtacgtacgaaggtacgcgtacgggaacgggaaccgtacgggtacgttacggttagtttaaacgtttacggttcggtacggacggtaaggtaaaggtagtacgggttaagggttcggggtacgtaaaggtttaaacgggg

SEQ ID NO: 230278 - DNA, 585 bp, Homo sapiens
  misc_feature: GYAE6OF01BWTHE.3.4.A04.1.454.CMB.1.raw
  modified_base (53)..(53): a, c, t, g, unknown or other
  misc_feature (53)..(53): n is a, c, g, or t
  modified_base (260)..(260): a, c, t, g, unknown or other
  misc_feature (260)..(260): n is a, c, g, or t
tcagagacgcactccacgaccggtgctcgatttagagtagtgatcaggggganctctgggagacgagcccagcactggaagtcgccggtgtttccattcggtgatcatcactgaacacagaggactcaccatggagtttgggctgagcttgggttttcctcgttgcttcttttaagaggtgtccagtgccaggtgcagctgggtggagtcgtgggggagcgtggcccaggcctgggacggtcccaggactctcctgtacngtctctggattcaccttaggttactatgctatgcacgtgggtccgccgggctccgaggcgaaggggctgggagtggggtgcagtttatactcccatgagtgggaggcagtaaactcctacgcagactccgtggaacggccgatcaccatcctcagagactaattaccaagaccacgctgtactctgacaatacgaacacgacctaggaacgacgacgtaggaacggaccgacgggccttaggttagttacgtttaccgtggttacggacggaaaggtacggtagttagggtaaggtttggggtaccgtaaaggtttaaaccgggg

SEQ ID NO: 230279 - DNA, 747 bp, Homo sapiens
  misc_feature: GYAE6OF01ECW3I.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagtcgttgggtttttcctcgttgtcttacgttttaaggaggttcgtccgagtcgccgaggtgcgagtcgtgggtggaggtcggtgggggaggcgtcggcccaggccgtgggacgtcccgaggtacctctcgtagtactacgtctcgtggtacttaccgtaccgtttaggttaactagtcgtactagtcgaccgtacggtcggggtcccggcccgggtacctcccggagggtaccgaacgggggtcgtgggtagggttggggtaggtccgttaaggttacttaccgttcccgaagttcggtaacggtaggggaacggtactaaacggttaaacgtcccgtaacgaccgtaacgtaccgtaccggtaggaacgggtaccgtacgtacccaccctatacccgacgtaacgacgtaactaactaaccgaacgaaccgtacgtactagtacgtctacgaactaagtacgaacacgtaccgtaggtaggtaggtacggaacggacgtacggtcgttggttaacgttacgttacggtaggtacggagacgggtaagtaggttacggtaacgggtagggttaacgttaaaggttaacgggtttaaacgggg

SEQ ID NO: 230280 - DNA, 652 bp, Homo sapiens
  misc_feature: GYAE6OF01B14Q9.3.4.A04.1.454.CMB.1.raw
  modified_base (176)..(176): a, c, t, g, unknown or other
  misc_feature (176)..(176): n is a, c, g, or t
  modified_base (258)..(258): a, c, t, g, unknown or other
  misc_feature (258)..(258): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttcttttaagnggtgtccagtgccaggtgcagctgggtggagtcgtgggggagcgtggcccagccgtgggacgtcccaggactctcctgtacngtctctggattcacttaggttactatgctatgctacgtgggtccgccggtctccgaggcgaaggggctgggaggtgggtgacgtagttatactcccagtgagtgggaaggctaagtaaaactccgtaacgctaacggacctaccggtaggaacgggtccgtacgtttaccgaacctacttccgtaccgaagtaacgaactaaacttacccgaaagtaacctaaccgtacgttacgttaagttccgtagaacctaaaagtacggaaaccctacggacccttaggaacgacgtacgtaggaacggaacgacggtcgttaggttagtaacttacgtaggtcggacggtaagtaaggtagtaggtaaggtttacggggtacgttaaggttaaaacggg

SEQ ID NO: 230281 - DNA, 781 bp, Homo sapiens
  misc_feature: GYAE6OF01DAAR2.3.4.A04.1.454.CMB.1.raw
tcagagacgcactccacgaccggtgctcgatttagagtagtgatcagggggatcaggactcctcagttcaccttctcacaatgaggcctccctgctcagctcctggggctgctaatgctctgggtcccaggatccaggtggggatgttgtgatgactcagtcctccactcctccctcgcccgtcctacccgttggaccacggcccggcctccatcctcctgctaggtctagtacaaacgtccttagtatacgaggtgaacgtacggaaaacctaccttacttagtaagtttcggttacagacgaggacggaccgtaggacctaactccgtaccgaacggtcccgttaacctttaaagtttaacggttaaccggttttacccggtaaacccgggtaccgtttcccggttacgggggtaccccctaaaggaccgtaaggttacgttacggacgggccgggtacgtaggggtcggggttaccgacggtactaacgttacggttaactttaccgaacgtaaactaagtaaacgtacgaacggcggtaaggggtcgggacgtacgtagggtagggttagtttggggttttagggtttaacttgtagtactaggtcgaacgtaagaccgtacgacggtccggacccgttaccgggtacccggttaccgggaacccgtaccgggggaacctaacggtaacggaaaacccgtacgaaaaccggtacggttcgggacgtcgaccgaccgttaccgtacttaccgttacgttccctctacccgtttccccg

SEQ ID NO: 230282 - DNA, 809 bp, Homo sapiens
  misc_feature: GYAE6OF01AUR0W.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagtcgttgggttttcctcgttgccttacttttaaggaggtgtccagtcgccaggtgcagctgggtggacgtcgtgggggagcggtcggcccaggccgtggggacgtcccgaggaccttctcctgactgtctctggtattcctaccgttaggttacatcgctagtcgcgacgtcgggtccccgccgggtctaccggagggacgaagggggtctaggggtagtcggggttcgacgtagtttactacgtcccgagtcggagtcgggaacgtacgtaaacgtaaccttccgaacgtcgacgtaaccgtaccgggtaggaaccgggttacctaacgttaccgaacccgtagtaccccgtaaccgaaacggtaaaccgtaaaccttaaaccggttaacccgaaaccgtaaacccgtacgtacccgtttaagttaccgttaacgtaaccggaaacttaaaacgtaccgtaaaaccggtaccggtaacccgttaagggaaccgtaacggttaccggttaaaccgggaagggttaacccacggggtttacccgtagggtttaaacccgttaacgtttacccggtaggggttaccgaaaccgggtaagtaacggttaacggttaacgggaagggtttacccgggttaaaccggtaaacgttttaaaacccggggg

SEQ ID NO: 230283 - DNA, 729 bp, Homo sapiens
  misc_feature: GYAE6OF01CDYC1.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgcttcttttaagaggtgtccagtgccaggtgcagctggtggagtcgtgggggagcgtcggcccagccgtgggacggtcccaggactctcctgtacagtctctggattcaccttaggttactatgctatgcacgtcggggtcccgccgggtctccgaggcgaaggggctgggaggtggggtggacgtagtttactactcccatcgagtgggaggacaagtaaacgtcctaacggccaacgacttcccggtaggaacgggcccgtaacttcccgaaaccctacgttcccgtaccaaggtaacgaacctaaacgttacccgaaaacggtaaacccaccggtaccgttagttaacttccgtacgaaaccgtaaaagttaccggaaaccgtaccggtacccgttaaggaaccgggtaacggtccgttaagggaaaccgggtaccgtaaccggggtcctttagggttaccggtttaacttttaaccgggtagggtaacggtacccgggaaagggtaacgggtacgttagggtaacgggtttcggggtaacccgtaaaggtttaaaacccgggg

SEQ ID NO: 230284 - DNA, 663 bp, Homo sapiens
  misc_feature: GYAE6OF01B3G7F.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttggggttttcctcgttgcttcttttaagaggtgtccagtgccaggtgcagctggtggagtcgtgggggagcgtggcccagccgtggggacgtcccaggaactctcctgtacagtctctggattccaccttaggttactatgtctatgcacgtgggtcccggccgggctccgaggcgaaggggctgggaggtggggtggcgagttatactcccatggagtgggaggacaacgttaaactccgtacgcgtacgaccgtccggtaggaacgggtccgtaattccacctacgtccaccaagaacgaactaactaccgaaacgaacacgtctagtactcgtacgactaaatcgaacacgaccgtaggaacgtacggacgtacgggaacggtaaccggaccgggtaccttagggttaacgtttaacgtttaacggttacggttacgggtacggtaaacgggtaggtaacggttagggaacggtttacgggggtaaaccgttaacgggtttaaaaccggggg

SEQ ID NO: 230285 - DNA, 768 bp, Homo sapiens
  misc_feature: GYAE6OF01CB5CU.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagtctgggttttcctcgttgcttcttttaagaggtgtccagtgccaggtgcagcgtggtggagtcgtgggggagcgtcggcccagccgtggggacgtcccaggtaacctctcctgtacagtctcgtggtacttaccgtaaccgtttaggtttaactagttgtacttagtcgtccgtacggttcggggtcccggtcccggggtcctaccggacgggaccgggtaacgggggtccgttaggggtacgggttgggggtacgggtacgtaagtttaacgtaccgtaccccgtagttaggtaaggtacggggtaaggtaccgtaaaacggttaaaaccgtacccgttaaccggaccgtaacggtacccggttaccgggtacggggaaccgggtaccggtaactttacccgacctacgtaccctaccgaaggtaacgaacgtaaccttaaccgaaacgaaccgtaacgtcgtacgtactacgtacgaactaacgtacgaacacgaccgtagacgtacgacgtaggaacggaccggtacggtcgttacggttacgttacgttacggttcggtaggacggtaaggacgtaaggtacggttaagggttcgggtacggttaacgttaaacgggg

SEQ ID NO: 230286 - DNA, 639 bp, Homo sapiens
  misc_feature: GYAE6OF01EJZUY.3.4.A04.1.454.CMB.1.raw
tcagagacgcactccacgaccggtgctcgatttagagtagtgatcagggggatcaggactcctcagttcaccttctcacaatgaggctccctgctcagctcctggggctgctaatgctctgggtcccaggatccagtggggatgttgtgatgactcagtctccactctccctgcccgtcacccttggacagcccggcctccatctcctgcaggtctagtcaaagtcctcgtatacagtgagtaggaaactaccttacttagtaattggtttacagtcaggacggccgaggaccaatcctaccgaaggccgtaccttaaattttagttaacggtttacgtaaccgggtacttcgtcggggtacccaggacagtattcgaggcggcaggtgggtcaggcagtgactttcaactactaagaaatcgagcgaaggggtggaggcgtaggagggtagtttagggtttaggggtttaacttacgtcgtagtagtacgaacgtaacggtacacgtacgtcggcccgttaccggtaccggttcccgggaccggtaaccgggaaccgtaagggtaacggaaacgtaccgaaacgtacggtggtacggctacgacctaaccgtattacgtgttcttactcgttaccccg

SEQ ID NO: 230287 - DNA, 748 bp, Homo sapiens
  misc_feature: GYAE6OF01CY8MB.3.4.A04.1.454.CMB.1.raw
  modified_base (326)..(326): a, c, t, g, unknown or other
  misc_feature (326)..(326): n is a, c, g, or t
  modified_base (615)..(615): a, c, t, g, unknown or other
  misc_feature (615)..(615): n is a, c, g, or t
tcagagacgcactccacgaccggtgctcgatttagagtagtgatcagggggagctctgggagacgagcccagcactggaagtcgccggtgtttccattcggtgatcatcactgaacacagaggactcaccatggtagtttgggctgagtcgttgggttttcctcgtttgtcctttacgtttttaaggaggttcgtccgagttcgaccgagggttcgacgaggtcgttgggtggacggttcggtggggggaggccggttcgggccccgtaggcccggttagggggaccggttccccgaacgggtaaccttccgtaccgttgtaaccngttcctcgtaggtacttctaaccgtttaggttactagtgtactagtcgcgtacggtccggggcccgccggtccgtcgacggacggtaaggggtcgtagggagggttgggtaggtcgtaagttactacgtacctagtacgaggtaggacggtagtaaacgttaacgtaccgtacgacgtaacggtaccggtcggtacggaacgggtccttaacgttaccgaacctacgtaccgaacgaacgtaacgtaaactaacgtaaccgaacgtaaccgacgtcgtatacgtcgtanaacgtaagtacgaactaccggtactaggaacgtacggtacgacggtacggacggtacgtcgttagttaacggtattcggaggtacggacggaagtgaacgttaggaggttacggtacggttaaagttaacggg

SEQ ID NO: 230288 - DNA, 616 bp, Homo sapiens
  misc_feature: GYAE6OF01A7I3R.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtggagtcgtgggggagcgtggcccagccgtgggacgtcccaggactctcctgtacagtctctggattcacctttaggttactatgctatgcacgtcgggtccgccgggctccgaggcgaaggggctgggagtgggtgctagttatactccatcgagtggagcaacgtaaactccgtaacgcaagtacgtccgtagggaacgggtcctaacttccaacccgtactcctaccgaagaacgaactaacgttacccaaagaaccaacgtctagtactactacgaacctaaagtcgaaacacggtacccgtaggaacggacgacgtaggaaccggtacgaccgggtacttaggttagttatttaccggtggtacggacggagaggtacgtaggtaggttcgggtacgtaagttaaacggg

SEQ ID NO: 230289 - DNA, 633 bp, Homo sapiens
  misc_feature: GYAE6OF01DL8YH.3.4.A04.1.454.CMB.1.raw
  modified_base (475)..(475): a, c, t, g, unknown or other
  misc_feature (475)..(475): n is a, c, g, or t
tcagagacgcactccacgaccggtgctcgatttagagtagtgatcagggggagctctgggagacgagcccagcactggaagtcgccggtgtttccattcggtgatcatcactgaacacagaggactcaccatggagtttgggctgagctgggttttcctcgttgcttctttaagaggtgtccagtgccaggtgcagctggtggagtcgtggggggaggcgtcggcccaggccgtggggacggtcccgaagggaactctcctgtacagtctctggacttcaccttaggttactatgctatgcacgtgggtccgcgggctccgaggcgaagggggctgggaggtgggtggctaggttatactccgatgagtaggacggtacaaaggttaaactccgtaacgcacggtactccggtaggaacgggtccgtattaccacctatcctaccaagacgaactaactaccaaagaactaccgntagtactcgacgactaaatacgaactacgctaggaaggacgtacgtacgggaacggaccggtacgggtccgttaggtaggtaacgttttaaggtgggtaggaccggaggtaaacggtagttacgggagtttacggggtacgttagttaaaaccggggg

SEQ ID NO: 230290 - DNA, 650 bp, Homo sapiens
  misc_feature: GYAE6OF01C5V0Z.3.4.A04.1.454.CMB.1.raw
  modified_base (353)..(353): a, c, t, g, unknown or other
  misc_feature (353)..(353): n is a, c, g, or t
  modified_base (362)..(362): a, c, t, g, unknown or other
  misc_feature (362)..(362): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccagtggagtttgggctgagcttgggttttcctgttgcttcgttttaagaggtgtccagtgccaggtgcgagcgtgggtggaggtcggtgggggagcggtcggcccaggccgtgggacgtcccgaggacctcgtcctagtacagtctcgtggacttcaccgtttagttactagtgctatgctacgtcggtccgccggtctccgaggccgaagggtctgggagtggngctagttanactccagtgagtggacgtacgtagtaaactccagtaccagtaccgtcggtaggaacgggacctagtacctaccacgttcaccgaagaacgaactaaacgtaccgaaagtaccgaaccgcgtttaagtacttacgagtaaccaaagttaacgaaccgacgaccgttagaacggtacacggtaggaacgaaccggtaggaccgtttaagttacgggtttaaaccttaggtacgtagggtacgaacgttaggagttagtagggtacgggtttaacgaacgtttaaacgggg

SEQ ID NO: 230291 - DNA, 597 bp, Homo sapiens
  misc_feature: GYAE6OF01B775X.3.4.A04.1.454.CMB.1.raw
  modified_base (260)..(260): a, c, t, g, unknown or other
  misc_feature (260)..(260): n is a, c, g, or t
tcagagacgcactccacgaccggtgctcgatttagagtagtgatcagggggagctctgggagacgagcccagcactggaagtcgccggtgtttccattcggtgatcatcactgaacacagaggactcaccatggagtttgggctgagcttgggttttcctcgttgcttcttttaagaggtgtccagtgccaggtgcagctggtggagtcgtgggggagcgtggcccagccgtggggacgtcccaggaactctcctgtacngtctctggattcaccttaggttactatgctatgcacgtgggtccgccgggctccgaggcgaaggggctgggaggtggggtggctagttatactcccatgagtgggaggcaagtaaactccgtagcagacctcgtaggaacgggccattccacctatcctacgagaacgaacaactaccaagaaccacgctagtatctacgactaaatcgaacacggcctaggagacggtactagggaacggaccgaccggtcgtacggtacgttaactttacgtacggtcggaccggtaaggtaggtacgtaggtaaggttcggggttacgtaagtttaaaccgggg

SEQ ID NO: 230292 - DNA, 677 bp, Homo sapiens
  misc_feature: GYAE6OF01EHWOC.3.4.A04.1.454.CMB.1.raw
  modified_base (262)..(262): a, c, t, g, unknown or other
  misc_feature (262)..(262): n is a, c, g, or t
  modified_base (347)..(347): a, c, t, g, unknown or other
  misc_feature (347)..(347): n is a, c, g, or t
  modified_base (354)..(354): a, c, t, g, unknown or other
  misc_feature (354)..(354): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttcttttaagaggtgtccagtgccaggtgcagcgtgggtggagtcgtgggggaggcgtggcccagccgtgggacggtcccaggactctcctcgtacngtctcgtggatttccaaccgtttaggttacctatgcttatgctacgtcggggtccgccgggtctccgaggcgaaggggctagggnggtgggngctagttatctccagtgatgggaggactaagtaaacgtcctacgacgacggacctccggtaggaacgggtccgtattaccgaacctactaccgtaccgaagtacggaaacctaacgttaacccgaaacgaacctaaccgtaccttacggtaactcggtaacgtacaaaatcgaaacgtacggaccgtaggaacgacgacggtaggaaccggtacggtaccgggttactaggtttaaggttactttaacggtacgggttacggaggtaaacggtaaggtaggttagggaacgggtttcgggaaaggttaacgttaaaacggggg

SEQ ID NO: 230293 - DNA, 629 bp, Homo sapiens
  misc_feature: GYAE6OF01C7ODQ.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagtcttgggttttcctcgttgcttcttttaagaggttgtccagtgccaggtgcagcgtggtggagtcgtgggggagcgtcggcccagccgtgggacgtcccgaggtacctctcctagtacagtcctcgtggtacttctaaccttaggttactatgactatgcgacgtcgggtccgccgggcctcgaggcgagggcgtggaggtgggtgcagttatactccagtgtagtaggaggataagtaaactaccgtacgacgtacgacgtccggtaggaacgggtaccgtacgttaccacctacgtcctacgaagaacgaactaacttaaccaagaaccgtacgtactacgtactacgtaagactaagtaacgaacacgtaccgtagacgagtacgtagaacggtacgacggtctaggttagttacgtacggttaggttcggacggtaagacggtagttaggtaggtcgggtaacgtaagttaaaccgggg

SEQ ID NO: 230294 - DNA, 930 bp, Homo sapiens
  misc_feature: GYAE6OF01CTYT4.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggtagtttgggctgagtcttgggttttcctcgttgcttcttttaagaggtgtccagtgccgaggtgcagcgtgggtggagtcggtgggggagcgtcggcccaggccgtagggacgtcccaaggtactctcctgtacagtctcgtggtacttctaccgtttaggttactatgtactagtcgcacgtcggggtcccgccgggtcctaccgaggaccgaaggggtcgtagggacggtggggtaggacgtaaggtttaacgtactaccccgtagttaggaaggttacggggaacggtaactaaaacgggttaaacttaccccggtaacgaccgtaaacggtaaccccggtttaccggtacggggaaaccggggtacccgttaacgtttaaccctaacccgtaaccgtttacccgaaccccggtaaacggtaaaccggtaaaaccctttaaaacccgttaacccccgtaaaaacggtaaaccccgtaaacccgggttacccgtttaaagggtttaacccttaaccgttaaccgggtaaaaaccttaaaacgtaaacgggaaaaccccgttaacccggttaacccggtacgggtaaaccggtacgggttaacccggtaaggggtaacccgggtaaaccgggtaaccccgggttccggttttaagggttaacggttttaaacccggtttaacgggtttacgggttaccgggaaaccgggtaaaagggttagggttaacggttaacggggttaacgggtttaaccggggggttaaaccggtttaaacgggttttaaaaccccggggg

SEQ ID NO: 230295 - DNA, 735 bp, Homo sapiens
  misc_feature: GYAE6OF01BZ4YA.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttcttttaagaggtgtccagtgccaggtgcagctggtgtaggtcgtgggggagcgtggcccagccgtggggacgtcccaggactctcctgtacagtctctggacttcaccttaggttactatgctatgcacgtcgggtccgccgggctccgaggcaaggggctgggagtggggtggactagttagtactcccgaagttcggagtggggaacggacgtaaacggttaaacgttccccgtaacggacccgtaacggaacccgttcccgggtagggtaaaccggggacccgtaacgttacccgtaaccccgtacgttaccccgtacccgaaggaaaccgtaacctaaacgtttaaccccgaaaacgtaaacccgtaccggtactttacgtaacgttcctaacggacctaaaaggttacgaaaccgtacggtacccgttaaggaacggtaacgtacggtacgggaaccggaaccgtacgggtccttagggttacgttaacgttagttcgggtcgacggtaagggaagtacgttagggtacggttacggggtacgtaaacgggtttaaaccgggg

SEQ ID NO: 230296 - DNA, 904 bp, Homo sapiens
  misc_feature: GYAE6OF01AC88C.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggacctcacctagtgggtagtttgggctggagtcgtttcggggttttccctcggttggtccttacgtttttaaaggaggttcgtccgaggttcggccgtagggtcgacgtacggtcgttggggtggaggttccgggtaggggggacgtccggtcgggccccgaagggtcccggtaggggaaccggttaccccgaacgggtaacccttccgttaccgtaggtaacctggttccttaccggtaggttaactttccgtaaccgttttaagggtttaaccttacgtcgtacgttacgtccggtaccgtaccgggtccgggggttccccgaccgggtaccgtaccggaacggggtaccgggaacgggggtccgttagggggtaacgggttcggggtacggtacccgttaaagggttttactaaacccgtccgtaaggtaccgggtaggtacgggaacggtacgtaaacgtttaaacctaccggtacgtaccgtaacggtacccgttaccgggtaacgggacggtacccgtactacctaacccgtacgttaccgtaaccaacggtaacctaaaccgttaaaccggtaaacccgaaacggaaccgttacgtaccgtttacgtaacgttccgtaacggtaaccaaaacggtcggaaaccgtacggaccgtaagggacgacgtacgacggaccgtaggcgttaacgtggttaacttacggtacgttagggaccgtagggtaaacggtagtacggtttacggaagggtacgttaaacggtaaggtttaacgggg

SEQ ID NO: 230297 - DNA, 730 bp, Homo sapiens
  misc_feature: GYAE6OF01B4Z3W.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgcttcttttaagaggtgtccagtgccaggtgcagcgtggtggagtcgtgggggaggcgtggccccaggccgtggggacggtccccaggaacctcgtcctgtacagtctcgtggatttcacctttaggttactatgctatgcacgttcgggccgccgggctccgaggccgaaggggcgtggaggtgggtggctagttatactccaagtgagtgggacgctaaggtaaactccgtaacgcgaacgtaccgtcggtaggaacgggtcccgtagttacccaaccctatacccgtaccgtaaggtaacgtaacctaaactttacccgaaagtaaacccgtaccggtaccttaaggttacttaccgtaacggactaaaacgtccggaaaaccaaccggtaccgttaagggaacggtaacgtaccggtacggggaaaccggtacccggtaaccgggttccggttacggtttaacggtttaacgtttaccggtacggttaggaccgggtaaaggtaacggtaaggttacgggttaaaggttaccgggggtttaacgtaaacggttttaaaccgggg

SEQ ID NO: 230298 - DNA, 636 bp, Homo sapiens
  misc_feature: GYAE6OF01BV5ZI.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcgtgggttttcctcgttgcttcttttaagaggtgtccagtcgccgaggtgcagcgtggtggagtcgtgggggaggcgtggcccagccgtgggacggtcccgaggaactctcctgtacagttctcgtggtacttcctaaccgtttaggttactagtgcttatcgctacgtcgggtccgccgggtctccgaggcgaaggggctggacggtgggtgacgtagttatactccagtcgagtggagctaaagtaaactccgtacgcgacgtacgtccggtagacgggccgtacttccgacctactcctaccgagaacgaactaattaccgaaacgaaccgacgtacctagtaactacgttacgaacctaaagtacaaaccgacgtaccgtagagacgacgtaggacggtaaccgacggtcgtaggttacgtaacgttagtacggtacgacggagtaaggtacgtaggtaggttcgggtaagtaacgttaaacgggg

SEQ ID NO: 230299 - DNA, 720 bp, Homo sapiens
  misc_feature: GYAE6OF01B32QK.3.4.A04.1.454.CMB.1.raw
  modified_base (196)..(196): a, c, t, g, unknown or other
  misc_feature (196)..(196): n is a, c, g, or t
  modified_base (198)..(198): a, c, t, g, unknown or other
  misc_feature (198)..(198): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttacttttaagaggttgtccagtgccaggtncngctggtgagtcgtggggagcgtggcccagtccgtgggacgtcccaggaacctcgtcctgtacagtcctctggtattcaccgtttaggttactatgctagtgcacgtcgggtccgccgggctccgaggacgaaggggctggaggtgggtggcagttatatcccagtgatgggagctaagtaaactccgtagacgagtacctccggtaggaacgggtacccgtattcgaacctatcctacgacgtaacgaactaacgttaaccaacgaaaccaccgtatacgtaacgtactaggtaaccaaagtacgaaaccgacgtaccccgttaggaaacggtacggtaaccgtagggaaacccgggtaaaccgtaacccggggtccgttttaacgggttacggttttaaacgttttaaacccggttacgggttaacgggtaacggtaaaccgggttaaggttaaacggtttacgggttaaaccgggtttcgggggttaaaccgggttaaacgttttaaaaaacccgggggg

SEQ ID NO: 230300 - DNA, 536 bp, Homo sapiens
  misc_feature: GYAE6OF01DUYGE.3.4.A04.1.454.CMB.1.raw
  modified_base (345)..(345): a, c, t, g, unknown or other
  misc_feature (345)..(345): n is a, c, g, or t
  modified_base (497)..(497): a, c, t, g, unknown or other
  misc_feature (497)..(497): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgctcttttaagaggtgtccagtgccagggtgcagctggtggagtcgtgggggagcgtggcccagccgtgggacgtcccaggaactctcctgtacagtctctggattcaccttaggttactatgctatgcacgtgggtccgccgggctccgaggcgaaggggctgggagtgggtggcagttanactccatgatgggagcaagtaactccgtagcacgactccgtagaacgggcctattcaccatctaccgagacgaactaactaccaagaacacgctgtatctagacaaatcgaacagctagagtagcgagaggacaggtctgttagtagttacnggtgacgagtacgtatagagtcgggtgtagttaaacggg

SEQ ID NO: 230301 - DNA, 571 bp, Homo sapiens
  misc_feature: GYAE6OF01B4WIU.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttcttttaagaggtgtccagtgccaggtgcagctggtggagtcgtgggggagcgtggcccagccgtgggacggtcccaggaactctcctgtacagtctctggattcaccttaggttactatgctatgcacgtggggtccgccgggctccgaggcgaaggggctgggagtgggtggcagttatactccatggatggaggcaagttaaactccgtaacgcaagacctccggtaggaacgggtccgtattccaccatcctaccagaagtaaccaattacccgaagtaaccacgactagtatcgtagactaaatgaaaccacgccgtagagacgcgtagaacggacgacggtctaggtagttacttacgtgtgacgagacgtagtacgagttcgggtgtaagttaacggg

SEQ ID NO: 230302 - DNA, 630 bp, Homo sapiens
  misc_feature: GYAE6OF01DVERC.3.4.A04.1.454.CMB.1.raw
  modified_base (177)..(177): a, c, t, g, unknown or other
  misc_feature (177)..(177): n is a, c, g, or t
  modified_base (181)..(181): a, c, t, g, unknown or other
  misc_feature (181)..(181): n is a, c, g, or t
  modified_base (504)..(504): a, c, t, g, unknown or other
  misc_feature (504)..(504): n is a, c, g, or t
  modified_base (506)..(506): a, c, t, g, unknown or other
  misc_feature (506)..(506): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatgggagtttgggctgagcttgggtttttcctgttgcttcttttaagnggtntccagtgccaggtgcagctgggtggagtcgtgggggagcgtggacccaggccgtggggacgtccccaggtacctctcctgtacagtctcgtggattctaccgttaggttactatgctatgcacgtcgggtccgccgggctcgaggcgaaggggctgggaggtgggtggctaggttatactccatggagtagggacgacgtaagttaaactccgtaacgcgaacgtacgtcccggtaggaaacgggtccgtaagttacccaacccgtattaccgtaccgaagacgaactaaattcccgaaagtaaccaccgtcgtgtactcgtnanaataagaactacgacctagagacgcgtaggacggaccgacggtcgttaggtagttaagttacggtcggtaggaccgaagtaggtagtacgggtaggttcgggttacgtaaggttaaacccgggg

SEQ ID NO: 230303 - DNA, 533 bp, Homo sapiens
  misc_feature: GYAE6OF01EBPON.3.4.A04.1.454.CMB.1.raw
  modified_base (445)..(445): a, c, t, g, unknown or other
  misc_feature (445)..(445): n is a, c, g, or t
  modified_base (451)..(451): a, c, t, g, unknown or other
  misc_feature (451)..(451): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtctggggggagcgtggcccagccgtgggacggtcccaggaactctcctgtacagtctctggattcaccttaggttactatgctatgcacgtgggtccgcggctccgaggcaaggggctgggagtgggtggctagttatactcccatgatggaggcaagtaaactcctacgcagactccgtaggaacgggccgattcaccatctccagacgaactaattaccaagaacacgctagtatctanacaaangaacagcctagagagctagagacgacggtctgtagtattacgtgtcggcgtagagtataggagtgggtacgtagttaacggg

SEQ ID NO: 230304 - DNA, 916 bp, Homo sapiens
  misc_feature: GYAE6OF01DPDNC.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccagtggagtttgggctgagtcgttgggttttcctcggttgtcttacttttaaggaggtgtccgagtcgccgaggtgcgaggcgtgggtgggaggtcggtagggggaggcggtcggccgaggccggtggggacggtcccgaggtacctcgtccgtagtacgtagtctcgtcggtacttcctaccgttaggttactagtcgtctatcgtccgtacggtcgggtcccggccgggtccgtaccggacgggtaccggaaggggtccggtaggggtacgggttggggtcgggtaccgttaaggtttaacgttaccgttaccccgtaagttaggtaggttacggggaacggtaacgtaaacggttaaaaccgttcccgttaaccggaccgtaaaccgggtaccggttacccgggttaaggggtaaccgggtacccgttaaccttaccccgtaacccgtaaccgttacccgttaaccgaaacggtaaaccgtaaaacgtttaaaaccgttaacccgaaaacccggaaaccgttaacccggtaccgtttacgttaacgtttaacccgtaacgtaaaccgttaaaagtaacccggtaaaccgtaccggtacccggttaagggaacggtaaccggtaccggtaacggggtaaccggtaacccggtaccgggttagttacgggtttaacggttaacggtttaacggttcgggtaacgggaacgggttaaaggtaaagggttaacggttacggggtaagggtttaccgggggtaaacgttaacgggtttaaaaaccggggg

SEQ ID NO: 230305 - DNA, 864 bp, Homo sapiens
  misc_feature: GYAE6OF01AB5X7.3.4.A04.1.454.CMB.1.raw
tcagagacgcactccacgaccggtgctcgatttagagtagtgatcaggggagctctgggagacgagcccagcactggaagtcgccgtgtttccattcggtgatcatcactgaacacagaggactcaccagtggagtttgggctgagtcgttgggtttttcctcgttgcttacgtttttaagaggtgtccagtcgccgaggtcgcgagtcgtggtggagtcggtgggggagcggtcggcccgagccgtgggacgtcccgaggactctccgtgtacacgtctcgtgtacttctacgttagttactatgtctagtcgctacggtcgggtccgccggtcctacggaggcggtaacggggtcgtagggtagggtcgggtcgggtacgtaacggtttactaaccgttacccgaagtttacgggaaggttcgggtaaacggtaccgttaaacggttaaacccttccggtaaccggtaccggtaaccgtaccggttacccgggtaaggggtaacccgggttacccgttaacgttacccgaacccgttacgttaccctaacccgggtaaaggtaaccgtaaccgttaaaccgtttaaccccgaaacggaaacccggttaccgttaccgttaccgttaacgtacccgtttaaaggaaaccctttaaaaggtaaccgtaaccggtaccggtaaccgggttaaccgtaacggtacgggtaaccggtaacgggtaccggtaacgggtacggttaaccggtttacgggtttaaacggtttcttaacggggttaggtaccgggtacgggtaaaggtaaggttaaccgggttaggtaaaaccgggtttcggggtaaagtttaaacccggggtttaaaggg

SEQ ID NO: 230306 - DNA, 737 bp, Homo sapiens
  misc_feature: GYAE6OF01D58T2.3.4.A04.1.454.CMB.1.raw
  modified_base (272)..(272): a, c, t, g, unknown or other
  misc_feature (272)..(272): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttacttttaagaggtgtccagtcgccgaggtgcgagcgtggtaggagtcggtgggggagcgtcggcccaggccgtgggacgtacccgaggtacctcgtccgtgtacngttctcgtggtacttcacttaggttacatgactatcgactacgtcgggtccgccggtctccgaggacgaagggtcgtaggaggtggtggacttagttataccgtccagtagagtagggagactaaggtaaacttcccgagacacggtacgttaccggtaaggtaaccgggtcccgtaacgttcccaacccgttaagtacccgtaaccgaagaacgtaaaccctaaagttaacccgaaagtaaacccgtccgtacgttacgtaacgtccgtaagaaccgtaaaacgtcggtaaacctacggtacccgtaagggaaacgtacggtaacggttacgggaaacggtaacccgtcgggttaccgttaacggtttacggttaactttaccgggttagggaccgtaaaccggtaaggaacggtttacggtacggttaagggttacgggttaaacgtaacggtttaaacgggg

SEQ ID NO: 230307 - DNA, 738 bp, Homo sapiens
  misc_feature: GYAE6OF01BJ052.3.4.A04.1.454.CMB.1.raw
tcagagacgcactccacgaccggtgctcgatttagagtagtgatcaggggagctctgggagacgagcccagcactggaagtcgccggtgttccattcggtgatcatcactgaacacagaggactcaccatggagtttgggctgagtcgttgggttttcctcgttgcttcttttaaggaggttgtccgagtgccaggtgcgagcgtggtggaggtcgtgggggagcgtcggcccaggccgtggggacgtccccgaaggtaacctctccgtgtacagtctcgtggtattctacgttaggttactatgtctatcgcgtacgtcgggtccgccggtctaccggaggacggagggtcggtggtaggtgggtggtactagttagtaactccgtagtaggtagtacgggagtacgtaaacgttaaactccgtaccgacgacgtaccggtaccggtacgggaacggggtaccctagttaaccgacctacgtaccgttacccaaaggaaaccgtaccgtaaaacctacgtaaccgaaccggtacttccgtaagttaccgtaccgtataaccgtaaatacggaaaccttacgggaccttaaggaacgaacgtacggttacggaaccgggaacgtaacccgggttgtaacgggttaaggtttaaccgttggttaacggtcggaccggttaaaggaacgggttcgtaagggttacgggtacggggttaaacggtactttaaaaccggggg

SEQ ID NO: 230308 - DNA, 627 bp, Homo sapiens
  misc_feature: GYAE6OF01B9I0V.3.4.A04.1.454.CMB.1.raw
  modified_base (272)..(272): a, c, t, g, unknown or other
  misc_feature (272)..(272): n is a, c, g, or t
  modified_base (364)..(364): a, c, t, g, unknown or other
  misc_feature (364)..(364): n is a, c, g, or t
  modified_base (453)..(453): a, c, t, g, unknown or other
  misc_feature (453)..(453): n is a, c, g, or t
  modified_base (461)..(461): a, c, t, g, unknown or other
  misc_feature (461)..(461): n is a, c, g, or t
  modified_base (478)..(478): a, c, t, g, unknown or other
  misc_feature (478)..(478): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagtcttgggtttttcctcgtttgcttctttttaaggaggttgtccagtgccaggtgcagctggtggagtcgtgggggaggcgtggcccaggccgtggggacgtcccaggaactctcctgtacagtctntggattcaccttaggttactatcgctatcgctacgtggggtcccgccgggctccgagggccgaaggggctgggagtgggggtgacgtattanactccagtgatggggagcagtaaactcctaagcaagactcggtagaacgggcattccacatctaccagacaactaactcaagaacacgntagtactnagaactaagtcgaaacncgacctaggacgagtacgtaggaagggaacccgtaacggtccgttagggttacgtttaaacgttaccggtgggttaacggaccggtaaagggagtaaggttaacgggaaagggtttcggggtaaacccgtaaaggtttaaaacccgggg

SEQ ID NO: 230309 - DNA, 627 bp, Homo sapiens
  misc_feature: GYAE6OF01D61ZU.3.4.A04.1.454.CMB.1.raw
  modified_base (266)..(266): a, c, t, g, unknown or other
  misc_feature (266)..(266): n is a, c, g, or t
  modified_base (362)..(362): a, c, t, g, unknown or other
  misc_feature (362)..(362): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggtagtttgggctgagcttgggttttcctcgttgcttcttttaagaggtgtccagtgccgaggtgcagcgtggtggaggtcgtgggggagcgtcggccccagccgtgggagtcccaggaacctctccgtagtacngttctcgtggtattcaccttaggttactatgacttatgccacgtcgggtcccgccggggctcccggagggccgaaggggtcctgggtaggtcgggnggtactaagtttatacgtccagtggagtgggagtaccaagtaaactccgtaacgctagtaccgtcggaggacggcctagtcacctactctacagacaactaacgtaccgaagaaccacgtacctagtactacgagactaaagtacgaaacgcgtaccgtagaagacgtaccagggtacgaccggtacggtcgtaggttacgtagtttaccgaggttacggcgtaggaagtaggtagtaggttacgggttgtaaacgttaaacggg

SEQ ID NO: 230310 - DNA, 581 bp, Homo sapiens
  misc_feature: GYAE6OF01CL6O0.3.4.A04.1.454.CMB.1.raw
  modified_base (378)..(378): a, c, t, g, unknown or other
  misc_feature (378)..(378): n is a, c, g, or t
  modified_base (409)..(409): a, c, t, g, unknown or other
  misc_feature (409)..(409): n is a, c, g, or t
  modified_base (449)..(449): a, c, t, g, unknown or other
  misc_feature (449)..(449): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctgggtggagtcgtgggggagcgtggcccagccgtgggacgtcccaggacctctcctgtacagtctcgtggtattcacctttaggttactatgctatgcacgtcgggtccgccgggctccgaggcgaagggggctgggaggtggggtggctagttatactccagtgatgggagacagtaaacnctacgcacgctcgtagaacggcattcacctntctacagagactaactaccaagacacgctagtactcgtanacaagtacgaacacgaccgtagagacgcgtacggaacggaccggacggtccgtaggttacgttacgtttacgtaggtcgggtacgaggtacggtagtacggtaggttacggggtacgtaaggttaaacgggg

SEQ ID NO: 230311 - DNA, 629 bp, Homo sapiens
  misc_feature: GYAE6OF01EK34N.3.4.A04.1.454.CMB.1.raw
  modified_base (197)..(197): a, c, t, g, unknown or other
  misc_feature (197)..(197): n is a, c, g, or t
  modified_base (257)..(257): a, c, t, g, unknown or other
  misc_feature (257)..(257): n is a, c, g, or t
tcagagacgcactccacgaccggtgctcgatttagagtagtgatcagggggatcaggactcctcagttcaccttctcacaatgaggctccctgctcagctccgtggggctgctaatgctctgggtcccaggatccgaggtggggattgttgtgatgactcagtctccactcctccctcgcccgtcacccttggaccngcccggcctccatcctcctgcaggtctagacaacgccttgatacagtgagtacggaaacnccttacttgtaattggttcagcagacgcagccatcacacgctactatttagtagttcgtacggctcgtcggtccagacagtactcgaggcgcgaggtggtcgaggcacgtgtatttccaactactaagtaaacgttcgacggtacggtaggggtcggaggtcgtagggaaggttagtttcggggtttaggggttttaactacggttgaccgagttacggacgtaacgggtacaaccgtccgtcggcccgttaccgggtaccggttcccggaacggtaccgggaacgttaaagggacgaaagttaaccaaaacggtcgtcggtcggtcgacgtaccgtacctacgttaccgtcgttacttcgtaccttccccg

SEQ ID NO: 230312 - DNA, 649 bp, Homo sapiens
  misc_feature: GYAE6OF01DKVUV.3.4.A04.1.454.CMB.1.raw
  modified_base (195)..(195): a, c, t, g, unknown or other
  misc_feature (195)..(195): n is a, c, g, or t
  modified_base (351)..(351): a, c, t, g, unknown or other
  misc_feature (351)..(351): n is a, c, g, or t
tcagagacgcactccacgaccggtgctcgatttagagtagtgatcaggggagctctgggagacgagtccagcactggaagtcgccggtgtttccattcggtgatcatcactgaacacagaggactcaccatggagtttgggctgagcgttgggttttcctcgttgcttcttttaagaggtgtccagtgccaggtncagctggtggagtcgtgggggagcgtggcccagccgtgggacgtcccaggactctcctgtacagttctctggtattcaccgtttagttactatcgctatcgctacgtgggtccgccggctcgaggacgaggggctgggagtgggtcgactagttanactccagtgagtgggagtacaagtaaactccgtaagcgaagtcgtacgtaggaacgggcctaagttccaacctaatcctaccgaagtacgtaactaaacgttacccaaagtaaccacgtacttcgtaactaccgttagaaccttaaagtacgaacgtaacgtcctaggaaccgacgaccgtagggaacggaaccgtacggtacgtttagttacggttaaaccgttagtaggtacggaacggttaagaaacgggtcgtaacgggtaaggttacggggttactaaacggtttaaacgggg

SEQ ID NO: 230313 - DNA, 814 bp, Homo sapiens
  misc_feature: GYAE6OF01D4KKD.3.4.A04.1.454.CMB.1.raw
  modified_base (183)..(183): a, c, t, g, unknown or other
  misc_feature (183)..(183): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccagtggagtttgggctgagtcttgggttttcctcgttgtcttacgttttaaaggnggttcgtccaggtcgccgtaggtcgcaggtcgtgggtaggaggtcggtggggggacggtcggtcggccccaggtcccggtaggggaccggtaccccgaagggtaacccttccgttccgtacggtaacgtcgttcctcgttacggtactttccgtaaccgtttaggttactatcgtactagtcgacgtacggtcgggtcccggccgggtcctaccggacggtacggaaggggtcgtaggggtaggtcggggtaggtacgttaaggttacgtacctaccgtagtacggtaggtgggaacgtaacgtaacgtaaacgtccgtaacgacgtacggtacgtcggtaaggaccgggtcctaagttaccgaacctacgttccgaaccgtaaggaaaccgtaacttaaaccgtaaccggtaaaccgtaacctaccggttaacgtacgttacgttacgtaactaaccgtaaagtaccgaaacgtaccgtaccgtaaggaaacggtacgtacggtaacggggaaccgtaaccggtacgggttaccttaggtttaacggttacgttacggtcgggtaacggaacgtaaggtaacgtagtacgggttaagggtaccgggttaaagtaacgtttaaacgggggg

SEQ ID NO: 230314 - DNA, 635 bp, Homo sapiens
  misc_feature: GYAE6OF01DONDB.3.4.A04.1.454.CMB.1.raw
  modified_base (342)..(342): a, c, t, g, unknown or other
  misc_feature (342)..(342): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgctcttttaagagtgtccagtgccaggtgcagctggtggagtcgtgggggagcgtggcccagcctgggagtcccaggaactctcctgtacagttctctggattcaaccgttaggttactatgctatgcagtcgggtccgccggctccgaggacgagggcgtgggagtgggtagctagtntactccagtcgagtaggggagtacgtaaagttaaactccgtaagtcgaacgtacggtccggtaggaacgggtcctaacttacacccgtataccgtacgaacgtaacgaacctaaacttaacccgaaagtaaccgacgtactagttactcgtacgaataacgtaagaaccgtacgcgttacggaagatacggtaggaacgggtaaccgacgggtcttaggtagtttaaacttcgggtaggtacgacggtaagacggtagtaggtaaggttcgggaagttaacggttaaaccggg

SEQ ID NO: 230315 - DNA, 576 bp, Homo sapiens
  misc_feature: GYAE6OF01A6ENK.3.4.A04.1.454.CMB.1.raw
  modified_base (255)..(255): a, c, t, g, unknown or other
  misc_feature (255)..(255): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtgggggagcgtggcccagcctggggagtcccaggaactctcctgtacngtctctggattcaccttaggttactatgctatgcacgtggggtcccgccgggctccgaggcaagggggctgggacgtggggtggctagttatactcccatgagtgggaggcaagtaaactccgtacgcagacctccggtagaacgggtccattccacctactctccagacgacaattaccaagaacacgtctagtactctagacaaatcgaaacagccctagagacgcgtaggacggactacgggtcttaggtacgttacgttacgttggtcggacggaaggagtacgtaggtaaggtcggggtacgtaagttaaaccggg

SEQ ID NO: 230316 - DNA, 575 bp, Homo sapiens
  misc_feature: GYAE6OF01BPUTW.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgcttcttttaagaggtgtccagtgccaggtgcagctggtggagtcgtgggggagcgtggcccagcctgggagtcccaggactctctgtacagtctctggattccacttaggttactatgctatgcacgtgggccgccgggctccgaggcgaaggggctgggaggtgggtggctagttatactcccagtgagtgggagcaagtaaactcctacgacacgtacgtccgtaggaacgggccgtacttccaccatctaccgagacgactaacttaccaagaacacgactacgtactctagacaaagtcgaacacgaccgtaggacgagtcgtaggaacggtaacgacggtcgttaggtgttacgtttagtggttcgacgtaagaggtatagtaggtcgggtacgtaaggttaaacgg

SEQ ID NO: 230317 - DNA, 581 bp, Homo sapiens
  misc_feature: GYAE6OF01BCKEN.3.4.A04.1.454.CMB.1.raw
  modified_base (158)..(158): a, c, t, g, unknown or other
  misc_feature (158)..(158): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttccncgttgcttcttttaagaggtgtccagtgccaggtgcagctggtggagtcgtgggggagcgtggcccagccgtgggacggtcccaggaactcgtcctgtacagtctcgtggattcaccttaggttactatgctatgctacgtcgggtccgccggctccaggcgaaggggctgggacgtgggtgctagttatacgtccaatggagtcggagacagtaaactccgtacgcaacgtacgtccggtagaacgggccgtacttcgactatacctacgagacgaacgacttacgaagaacacgactagtatctaggactaaagtcgaacacgtacgtagacgacggactacgggaacgaccggacggtcgtacgttagtacttacgtcgtcggagaagaggtataggtacgagggtcgtagttaaacggg

SEQ ID NO: 230318 - DNA, 695 bp, Homo sapiens
  misc_feature: GYAE6OF01CJ0CO.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcgtggtttcgcgtagctctttaagaggtgtcagtgccaggtgcagctgggtggagtctggggggagcggtggcccagccgtggggaggtcccagggaactctcctggtaccagtctctaggacttcaccttaggttacctatgtacttactgtcacgtcggggtcccgccgggctaccgagggccaagggggctgggacggttggggtacgggcaagggtttactaactcccgtagtcggtaaagtggggggactaagttaaacgtaccgtacgtaccgacgtacgtaccggtcggtaacgggtaccgggacttaccgaccctacgtaccgtaaccgtacgaacggtaacgtaactaaccgtaacgaaaccgtaccggtacgtacgtacgtactacgtaaccgtaaagtacctaaacggaacgtaccgtacggacggagtacggtacggacggaacggtccggtaacgttcgtacgtaacggttccttagggtcgaccggtagaaaggtcgtacgtagggtaggtacggtaggtaacgtttaaacgggg

SEQ ID NO: 230319 - DNA, 671 bp, Homo sapiens
  misc_feature: GYAE6OF01AQP2H.3.4.A04.1.454.CMB.1.raw
  modified_base (266)..(266): a, c, t, g, unknown or other
  misc_feature (266)..(266): n is a, c, g, or t
  modified_base (352)..(352): a, c, t, g, unknown or other
  misc_feature (352)..(352): n is a, c, g, or t
  modified_base (446)..(446): a, c, t, g, unknown or other
  misc_feature (446)..(446): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttcttttaagaggtgtccagtgccgaggtgcagctgggtggagtcgtgggggaggcgtcggcccagccgtggggacggtcccaggtacctcgtcctgtacngtctctggacttcacctttagtactatgctatcgctacgtcgggtccgccgggtctccgaggcgaaggggtcctgggtaggtgggngctagttacacgtccagtgagtgggaaggtcaagtaaactaccgtacgacgtacgtaccgttccggtaggaacgggtcctacgttaccgaaccncgttaccgtacctaaggaacgaacttaacgttacccgaaaacgtaaccgaaccgtacgttacggtaactcgtaggaaacctaaaggtacgaacctaggacccttaggaaacgtcgtacgaggtaccggaaccgtacgggtgttaacggttagttacgttacggtggtacggtacggtaacgtaggtacgtaggtacggttacggggttgtaaaggttaaaccggg

SEQ ID NO: 230320 - DNA, 700 bp, Homo sapiens
  misc_feature: GYAE6OF01DMYYQ.3.4.A04.1.454.CMB.1.raw
  modified_base (357)..(357): a, c, t, g, unknown or other
  misc_feature (357)..(357): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagtcttgggttttcctcgttgcttcttttaagaggtgtccagtgccaggtgcagcgtggtggagtcgtgggggagcggtcggcccagccgtgggacgtcccgaggacctcgtcctgtacagtctctggtacttctaacctttaggttactatgactatgcctagtcgggtccgccggctccgaggcgagggctggagtgggtgctagttactntccagtcgagtgggagcaaagtaactccgtaacgcaacgtaccgtacggtaggaaacgggtccgtaacttaccgaaccctactaccgtacccgaaagtaacgaaaccttaaacgttaacccgaaacgtaaccgtaccgtaccgttacgtttaacttacgtacggaaacttaaacgaacgtaaaccgaacgtacccgtagaacggacgtacggttacgggaacggtaaccggtacgggtacgtttaggtaggtttaaactttacggtggttacgggaaccggttaaggaacggttaagtaagggtacggtttaaggggtaaccgttaaggtttaaaacccgggg

SEQ ID NO: 230321 - DNA, 896 bp, Homo sapiens
  misc_feature: GYAE6OF01EOH87.3.4.A04.1.454.CMB.1.raw
  modified_base (190)..(190): a, c, t, g, unknown or other
  misc_feature (190)..(190): n is a, c, g, or t
tcagagacgcactccacgaccggtgctcgatttagagtagtgatcaggggagctcgtgggagacgagcccagcactggaagtcgccggtgttccattcggtgatcatcactgaacacagaggactcaaccagtggtaggtttgggctgagtcgttgggttttccctcggttgtaccttacgttttaaggngggtcgtccgtaaggttcgccggtaggtgccgaggtcgtgggtcgggtagtcgggtagggggacggtcggtccgggacccgaggtcccggttaggggaccggttaccccgaaggtaaccttcgtaccgtacgtacgtcgttctcgtggtacttacgtaccgtttaggttacctagtcgtactagtacgtcgttacggtccggggtcccggtcccgggacgttacccgggagggtaaccgggaacgggggtccgttaggggtacgggttcggggttacgggtaccgtttaaaggttaccgttaaccgtccggtaaggttaacggtaggtaacggggtaaccgggtactaaaacggtttaaaccccgtaccgtaacggtaaccgtaaccggttacccggttaacgggtaaccgggggtaaaccggtacccgtttaaccgtacccgtaaacccgttacgttacccgtaacgtacgggtaaacctaacgtaaaccgttaaccgaaacgtaaccgtacggtacttacgtacgtacgtacgaaacgtaactaccgtaaaggcttacgggaaggtaaccgacgggtcgaacggtaccgggtaaacccggtcgttaaggttaccggttacgttaacgttaccggtagggttacccgaggttaaggaacggttggtaacggttacgggtcggtaaacggttaacgttaacggggg

SEQ ID NO: 230322 - DNA, 626 bp, Homo sapiens
  misc_feature: GYAE6OF01C81NM.3.4.A04.1.454.CMB.1.raw
  modified_base (160)..(160): a, c, t, g, unknown or other
  misc_feature (160)..(160): n is a, c, g, or t
  modified_base (177)..(177): a, c, t, g, unknown or other
  misc_feature (177)..(177): n is a, c, g, or t
  modified_base (364)..(364): a, c, t, g, unknown or other
  misc_feature (364)..(364): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagtcttgggttttccngttgcttcgttttaagnggtgtccagtcgccgagggtgcaggcgtgggtggagtcgtggggggagcgtcggcccaggccgtggggacggtcccaaggtacctcgtcctgtacagtctcgtggattcaaccgtttaggttactagtcgacttagtcgctacggtcgggtccgccgggctccgaggacgagggctgggaggtgggngctagttactactccagtgagtggagactaagtaactccgtaagcacgtacgtcggagaacgggtctactcacactctacagagaactaactaacaacgtaacgacgtctagtactcgtagaacaaacgtgaaaccacggaccgtaggaacgtacggtaccgtagggaaccggacgacggtaccgttaggttacgttacgttaacgtggacgtacggaagtaacggtagtaacggaggttcgggtaacgtaaagttaacggg

SEQ ID NO: 230323 - DNA, 623 bp, Homo sapiens
  misc_feature: GYAE6OF01AZY61.3.4.A04.1.454.CMB.1.raw
  modified_base (279)..(279): a, c, t, g, unknown or other
  misc_feature (279)..(279): n is a, c, g, or t
  modified_base (399)..(399): a, c, t, g, unknown or other
  misc_feature (399)..(399): n is a, c, g, or t
  modified_base (435)..(435): a, c, t, g, unknown or other
  misc_feature (435)..(435): n is a, c, g, or t
tcagagacgcactccacgaccggtgctcgatttagagtagtgatcagggggagctctgggagacgagcccagcactggaagtcgccggtgtttccattcggtgatcatcactgaacacagaggactcaccatggagtttgggctgagtcttgggttttcctcgttgcttactttttaaaggaggtcgtccaggtcgccgagggtgcgagcgtgggtggaggtcggtggggggagcggtcggcccaggccgtgggacggtcccaggacctctcctgtacngtctcgtggtattcacgttaggttactatcgctatgctacgtgggtccgccggtctccgaggcgaggggctgggaggtgggtggctagtttactactccgatggagtggagcaagtaacncctagcagcgtcgaggaacgggccgtattccaactntacgacagacactaactaccaagaccagctagtactctagaactaagtaccgaacgacgtaccgtaggaacgtacgacgtaggacgggtaaccgacgggtcgttaacggttagtttaacgttcggttacggtacggacggtaaggtagtacgttaggtaggttcgggtaacgtaacgttaaacggggg

SEQ ID NO: 230324 - DNA, 587 bp, Homo sapiens
  misc_feature: GYAE6OF01DC4Y9.3.4.A04.1.454.CMB.1.raw
  modified_base (245)..(245): a, c, t, g, unknown or other
  misc_feature (245)..(245): n is a, c, g, or t
  modified_base (461)..(461): a, c, t, g, unknown or other
  misc_feature (461)..(461): n is a, c, g, or t
tcagagacgcactccacgaccggtgctcgatttagagtagtgatcagggggatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctgtatacagtgatagaaacnctacttgaattgttcagcagaggccaggccaatcgtaccaaggccgtaccttaatttagtaacggttttcaaccgggtactcgtcggggtacccagacagtattcgagcggcaggtgggtacaggctactgtatttcaactatagaaatcaggcaggggtgaggctgagtagttggtttagggtttatacgtgctagtgacgtaaggttacaaccncgtcggacccgttccggtacggttaccggaccgacggggaactaaagggtagaaaactacgaaacgtaaacggtgtacgggcttacgacctaacgtacttacgttgttaccttcgtctttaccccg

SEQ ID NO: 230325 - DNA, 827 bp, Homo sapiens
  misc_feature: GYAE6OF01C7N2V.3.4.A04.1.454.CMB.1.raw
  modified_base (188)..(188): a, c, t, g, unknown or other
  misc_feature (188)..(188): n is a, c, g, or t
  modified_base (788)..(788): a, c, t, g, unknown or other
  misc_feature (788)..(788): n is a, c, g, or t
tcagagacgcactccacgaccggtgctcgatttagagtagtgatcaggggagctctgggagacgagcccagcactggaagtcgccggtgtttccattcggtgatcatcactagaacacagaggactcaccagtggtagtttgggctgagtcgtttgggttttcctcgttgtctttacgtttttaaggnggtcgtaccaggtcgaccgtaggtgcgagtcgtgggtggaggtggtgggggcgtcggtcggcccgaggccgtggggaccgtacccgaggtaaccttcgtaccgtagtaccgtagttcgtcgttacggtacttaccgttaaccgtttaaggttactagtcgtacttacgtcgcgtaccggttccggggccccggtaccgggtcctaccggagggacgggtacgggggtcgtaggggtagggtttcggggtacggtactaacggtttacgtaccgttaccgagttaggtaggtacgggacggtaactaaacgtaaccgtaccgtacgacgaccggtaccggtaccgggtaaggaaccgggttaccctacgttaccccaacttaccgttaaccccaacggtagtaaaaccgtaaaccgttaaacccgttaaaccaaaccggaaccgttccggtaacgttacgttaaccttacgaaacggtaaacctaagtaaccgaacctaacggtaccgtagaaacgggtacgaaccgtagggaaccggtaaccgtggtaccgtttgggttaattaacggttacggtgtaacggacggttaagaacgggttntaaggttacgggtacggttaacgtaggttttaaacgggg

SEQ ID NO: 230326 - DNA, 689 bp, Homo sapiens
  misc_feature: GYAE6OF01AQB10.3.4.A04.1.454.CMB.1.raw
  modified_base (549)..(549): a, c, t, g, unknown or other
  misc_feature (549)..(549): n is a, c, g, or t
  modified_base (590)..(590): a, c, t, g, unknown or other
  misc_feature (590)..(590): n is a, c, g, or t
  modified_base (647)..(647): a, c, t, g, unknown or other
  misc_feature (647)..(647): n is a, c, g, or t
  modified_base (678)..(678): a, c, t, g, unknown or other
  misc_feature (678)..(678): n is a, c, g, or t
tcagagacgcactccacgaccggtgctcgatttagagtagtgatcaggggagctcgtgggagacgagcccagcactggaagtcgccggtgtttccattcggtgatcatcactgaacgcagaggactcaccatggagtttgggctgagcttgggttttcctcgttgcttcgttttaagaggttgtccagtgccaggtgcagctggtggagtcgtgggggagcggtggcccaggccgtgggacggtcccaggactctccgtgtacagtctctcggtacttccacctttaggttactagtgtacctatcgcgtacgtcggggtcccgccgggtcctccgaggcggaaacggggcgtacgggaggtggggtcggacctaggttacctagttcccgaagtcggagtagggacggtccgtaaagttaacctccgtaacgaccgtaacggtacccttccgggaaggtaaccgggaccgttaacttcccaacccgtagtccccttaacgacgaacgtaaccctaacttacccgaaaagaaccaccggtcttaagtcnctacgtaactaaagtcgaaaaccgtgacccgtaagggaacncgtaccgtacggaaccgggacgtccgggtgttacggttacgtttacgtacgttcggngacgtaagaggtaagtgacggtagggttacngtttaaacggg

SEQ ID NO: 230327 - DNA, 620 bp, Homo sapiens
  misc_feature: GYAE6OF01AZVXS.3.4.A04.1.454.CMB.1.raw
  modified_base (174)..(174): a, c, t, g, unknown or other
  misc_feature (174)..(174): n is a, c, g, or t
  modified_base (176)..(176): a, c, t, g, unknown or other
  misc_feature (176)..(176): n is a, c, g, or t
  modified_base (178)..(178): a, c, t, g, unknown or other
  misc_feature (178)..(178): n is a, c, g, or t
  modified_base (183)..(184): a, c, t, g, unknown or other
  misc_feature (183)..(184): n is a, c, g, or t
  modified_base (186)..(186): a, c, t, g, unknown or other
  misc_feature (186)..(186): n is a, c, g, or t
  modified_base (189)..(189): a, c, t, g, unknown or other
  misc_feature (189)..(189): n is a, c, g, or t
  modified_base (191)..(191): a, c, t, g, unknown or other
  misc_feature (191)..(191): n is a, c, g, or t
  modified_base (193)..(193): a, c, t, g, unknown or other
  misc_feature (193)..(193): n is a, c, g, or t
  modified_base (195)..(195): a, c, t, g, unknown or other
  misc_feature (195)..(195): n is a, c, g, or t
  modified_base (199)..(199): a, c, t, g, unknown or other
  misc_feature (199)..(199): n is a, c, g, or t
  modified_base (207)..(207): a, c, t, g, unknown or other
  misc_feature (207)..(207): n is a, c, g, or t
  modified_base (211)..(211): a, c, t, g, unknown or other
  misc_feature (211)..(211): n is a, c, g, or t
  modified_base (264)..(264): a, c, t, g, unknown or other
  misc_feature (264)..(264): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctggagcggtgttcgcgtaggcgtcttaagagncngncagtnngntgngngngngggngcgcgccngcgnggacgtccagtactctcgtgtactgtctcgtgtactctacgttagtactagtntctagtcgacgtcggtcggccggtccggtccgacgacggacggagggtcgtagggtcggtgggtcgtacgtagttactacctaccgatcgagacggtacgactaacggtaactaccgtaacgacgtacgacggtacggtacgaaccggtctactaccgaactcgtaccgtacgaacgtaactaacgtaacgtaacgaacgtaaccgtacgtacgtacgtaacgtacgaacgaacaagtaacgaaccgacgtacgaaggactcgacgtacgacggacgtacgtacgtacgttacgttacgttacgtacggtagtacgtagtacgtacgtacggtaggtacggtaacgtaaggtaagg

SEQ ID NO: 230328 - DNA, 766 bp, Homo sapiens
  misc_feature: GYAE6OF01B23Z2.3.4.A04.1.454.CMB.1.raw
  modified_base (185)..(185): a, c, t, g, unknown or other
  misc_feature (185)..(185): n is a, c, g, or t
  modified_base (276)..(276): a, c, t, g, unknown or other
  misc_feature (276)..(276): n is a, c, g, or t
  modified_base (713)..(713): a, c, t, g, unknown or other
  misc_feature (713)..(713): n is a, c, g, or t
tcagagacgcactccacgaccggtgctcgatttagagtagtgatcgaggggagctcgtgggagacgagcccagcactggaagtcgccggtgtttccattcggtgatcatcactgaacacagaggactcaccagtggtagtttgggctggagtcgttgggttttcctcgttgcttacttttaaggnggttgtccagtcgccgtaggtgcagtcgtggtggaggtcgtgggggagcgtcggcccaggtccgtgggacgtcccaggactctcgtgtacngtctcgtggattccgacttaggttactagtgacttagtcgcgtacgtcggggtccccgtaccgggcctccggacgggcgaacgggggtccgttagggagggttcgggtcgggtactaggtttaactaccgtacccgtagtacgggtagtaggggtacgacgtaaacgttaaacgtcccgtaacggaccgtaacggtaccgttccgggtaacgggaacgggtcccgttaacgttcccgtaaacccgtacttaccgtaaacccgtacgtaaacgtaaccgtaaacgttaaccgaaaacgtaaccgtaccggtaacgtttaggtaccttacgtacgtaaaccgtaaagttccgaaaacgtccgtaacgtggaacggttcgacggtacggaaacggccggtaaccgtcgttaggttaacgttacgttacggtcgggtacgngggttaaagaggttacggtaggttaaggtccgggtaagtaacgtttaaacggg

SEQ ID NO: 230329 - DNA, 729 bp, Homo sapiens
  misc_feature: GYAE6OF01E05CO.3.4.A04.1.454.CMB.1.raw
  modified_base (156)..(156): a, c, t, g, unknown or other
  misc_feature (156)..(156): n is a, c, g, or t
  modified_base (173)..(173): a, c, t, g, unknown or other
  misc_feature (173)..(173): n is a, c, g, or t
  modified_base (257)..(257): a, c, t, g, unknown or other
  misc_feature (257)..(257): n is a, c, g, or t
  modified_base (295)..(295): a, c, t, g, unknown or other
  misc_feature (295)..(295): n is a, c, g, or t
tcagagacgcactccacgaccggtgctcgatttagagtagtgatcaggggagctctgggagacgagcccagcactggaagtcgccggtgtttccattcggtgatcatcactgaacacagagactcaccatggagtttggctgagctgggttttccncgttgcttcttttaagnggtgtccagtgccaggtgcagtcgtggtggagtcgtgggggagcgtggcccagccgtgggacttcccaggtactctcgtgtacngtctcgtggacttccaccgttagttactagtgcttagngcacgtcgggtcccgccgggctccgagggcggaacggggtcgtagggtacggtggggtcggacgtaagtttactacgtacccgagtagacgtggaaggtacgtaaaggttaaaccgtccgttaacgacgtaacgtaccggtacccggtaagggaaccgggtccgtaacttcccgtaaaccctacgtacccgtaccgaaacgtaaccgtaaaccgtaaaccgtttaacccgaaaaccgtaacccgtaaccggtaccgtttacgtacgttacgttagaacctaaacgtacgaaacgccgtacgttacgaacgtaacggaccgtaagggacggtaaccggtacggttacgttacggttagttaacgtttaggtcggttacggacgtaaggacgttaaggtacggtaaggttacgggtacgttaacggtttaaacggg

SEQ ID NO: 230330 - DNA, 728 bp, Homo sapiens
  misc_feature: GYAE6OF01DBD9X.3.4.A04.1.454.CMB.1.raw
  modified_base (358)..(358): a, c, t, g, unknown or other
  misc_feature (358)..(358): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttacttttaaggaggtgtccagtgccaggtcgcagtcgtgggtggaggtcggtggggggacgcggtcggcccaggcccgtggggacgtcccgaggacctctcctgtacagtctctggtacttctaccgttaggttactatcgctatgctacgtcgggccgcggctcgaggacgaggggtctgggaggttgggnggacgtagttactacgtccagtggacgtggacggtcaaacggttaaactcccgtaaccgacctaggtaacccgttccgggtaacgggaaacgggtcccgtaacttacccgaacccttaacgtacccgtaaccgacggtaaactaaccttaaacgtaaccccgaaacgtaacctaacccggtacttacggtaactccgtaacgtaacctaaagtacgaaaccgtaacgtacccggtaggaacgtacggtacgtagggaacggaacccgtacggtccgtaggttacgttaacgttacggttaggtaccggtacggtaagggaagttagtacgggtaagggttccgggtaaaggttaacggtttaaaacgggg

SEQ ID NO: 230331 - DNA, 727 bp, Homo sapiens
  misc_feature: GYAE6OF01AEGYK.3.4.A04.1.454.CMB.1.raw
  modified_base (195)..(195): a, c, t, g, unknown or other
  misc_feature (195)..(195): n is a, c, g, or t
  modified_base (355)..(355): a, c, t, g, unknown or other
  misc_feature (355)..(355): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagtcttgggttttcctcgttgcttcttttaagaggtgtccagtgccaggtncagctggtggagtcgtgggggagcgtggcccagcctgggacgtcccaggactctcctgtacagtctcgtggtacttccaccgtttaggttacctagtcgtctagtcgctacgtcggggtcccgccgggtctccgaggcgaaggggctagggagtgggtanacgtagttatactccatgagtggacggactaacgtaaactccgtacgacgtacgtaccgtccggtaggaaccgggtcctaacgtttcccgaacccttactacccgtaccggaaaggtaaccgaaaccgtaaaccgtttaacccgaaaacggaacccgtaccggtacgtttaacggttaacttaccggtaacgtaaacctaaaacgttccggaaaaccgtcggtaacccgttaggaaacggtccggtacgtagggaacccggtaacgtaccgggtcttagggttacgtttacgttacggttacggacggtacggaaagttacggtaaggttacgggtaaggttacggggttaacgtaaacggtttaaccgggg

SEQ ID NO: 230332 - DNA, 571 bp, Homo sapiens
  misc_feature: GYAE6OF01A6D32.3.4.A04.1.454.CMB.1.raw
  modified_base (175)..(175): a, c, t, g, unknown or other
  misc_feature (175)..(175): n is a, c, g, or t
  modified_base (179)..(179): a, c, t, g, unknown or other
  misc_feature (179)..(179): n is a, c, g, or t
  modified_base (372)..(372): a, c, t, g, unknown or other
  misc_feature (372)..(372): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgcttcttttaagnggtntccagtgccaggtgcagctggtggagtcgtgggggagcgtggcccagccgtgggacgtcccaggactctcctgtacagtctctggacttcaccttaggttactatgctatgcacgtcgggtccgccgggtctccgaggcgaggggcgtgggaggtggggtggctaagttatacgtcccagtcgagtggacgtnaagtaaactcctacgctacgtaccgtcgtaggaacgggcgtagttacaccatcctacgaagacgaactactaccgaacgaacacgctagtacgtctagacaatacgaacacggtaccagacgagtcctaggacgacgacgtctagtacgtacttagtcgtagcgaagagtagaggtaggtacggtacgtagttaaccgg

SEQ ID NO: 230333 - DNA, 547 bp, Homo sapiens
  misc_feature: GYAE6OF01EVFQ9.3.4.A04.1.454.CMB.1.raw
  modified_base (178)..(178): a, c, t, g, unknown or other
  misc_feature (178)..(178): n is a, c, g, or t
  modified_base (196)..(196): a, c, t, g, unknown or other
  misc_feature (196)..(196): n is a, c, g, or t
  modified_base (262)..(262): a, c, t, g, unknown or other
  misc_feature (262)..(262): n is a, c, g, or t
  modified_base (370)..(370): a, c, t, g, unknown or other
  misc_feature (370)..(370): n is a, c, g, or t
  modified_base (438)..(438): a, c, t, g, unknown or other
  misc_feature (438)..(438): n is a, c, g, or t
  modified_base (445)..(445): a, c, t, g, unknown or other
  misc_feature (445)..(445): n is a, c, g, or t
  modified_base (447)..(447): a, c, t, g, unknown or other
  misc_feature (447)..(447): n is a, c, g, or t
  modified_base (457)..(457): a, c, t, g, unknown or other
  misc_feature (457)..(457): n is a, c, g, or t
  modified_base (500)..(500): a, c, t, g, unknown or other
  misc_feature (500)..(500): n is a, c, g, or t
tcagagacgcactccacgaccggtgctcgatttagagtagtgatcagggggagctctgggagacgagcccagcactggaagtcgccggtgtttccattcggtgatcatcactgaacacagaggactcaccatggagtttgggctgagtcttgggttttcctcgttgcttcttttaagnggtgtccagtgccaggtncaggctgggtggaggtcgtggggggagcgtcggccagccgtgggacgtcccaggactctctgtacngtctctggattcacttaggttactatgctatgcacgtgggccgcggctcgaggcgaagggctggagtgggtgactagttatctccagtgagtggaagctaagtaaacnctacgcagacctcggtaggaacgggtccatccactatcctacagacaactaactacaagtacagtctntactcananaatcgaaacncgtactgagtcacgaggacgacgacgtgtagtcgttaacgttnaggtgacggtaagagtatagggtagtacgggtactaagttaaacggg

SEQ ID NO: 230334 - DNA, 707 bp, Homo sapiens
  misc_feature: GYAE6OF01DOTJJ.3.4.A04.1.454.CMB.1.raw
  modified_base (119)..(119): a, c, t, g, unknown or other
  misc_feature (119)..(119): n is a, c, g, or t
  modified_base (177)..(177): a, c, t, g, unknown or other
  misc_feature (177)..(177): n is a, c, g, or t
  modified_base (565)..(565): a, c, t, g, unknown or other
  misc_feature (565)..(565): n is a, c, g, or t
  modified_base (573)..(573): a, c, t, g, unknown or other
  misc_feature (573)..(573): n is a, c, g, or t
  modified_base (578)..(578): a, c, t, g, unknown or other
  misc_feature (578)..(578): n is a, c, g, or t
  modified_base (610)..(610): a, c, t, g, unknown or other
  misc_feature (610)..(610): n is a, c, g, or t
tcagagacgcactccacgaccggtgctcgatttagagtagtgatcgaggggagctctgggagacgagccctagcactggaagtcgccggtgtttccattcggtgatcatcactgaacanagaggactcaccagtggtagttggctgagcgttgggtttcctcgttgcttctttaagnggtctccagtgccgaggtgcgaggcgtgggtggtagtcggtgggggacgcggtcggcccagcgtgggacgtccgaggactctcgtgtacagtctcgtgctactaccgttaggtactatgtctatcgacgtacggtcgggtcccgaccggctccggacgggaccgaggggtcgtagggtacgggttggggacggcgttaagttacgtaaccgtaccgttagttaggtaaggttacgggaacgtaaccgtaaaacgtttaacccgtccgtaacgaccggtaacgtacccggtacgggtaagggaaacgggtcccgttaattaccccgaacccgttaacggtccctaaccgaaggtaccgtaaactaaacgtcccgaaagtacgaccggtntacgttancgtanaaccgtaagacagacgcgtagacgagtacggnggaacggtccgtacgcggtttagtcggttaacgttcggtgtaacgggacgtaagaggttgtacgggaagttcgggtaagttaaaccgggttaacggg

SEQ ID NO: 230335 - DNA, 577 bp, Homo sapiens
  misc_feature: GYAE6OF01E4783.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgctcttttaagaggtgtccagtgccaggtgcagctggtggagtcgtgggggaggcgtggcccagccgtgggacggtcccaggactctcctgtacagtctctggattccaccttaggttactatgctatgctacgtgggtccgccggctccgaggcgaaggggctgggaggtgggtggctagttacatcccatgagtgggagcaagtaaactccacgcagtactccggtaggaacggcctactccacctactcctaccagaacgactaacttaccaacgtaaccacgtctagtactctagactaaagtcgaaacacgtaccgtagagacgcgtaggacgtacgacggtactggttagttacttacgtgtcggacgaaggagtacgtaggaggttcgggtacgtaagttaaacggg

SEQ ID NO: 230336 - DNA, 641 bp, Homo sapiens
  misc_feature: GYAE6OF01CEC6B.3.4.A04.1.454.CMB.1.raw
tcagagacgcactccacgaccggtgctcgatttagagtagtgatcagggggagctctgggagacgagcccagcactggaagtcgccggtgtttccattcggtgatcatcactgaacacagaggactcaccatggagtttgggctgagctgggttttcctcgttgcttcttttaagaggtgtccagtgccaggtgcagctggtggagtcgtgggggaggcgtgcccagccgtgggacgtcccaggaactctctgtacagtctctggattcaccttagttactatgctatgcacgtcgggtccgccgggctccgaggcgaaggggctgggagtgggtggctagttatactccatgagtggaggctaagtaaactcctacgacgacgactccggtaggaacgggcctaagttccaacctactacctaccgaagaacgtaactaaacgttacccgaaagaaccctaacggtacctaggttaatcgtacgtaaccaaaagtacgaaacacggacctagggacgtaacgcggtacggaacgggaccgacgggtacgtacggttagttaacgttaccgttgggtacggaccgggtaaggaacggtaagttacggaaggttagggggtaccgtaacggtttaaaacggg

SEQ ID NO: 230337 - DNA, 933 bp, Homo sapiens
  misc_feature: GYAE6OF01BQVWR.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagagactcaccagtggtagtttgggctgagtcgttgggttttcctcggttgtcttacgttttaaggaggttcgtccgaggtcgccgagggtgcgagtcgtgggtggaggtcggtgggggaggtcggtcggcccgaggtccgtaggggacggtacccgaaggtacctcctccgtagtacagtcctcgtagtacttaccgtaaccgtttaaggttaactagtcgtacttagtcggtaccgtaccgggttccggggtccccgggtcccgggtcccgttaccccggaaggggaccgggtaaacgggggtcggttacgggggtagggtcggggtacggtaccgttaagtttaactaccgttacccgtaagtaggtaagttggggaaacggtaacctaaacggttaaaacctcccggtaacgacggtaaccgtacccggttaccgggtaagggaaacccgggtcccttaacgtacccgtaacccgtaacgttccctaaccggtaaacggtaaaccgtaaaccgtaaaccgttaaaccccggaaaaccggtaaacccgtacccggttaaccgtttaagtaacccgttacgttaaaccggaaacttaaaacggtaaccgtaaaccgtaccggtacccggaaggtaaccggtacgtaaccggtacggggaaacccgaaccgggttaccggttacgtttaacggtttaccgttaaaccggtttaagggttaccgggaacgggttaaacggaaacgggttaaacgtaagggtacgggtttaaacgggttaaccgggttaaaagggttaacgtttaaaaaccgggggg

SEQ ID NO: 230338 - DNA, 601 bp, Homo sapiens
  misc_feature: GYAE6OF01EI3GI.3.4.A04.1.454.CMB.1.raw
  modified_base (462)..(462): a, c, t, g, unknown or other
  misc_feature (462)..(462): n is a, c, g, or t
  modified_base (545)..(545): a, c, t, g, unknown or other
  misc_feature (545)..(545): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgcttcttttaagaggtgtccagtgccaggtgcagctgggtggagtcgtgggggagcgtggcccagccgtgggacgtcccaggacctctcctgtacagtctctggacttcaccttaggttactatgctatgctacgtcgggtccgccggctccgaggcgaaggggctagggacgtggggtggactaggtttatacgtcccagtgagtgggaggactaagtaaactcctacgcacgtacctcggtggaagggcctattccaccatcctaccgaagacgaacgtaattacccgaaagtaaccncgtacctagtactcgtagacctaaagtcgaaccaggcctagacgagactaggacgacgcggtacttggtagttacgtttacgnggttaccggacggtaagaggtacgtggacggttaggggtccgtaagttaaaccggg

SEQ ID NO: 230339 - DNA, 783 bp, Homo sapiens
  misc_feature: GYAE6OF01E39TX.3.4.A04.1.454.CMB.1.raw
  modified_base (133)..(133): a, c, t, g, unknown or other
  misc_feature (133)..(133): n is a, c, g, or t
  modified_base (323)..(323): a, c, t, g, unknown or other
  misc_feature (323)..(323): n is a, c, g, or t
  modified_base (638)..(638): a, c, t, g, unknown or other
  misc_feature (638)..(638): n is a, c, g, or t
tcagagacgcactccacgaccggtgctcgatttagagtagtgatcaggggagctctgggagacgagcccagcactggaagtcgccggtgtttccattcggtgatcatcactgaacacagagactcaccatggngtttgggctgagtcgttcgggtttttcctcgttgtcttacttttaaaggcggttgtccgagtgcctagggtcgcaggtcgtgggtgggaggtcggtgggggagcgtcggcccgaggccgtgggacggtcccgaagtacctctacctgtactagtctctggtacttcgtaaccttaggttactatgcctancggccgtaccggtcgggcccggccggtcgtaccgaggtccgggtaacggggtcgtaggggtagggttgggtacggtactaaggtttaacctagtacccgtaagtagggaacggttaggggaaacggtaacctaaacggttaaaccgttacccggtaacggtaccgtaccggttaaccggtcccgggtaaacgggtaacgggtacccgtaccttaccctaaccgtaccttcccgaacgaaaccgtaaaccgtaacgttaaacctaaaccgaaccgaactacggtcgtaactcgtaactacgaagaactaccgaacncgtacgtaacggagacggtacggtacggaccggaacgtcggttacggaagtttacggttactttagggcggttagggacgggtaaagtacggtaaaggtcggggtaacgttacggggttaaacgtaacggggttttaaaccgggg

SEQ ID NO: 230340 - DNA, 674 bp, Homo sapiens
  misc_feature: GYAE6OF01CUZKC.3.4.A04.1.454.CMB.1.raw
  modified_base (159)..(159): a, c, t, g, unknown or other
  misc_feature (159)..(159): n is a, c, g, or t
  modified_base (175)..(175): a, c, t, g, unknown or other
  misc_feature (175)..(175): n is a, c, g, or t
  modified_base (179)..(179): a, c, t, g, unknown or other
  misc_feature (179)..(179): n is a, c, g, or t
  modified_base (248)..(248): a, c, t, g, unknown or other
  misc_feature (248)..(248): n is a, c, g, or t
  modified_base (256)..(256): a, c, t, g, unknown or other
  misc_feature (256)..(256): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcgtgggttttccncgttgctcttttaagnggtntccagtgccaggtgcagctgggtggagtcgtgggggagcgtggcccagcctgggacgtccaggactccncctgtacngtctctggattcaccgttaggttactatgctatgcacgtgggtcccgccggctccgaggcgaggggctgggagtggggtggcgtagttatatcccatcgagtcgggaggtacaagttaaacgccctacggcgacgtaccgtacggtacgggaacgggtaccgtaacgttccaaccctacttcctaccgaaggaacgtacctaaacgttacccgaaacgaaccgtacgtccgtaacgtattacgtacgtaactaaacgtcgaaaccgacgtacccgagtaacggacgtacgtaggaaccggaccgtacgggtaccgtttaggtacggtttacgttaacgtttgggtacgggtaaccggaggtacgtaacgggttaggtaagggttcgggggttaacgtaacggttttaaaacccggggg

SEQ ID NO: 230341 - DNA, 809 bp, Homo sapiens
  misc_feature: GYAE6OF01CBCWL.3.4.A04.1.454.CMB.1.raw
  modified_base (372)..(372): a, c, t, g, unknown or other
  misc_feature (372)..(372): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttggctggagcttgggttttcctcgttgctcgttttaagaggtgtccagtgccaggtgcagcgtggtggagtcgtgggggagcgtcggccagccgtggggacggtcccgaggtaacctctccgtgtacagttctcgtggacttcaccgttaggttactatgtctagtcgcgtacgtcgggtccgccgttgacctccgagggcgaagggcgtgggaggtggggtcggactagttaanactcccgtaagtgaagtggaacggtacgtaaacgtaaaacgttcccaacggacccgtaaggaacccgttaccggtaacgggaaaccggggttccccgtaaacggtttacccaacccgttaacgttaacccgttaccccgaaaacggtaaaccggtaaaccgtaaaaccctttaacccgaaaaacggtaaaacccgtaaccggtaccgtttaacggttaaacctttacgtaacgtaacgtaaaaacgttaccggaaaaccgtacgtacccgtaagggtaacgaacggtaccgttaaggaaccgggtaaaccggtacgggttaccggttaacggtttacgggtttaaacctttacgggttacggtacgggtaaggtaacgggtaaacggtaaaggttagggttaacgggttacgggggttaaccggtttaaaaaccggg

SEQ ID NO: 230342 - DNA, 945 bp, Homo sapiens
  misc_feature: GYAE6OF01D9OEB.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactacaccagtggtaggtttgggctgagtcgtttgggttttcctcgtttgtctttacgttttaaggtagggttcgtaccgtagtcgaccgagggtgcgagtcgtggtgggtacggtcgggtaggggggaggtcgggtccggacccgacgggtccgtacggggggaccgtacccggaacggtaacccttccgttaccgttacggttaaccgtacgttcgtttaccgttagggtaaccttttaccttaaccggttttaacggtttaacttaacgttcgtacgttataccggccggttaccgggtccgggggtccccgggcccgggtaccgtaacccgggtaacggggtaaccgggtaacgggggttccggttaagggggtacgggggttggggtacgggtaacgttaaacgttttacgtaccgttaccgtaaggtaggtaacgggtaggggtaacggtaaccgtaaaaggttaaaccgttacccgtaacggaaaccgtacggtaccgtttaccggggagggtaaaccgggtaccgttaactacccgtaacccgtgtaacccgtacggaaagtaaccgtaaaccgttaaccgttaaacccggaaacgtaacgttaacccggtatttaacggttccttaacggtaactaaacgtaacgtaacgaacgtaacgaccgttaggacgacggttcggacggtaacgggtaaccgtcgggttacgtacggttaacgtttaaccgttagggtacggttaacgtaacgggaaggttaacgggtaggttacggtaagggttaaacccggggtttgttaaaccggttaaacggggg

SEQ ID NO: 230343 - DNA, 685 bp, Homo sapiens
  misc_feature: GYAE6OF01C6X4K.3.4.A04.1.454.CMB.1.raw
  modified_base (339)..(339): a, c, t, g, unknown or other
  misc_feature (339)..(339): n is a, c, g, or t
  modified_base (629)..(629): a, c, t, g, unknown or other
  misc_feature (629)..(629): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccagtggagtttgggctgagtcgttgggttttcctcgttgccttacgtttttaaggaggttcgtccgtaggtcgccgtagggtgcgaggtcgtgggtggaggttcgggtggggggaggccggtcggcccgaggtccgtaggggacggtcccgaggtaacctccgtccgtagtacagtctcgtgtacttactacgttagttactagtgcttancgtactacggtccggggtcccgccgggtctaccgaggacggaaggggtctgggaggtggggtgactaagttactacgtaccagtagacggtggacgtactaaagtaactccgtacgacgtacgtccggtacgtagggaaccgggtctacttaccactacgtcgtaacgaggtaactaactaactacgaaacggactacggtacttagtaacgttcaacgaactaaagtgaaccgcggtaccgtagaacgcgtaccgaggaacggaacgtcggcgttaggtagtaacgttngggtagaacggtaaggtacgtaggtagggcggtttacggaagttagttaaacgggg

SEQ ID NO: 230344 - DNA, 616 bp, Homo sapiens
  misc_feature: GYAE6OF01C2CBB.3.4.A04.1.454.CMB.1.raw
  modified_base (353)..(353): a, c, t, g, unknown or other
  misc_feature (353)..(353): n is a, c, g, or t
  modified_base (385)..(385): a, c, t, g, unknown or other
  misc_feature (385)..(385): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctggagcttgggttttcctcgttgcttcttttaagaggtgtccagtgccagggtgcagctgggtggagtcgtgggggaggcggtggcccaggccgtggggacggtcccgaggaacctcctccgtgtacagtctctaggtattcaccgtttaggttactatgctatgctacgtcgggtcccgccggctcgaggacgaggggctggaggtgggngctagttatctccatgagtggagcagtaaacnccgacgcgacgactcggtaggacggcgtactaccacctactccgtacaacgagaaactaacgttaccaacgacacgtcgttagtactactgaacaacgtacgaacacgtccgtagtaacgacgtacgtggaacggtaaccgtacgggtcttaggttaggttacgttaccggttggtacgacggtaaggagtacggtaggtaggttacgggtaacgttagttaaaacggggg

SEQ ID NO: 230345 - DNA, 953 bp, Homo sapiens
  misc_feature: GYAE6OF01EEEZK.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggaggtttgggctggagtcgttgggtttttcctcgtttgtcttcgtttttaaggaggttgtccaggttcgccgagggtgcgagtcgtgggtgggaggtcggtgggggagcggtcggcccaggtccgtagggacggtcccgaggaacttcgtctagtacagttctcgtggtacttctaaccgtttagttacctagtgtcttaagtgaccgtacgtcggggttcccggcccgggtctacccggagggaccggtaaggggccgttaggggtacgggtggggtacggtacgttaaggttacttaacgtcccgtaagtcggtagtacgggacggtaccgtaaaggttaaacccgtcccgtaacggactaacgggttacccgtacccggggtaaggtaacccggggtacccgttaaccgttaaccctaacccgtaaccgttcccgttaacccgaaacggtaaacggtaaaacccgtaaaccgttaaacccgaaaaccggtaaacccgttaacccggttacgtttacggtttaaccgttaaccgttaacggtaaacctaaaacggttaaccggaaaaccggtaaccgttaccgtaagggtaaacccggtaagggtacccggtaaacgggtaaccgggtaaacccggttaaccggggtccgtttaaacgggtttacggttttaaaacccgttttagggttaacccggggttaaggtaaccccggggttaaaagggttaaacccgggtttaacgggtttaaccgggttaacgggggttttaacgggggtttaaaacccgttaaaaggggtttttaaaaaaccccggggggg

SEQ ID NO: 230346 - DNA, 834 bp, Homo sapiens
  misc_feature: GYAE6OF01D3FXI.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcacagtggtagttgggctgagtcgttgggttttcctcgttgtctttacgttttaaggaggttgtccgagtcgccgaggtgcgagtcgtgggtggtaggtcgggtagggggagccggtccggacccgtacggcccgtggggaccggtaccccgtaacggtaaccttccgtcccgtaggtaccgtacgttccgttcgtacggttactttaccgttaaccgtttaaggtttacttacgtagtacttagtcgactaccggtccggggtcccggccgggtcctaccggaacgggacgggtaacggggtcggtaggggtacgggttgggtacggtacgttaaggtttacctaaccgtaccgtaaggtacggtaaggtagggacggaactaaacgtaaaccgtaccgtaacgaccggaacggttacccggtcgggtaaacggtaccgggtaacccttacgttaacccgacctaccgttaccgtaaccgtaaacgaaacgtaaaccgtaaacgttaacccgaaacgtaaaccgtaccgtacgttacgttaacctcgtaacgtaaactaaacggtaacggaaaccctacggtacgtaggaacgacggtacggtacggaaccgtacgtacggttacgtacgttaagttacgttcggtaggacggaggtaagacggttaaggtggtaaccgggtttacgtcggtaaacggtttaaacggg

SEQ ID NO: 230347 - DNA, 562 bp, Homo sapiens
  misc_feature: GYAE6OF01AVH5Z.3.4.A04.1.454.CMB.1.raw
  modified_base (260)..(260): a, c, t, g, unknown or other
  misc_feature (260)..(260): n is a, c, g, or t
  modified_base (399)..(399): a, c, t, g, unknown or other
  misc_feature (399)..(399): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttcttttaagaggtgtccagtgccaggtgcagctggtggagtcgtgggggagcgtggcccagccgtgggacggtcccaggaacctctcctgtacngtctcgtggattcaccttaggttactatgctatgcacgtggtccgccgggctccgaggcgaaggggctgggagtgggtgctagttatactccatgatggagcaagtaactccagcagactcgagaacgggccatcaccntctcagagactaatcaagacacgctagtactctagacaaatcgaaacacgtccgtagaagcgtaccgtaggtacgaccgacggtctacgggttagttacgttacggtggttcgacggtaagaggtaatagggtaagttaggggtacgtaacgtttaaacgggg

SEQ ID NO: 230348 - DNA, 738 bp, Homo sapiens
  misc_feature: GYAE6OF01A2417.3.4.A04.1.454.CMB.1.raw
  modified_base (159)..(159): a, c, t, g, unknown or other
  misc_feature (159)..(159): n is a, c, g, or t
  modified_base (180)..(180): a, c, t, g, unknown or other
  misc_feature (180)..(180): n is a, c, g, or t
  modified_base (354)..(354): a, c, t, g, unknown or other
  misc_feature (354)..(354): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttccncgttgcttcttttaagaggtntccagtgccaggtgcagctgggtggagtcgtgggggagcgtcggcccagccgtgggacgtcccaggactctcctagtacagtctcgtggtactttccgaccgtttaggttacctatgtctagtgctacggtcgggtccgccgggtctccgagggcgaaggggctggaggtgggngactagttatctccgagtgagtagggagactaacgtaactccgtacgcacgtaccgtacggtagggaacggtccgtaacttacccgaaccgtactcccgtacccgaagtaaaccggtaacctaaaccttaacccgaaacgtaacccgtaccggtacttacggttaactccgtaacgtaaaccgtaaacgtacggaaacctaccggtacccgttaaggaacggtaacgtaccgggttaacggaacgggtaaccggtaccggggttcgtttaacgggtttaacgtttaaacgtttacgggtacggttaaccgggtaacgtaaacgggaaggttacggttaacggggtaagtttaccgggggttaagtaaacggttttaaaccgggg

SEQ ID NO: 230349 - DNA, 643 bp, Homo sapiens
  misc_feature: GYAE6OF01CHDL5.3.4.A04.1.454.CMB.1.raw
  modified_base (262)..(262): a, c, t, g, unknown or other
  misc_feature (262)..(262): n is a, c, g, or t
  modified_base (497)..(497): a, c, t, g, unknown or other
  misc_feature (497)..(497): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagtcttgggttttcctcgttgcttcttttaagaggtgtccagtgccaggtgcagctggtggagtcgtgggggagcgtggcccaggccgtggggacgtcccaggtacctctcctgtacngtctctggattcaccttaggtactatgctatgcacgtcgggtcccgccgggtctccgagggcgaaggggctgggaggtggggtggctagttatactcccatggagtgggaggctaagtaaactcccgtaacgcaagtaccgttccggtaggaacgggtccgtacttccgaacctacgtcctaccgagtaacgaacctaacttaccgaacgaacctacgtactacgtactacgtanaaccgtaaatacgaaccgacgtccgtaaggacgtaacgtcgtaggacggtaccgacggtcgttaggttacgttacgttacgttcggtcggacgggtaagacgtaggttacggtaggtttacggggtacgtaaaggttaaaccgggg

SEQ ID NO: 230350 - DNA, 646 bp, Homo sapiens
  misc_feature: GYAE6OF01DBA8B.3.4.A04.1.454.CMB.1.raw
  modified_base (504)..(504): a, c, t, g, unknown or other
  misc_feature (504)..(504): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccagtggagtttgggctgagcttgggttttcctcggttgcttcttttaagaggtgtccagtgccaggtgcagcgtgggtggaggtcggtggggggaggccggtcggccccaggcccgtggggacggtccccgaaggaacctctcctagtacagtctctggattctaccttaggttactatgctatgctacgtcgggtccgcggctcgaggcgaggggtctgggaggttgggtggactagttactactccagtgagtgggaacggactaaggtaactcccgtaagccgaacgtacgttccggtaggaacgggtccgtattacccacctactccaccgacgaacgactaaataccgaacgaacacgctagtactcgtanaactaagcgaacaggcctagggacgagcgtacggaacggaccgtacgggtcttaggtacgtttaacgttcgcggtttcgggacggtaaggacgtaggttaagggtacggttacggggtaaacggttagtttaaaacccgggg

SEQ ID NO: 230351 - DNA, 781 bp, Homo sapiens
  misc_feature: GYAE6OF01EGEHP.3.4.A04.1.454.CMB.1.raw
  modified_base (489)..(489): a, c, t, g, unknown or other
  misc_feature (489)..(489): n is a, c, g, or t
  modified_base (673)..(673): a, c, t, g, unknown or other
  misc_feature (673)..(673): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatgggagtttgggctgagtcttgggttttcctcgttgcttcttttaagaggtgtccagtgccgaggtgcagcgtgggtggaggtcgtggggggagcggtcggccccaggccgtggggacggtcccaggaacctcgtcctagtacagtctacgtggtacttctaaccgttaaggtttacctaagtgtacgttactcggtacctaccggttcggggtccccggccggggtccgttaccgaacggggtcggtaacggggggtaccggttggggtaagggttcgggggtcgggtactaaaccgtttaacgttacgtaccccgaaagttgggaacgtagggaaacggtactaaacggttaaaacncccgtaaacgacccgtaacggtaacggttacccgggtacggtaacggggtaccctaaccgttaccgaaccctaacgtaaccgtacccgaaaggtaaaccgtaaccgtaaacttaaacccgaacgtaaccgtaacgtaccgttacgttaactacgtaacgtaaccgtaaaacgtcgtaaacccgnggaccgtaagtacggaggtacgtaacggaggtacgacgggttagtagtacgttacgttgaggtggagaaggtagtaggtagtagtagggttaacgtaggttaaacggg

SEQ ID NO: 230352 - DNA, 870 bp, Homo sapiens
  misc_feature: GYAE6OF01DPD3H.3.4.A04.1.454.CMB.1.raw
tcagagacgcactccacgaccggtgctcgatttagagtagtgatcgaggggagctctgggagacgagcccagcactggaagtcgccggtgtttccattcggtgatcatcactgaacacagaggactcaccagtggtagtttgggctggagtcgtttcgggtttttcctcgtttcgtctttacgtttttaaggaggttcgtccgaggttcgccgtagggtgcgaggtcgttgggtcgggaggttcggtggggggacggtccggtcgggccccgaggcccggttagggggaccggttaccccgaagggtaacccttccgttacccgttaggttaccgtacggtttccgttcggttacgggtactttaccgttaaccgttttaaggtttaccttagtcggtacttagtcgtaccgtaccgtccgggggttcccgccgggtctccgagggtacggaaggggtcgttagggacggttggggtggtactagttacgtactaccgtagtcggagtgggacgtacgtaaggttaacctccgtaacgacgtaacggtacgttaccgggtacggaacgggtccgtaacctttccgaacccgttacgtcccgtaacccggaaaggttaaccggtaaacttaaaccgtttaaacccgaaacggtaaacccgtaccgttaacgttacggttaaccttacgttaacgaaacgttaaaacgtacggaaacctccggtaccggtaagacgggtacgacggttacggaacggaccggtacggttacgttagggttaacgtttacgttacccgggttaggacggttacgaaacggtagtacgggttacggtaagggtttacgggttacgggttaaacgtttaacgggg

SEQ ID NO: 230353 - DNA, 689 bp, Homo sapiens
  misc_feature: GYAE6OF01EY5YF.3.4.A04.1.454.CMB.1.raw
tcagagacgcactccacgaccggtgctcgatttagagtagtgatcagggggatcaggactcctcagttcaccttctcacaatgaggctccctgctcagctcctggggctgctaatgctctgggtcccaggatccagtggggatgttgtgatgactcagtctccactctccctcgcccgtcacccttggacacgccggcctccatctcctgcaggtctagtcaaagcctactatacagtgagtacgaaactaccttacttagaagttggtttcagcagaggccaggaccaatcgtaccgaagggtccgtaccttaaattttaagttaaacggttttaccgtaaccgggtacttcggtcggggtaccccaaggacctaagtacttcgaacggcggtacgtagggtcgggtcgaaggggtcctacgttagtacttttaccaactacgtaagaaaactcgaaggacggaggggtgggaggtcgtaggaagggttagtttagggtttagggggttttaacttacggtgtacgtagttaggaaccgtaaggtacacgtaccggtccggtccgttaccggtaccggttacggacccggtaacgggtacgaaagggtacgtaaaataaccgaaacggtacgtacggtacggcctacggacccaacgtaccgttacgttactacttctgttacccccg

SEQ ID NO: 230354 - DNA, 588 bp, Homo sapiens
  misc_feature: GYAE6OF01BGGX5.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcgttgggttttcctcgttgcttcttttaagaggtgtccagtgccaggtgcagcgtggtggagtcgtgggggaggcggtcggcccagccgtgggacgtcccaggactcgtctgtacagtctctggattccacttaggttactatgtctatgctacgtcgggtccggccgggcgtccgaggcgaaggggctgggagtggggtggctagttactactcccagtggagtgggagacgaagtaaactccgtacgacacgaccgtcggtaggaacggcgatccaccatcctacagacgaactaactaccaagaccgacgcgtagtactctacgactaatacgaactaggacctaggacgacggacgtaggaacggacgacggtagtcggttagttagttcgtaggtcgacgagacgtagtagtaaggtgggtacgtaaggttaacggg

SEQ ID NO: 230355 - DNA, 589 bp, Homo sapiens
  misc_feature: GYAE6OF01AVSHM.3.4.A04.1.454.CMB.1.raw
  modified_base (157)..(157): a, c, t, g, unknown or other
  misc_feature (157)..(157): n is a, c, g, or t
  modified_base (206)..(206): a, c, t, g, unknown or other
  misc_feature (206)..(206): n is a, c, g, or t
  modified_base (521)..(521): a, c, t, g, unknown or other
  misc_feature (521)..(521): n is a, c, g, or t
tcagagacgcactccacgaccggtgctcgatttagagtagtgatcagggggagctctgggagacgagcccagcactggaagtcgccggtgtttccattcggtgatcatcactgaacacagaggactcaccatggagtttgggctgagcgtggtttcncgttgctctttaagagtgtcagtgccaggtgcagcgtgggtggagtcgngggggacgcggtcgggcccaggccgtggggacggtcccgaggactctccgtgtacagtcttcgtggtacttccacgtttaggttactagtgactagtgcacgtcgggtccgccgggctccgaggcgaaggggtctagggagtgggtcgcgtaagttataccgtccagtcgagtgggagactaagtaactccgtaacgacgtagaccgtcggtaggacgggaccgtattcacctacgtctacgagaacgtacaacttacaacgacacgactatagtcagtacaaagtcgaacgtacgctaggacaggtcagggaanaccgacgtagtgttacgtagtactggttcgacgagacgtacgtggtagtacggttcgaagttaacggg

SEQ ID NO: 230356 - DNA, 629 bp, Homo sapiens
  misc_feature: GYAE6OF01D2RLB.3.4.A04.1.454.CMB.1.raw
  modified_base (180)..(180): a, c, t, g, unknown or other
  misc_feature (180)..(180): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttcttttaagaggtntccagtgccaggtgcagctggtggagtcgtgggggagcgtggcccagccgtgggacgtcccaggactctctgtacagtctctggattcaccttaggttactatgctatgctacgtcgggtccgccgggctccgaggcgaaggggctgggagtgggtgctagttatctccagtgagtgggacggcaaagttaaactcccgtacgacacgaccgttaccgagggaacgggtcccgtacttaccaacccgtattcccgtacccgtaagaacgtaacctaaacgttacccgaaagtaaccaacggtcttacggttactcgttacgaactaaacgtacgaaaccgtacggaccgtagaacggacgtacgtagggaacggtaccgacggtcgtagttacgtaactttacgtggtgacgagtaagtagttaggaggttcggtcgtaagttaacggg

SEQ ID NO: 230357 - DNA, 717 bp, Homo sapiens
  misc_feature: GYAE6OF01DLGS9.3.4.A04.1.454.CMB.1.raw
  modified_base (268)..(268): a, c, t, g, unknown or other
  misc_feature (268)..(268): n is a, c, g, or t
  modified_base (304)..(304): a, c, t, g, unknown or other
  misc_feature (304)..(304): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctggagcttggggttttcctcggttgcttactttttaagaggttgtcccagtcgccgaggtgcagcgtggtggagtcggtgggggagcgtggccagccgtgggacgtcccaggtactctcctgtacngtctcgtggtacttctacttaggttactatgtactngccacgtcgggtccgacggctccgacggacgacggggtctgggaggttcgggtgcgtaagttactactccgtagtagtagtaggacggacgtaaacgttaaacctccgtaacgacgtaacgtaccgttccggtaacgggaacggtcccgaacgtttacccgacctaactccgtaaccaggtaacaacctaacgttaccgaacgaaacctacgtacgtcgtaacgttcgtagtaaaccgtaagtacggaaaccgtacgtaccgtaaggtaaggtactaacgggtacgggtaaccgaaccggtaccgggtacgtttaggtaacgtttaacgttacgggtacggttcgggaaccggaaggacggttaacggttacgggtaacggttcgggggtaaacgtttaagttaaaccggggg

SEQ ID NO: 230358 - DNA, 728 bp, Homo sapiens
  misc_feature: GYAE6OF01DPW45.3.4.A04.1.454.CMB.1.raw
  modified_base (184)..(184): a, c, t, g, unknown or other
  misc_feature (184)..(184): n is a, c, g, or t
  modified_base (201)..(201): a, c, t, g, unknown or other
  misc_feature (201)..(201): n is a, c, g, or t
  modified_base (443)..(443): a, c, t, g, unknown or other
  misc_feature (443)..(443): n is a, c, g, or t
  modified_base (513)..(513): a, c, t, g, unknown or other
  misc_feature (513)..(513): n is a, c, g, or t
tcagagacgcactccacgaccggtgctcgatttagagtagtgatcagggggatcaggactcctcagttcaccttctcacaatgaggctccctgctcagctccgtgggctgctaatgctcgtgggtccaggatccgaggtggggattgttgtgatacgactcacgtcctccactccctccgttcncccgtctaccgtggacncgccgcctccatcctctgacgtgtctagtacaacgtcctacgtaatacgaggtacgtaagtaacgaaaccttaaccgttacgtttagttaacgtttcggttacagacgaacggacgacccggtaacgacctaacgtaccgaccgaaagggtccgtaaacttttaaagttttaacggttaacgtttaccggaaccgtcgttacggtcgggtaacccaggtaactagtacctcggcggtacggngtacgggtgccgaaggacttactgtaccttaacgacgttaactaagaaacgtcgacggtaggtaacgggngggtacgtacgtagggtaggtttacggtttagggttttagttacgttcgtacgtagtacgtaggtaacgtaacgacgtccgtaacggtcccgtaccggtaccggtccggtacccggtaccgacggaacggtaacgtaagtaaacgaacggtaaaccggtgtaggcctaggacctacgttaccagtttaccgtattccgttactaccgtttccccg

SEQ ID NO: 230359 - DNA, 813 bp, Homo sapiens
  misc_feature: GYAE6OF01D7X4W.3.4.A04.1.454.CMB.1.raw
  modified_base (322)..(322): a, c, t, g, unknown or other
  misc_feature (322)..(322): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagtcgttgggtttttcctcgttgcttacgtttttaaggaggttgtccgagtcgccgaggtgcagtcgtgggtggagtcggtgggggagcggtcggcccgagtccgtgggacgtacccaggtacctctcctagtacagtctcgtggtacttcctaccgtttaggttactagtgacttancgcctacggtcgggcccgccgggtcctccgagggacgaaggggcgtgggtaggtgggtcggacgttaagttactacgtaccgagtggaggtacggaacggataaacgttaaacctccgtaaccggactaacggtaccgtaccgggttaagggaaaccgggtcccttaagttacccgaaccctagttacccgacccggaaagtaaccggtaaacctaaaccgttaacccgaaaccggtaaaccctacccggtaacgtttaggtaaccttacccgggttaacaaaccgtaaaaacgttacccggaaaaccgtaacggtacccgttaaacgggtaaacggtaccgggtaaccggtaacggggtaaacccggaaccgggtaaccggtaccgtttagggttaacgttaaacgtttacggacgggtacggtaacggaacggtaaggttacggacgggttaagggtacggggtttaacgtaaacggttaaaccggggg

SEQ ID NO: 230360 - DNA, 667 bp, Homo sapiens
  misc_feature: GYAE6OF01C7IQY.3.4.A04.1.454.CMB.1.raw
  modified_base (195)..(195): a, c, t, g, unknown or other
  misc_feature (195)..(195): n is a, c, g, or t
  modified_base (595)..(595): a, c, t, g, unknown or other
  misc_feature (595)..(595): n is a, c, g, or t
  modified_base (629)..(629): a, c, t, g, unknown or other
  misc_feature (629)..(629): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatgggagtttgggctgagcttgggttttcctcgttgcttcttttaagaggtgtccagtgccaggtncagtcgtggtggagtcgtagggggagcgtcggcccagccgtgggacgtcccaggtacctctcctgtacagtctctaggtacttccgtaacctttaggttactatactatgccgacggttcggggtcccggcccggtcctccgaggccgaaggggtcgtgggacggtggggttggacgtagtttaactacgtacccgtaagttggacgttaggggacgtaacgaacgtttaaaactcccgtagacgacgtacctcgggtaacgaacgggtacctattaccacctacgtacctaccgaagtacaaccgtaacgttaaaccgaacgaacgacggtaccttcgtaacgtcttacgactaaactacgaaacgacgtaccgtgtacgagccgtaggagtacgacgngttacgtagtacgttacgtgcgacggtaagtagngtacggttaggtgggtaaactggttaacggtaaagggg

SEQ ID NO: 230361 - DNA, 802 bp, Homo sapiens
  misc_feature: GYAE6OF01EX0P6.3.4.A04.1.454.CMB.1.raw
  modified_base (185)..(185): a, c, t, g, unknown or other
  misc_feature (185)..(185): n is a, c, g, or t
  modified_base (742)..(742): a, c, t, g, unknown or other
  misc_feature (742)..(742): n is a, c, g, or t
  modified_base (787)..(787): a, c, t, g, unknown or other
  misc_feature (787)..(787): n is a, c, g, or t
tcagagacgcactccacgaccggtgctcgatttagagtagtgatcaggggagctctgggagacgagcccagcacgtggaagtcgccggtgtttccattcggtgatcatcactgaacacagaggactcacatggagtttggctgagtcgttgggttttcctcggttgtctttacgtttttaaaggngggtcgtcccgaggtcgccgtagggtgcgaggcgttggggtggtaggttcgggtgggggggtacggccggttcgggccccgaagggtcccggttagggggacggttaccccgaagggtaaccctcgttcccgttaggtacctcgttcctcgtacggtactttaccgtaaccgtttaaggtttaacctagttgacttaaggtgtaccgtaccgggttcggggtccccgggccgggtccgtaccggacgggaccggtaaaggggggtccgttaaggggttggggttcgggggttacggcttaaaggtttaactaccgttaccgaaggtacggtaggttacggggaagtacgtaaaggttaaacctaccgtaaccgcgaaccggtacgtccggtaagggaaccgggttcgtaacttccgtaactacgttaccgtaccaacggtaacgaacctaaacgtaaccgaaaacggtaccggtaacctgttacggtaacttcgaacgtaacaaatcgaaacgacgtacgtagacggcgagtacggacgaacggtcgtacgttagtnttacgttagtggtcgaggaatacggtagacggttaagtacgggtntaaaggttaaacggg

SEQ ID NO: 230362 - DNA, 727 bp, Homo sapiens
  misc_feature: GYAE6OF01DS01J.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttcttttaagaggtgtccagtgccaggtgcagctggtggagtcgtggggagcgtggcccagcctgggacgtcccaggactctcctgtacagtctctggattcaccttaggttactatgctatgcacgtgggtccgcgggctccgaggcgaaggggctgggagtggggtggctaggttatatccgagtggatcgggagccaagtaaactcctaacgctaagacgtcggtaggaacgggtccgtaacttccgacctaacgtcctaccgaaggaacgtaacctaaattaccccgaaaggtaaccgaaccggtacgttacggttaacttacgtacgtaaccgtaaaagttaacggaaaccgtaaccggtacccgttaagggtaacggtaacggttaccggtagggtaaaccgggtaacccgttaacccggggtaccgtttacgggtttacggtttaaaccgttttaacggttacgggttacggtaacccgggtaaaggtaacccgggttaagtttaacgggacggttttacgggggtaccggttaaacggtttaaaaacccggggg

SEQ ID NO: 230363 - DNA, 802 bp, Homo sapiens
  misc_feature: GYAE6OF01C1MIG.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttcttttaagaggtgtccagtgccaggtgcagcgtggtggagtcgtgggggagcgtcggcccagccgtggggacgtcccaggtaacctctacctgtacagtctcgtaggtacttactaaccgttaggtttactacgtgtactatcgacctacggtcgggggtccccgccgggcctacccggaaggccggaagggggtcgtagggacggttgggggtcgacgtaacggtttactacgttacccgtaagttggaagttggggaacggtacgtaaaacggtttaaaacctccccggttaacggacctaaacgggtacccgttaacccgggttagggaaaccgggggtccctaaacgtttacccgaacccgttaacgttccccgtaacccgaaacggtaaaccgtaaaaccgttaaaaccgtttaaccccgaaaaccggtaaacccgtaccgggtaaccttaaggttaacctttaccgtaacgtaaactaaaacggtaacgtaaaccgacggtacccgtaggaacggtacggtacgtacgggaacgggtaacccgtacgggtaccttaggtttaacgtagtttacgtacgggttgaccggtagtagtacgtaggtaggtacgggtacgtaaagttaacggg

SEQ ID NO: 230364 - DNA, 778 bp, Homo sapiens
  misc_feature: GYAE6OF01A4HMI.3.4.A04.1.454.CMB.1.raw
  modified_base (308)..(308): a, c, t, g, unknown or other
  misc_feature (308)..(308): n is a, c, g, or t
  modified_base (342)..(342): a, c, t, g, unknown or other
  misc_feature (342)..(342): n is a, c, g, or t
  modified_base (389)..(389): a, c, t, g, unknown or other
  misc_feature (389)..(389): n is a, c, g, or t
tcagagacgcactccacgaccggtgctcgatttagagtagtgatcagggagctcgtgggagacgagcccagcactggaagtcgccggtgtttccattcggtgatcatcactgaacacagaggactcaccagtggagtttgggctgagtcgttgggttttcctcggttgctttacgtttttaaaggagggttcgtccctaggttcgcccggtagggtcgccgtaggtcgttgggtggaggttcggtggggggagccggtcgggcccctaggccgtggggaccgtcccgaggtaccttctccgtagtacngtctcgtgacttcgtaccgttaggttactatgtntatgtctacgtcggtccgccggctccgaggcgaacgggtcgtacggnggtagggtcgtacgtaggttactacgtacccgtagtcggtacgtagggacggtaacgtaaaggtaacgtccgttaacggaccgtacggtaaccggtccggtagggtaacccggtaccgtacgttaccgaaccgtacttccgtaccctaagggtaaactaacccgtaattaacccggaaacgtaaccgtacgtaccgttacgtaactacgtacgtaacgaaacgttagaaccggtacaccgttacggaacgagtaaccgtaggaaccgtaccggtacgtacggtacgttaggttaaccgtttacggacggttacggtaaccggaaggttacgggtaaggttacggtaaccgggttaggggttaaacccgttacgggtttaaaaaccgggg

SEQ ID NO: 230365 - DNA, 604 bp, Homo sapiens
  misc_feature: GYAE6OF01DTGE8.3.4.A04.1.454.CMB.1.raw
  modified_base (266)..(266): a, c, t, g, unknown or other
  misc_feature (266)..(266): n is a, c, g, or t
  modified_base (353)..(353): a, c, t, g, unknown or other
  misc_feature (353)..(353): n is a, c, g, or t
  modified_base (476)..(476): a, c, t, g, unknown or other
  misc_feature (476)..(476): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatgggagtttgggctgagcttgggttttcctcgttgcttcttttaagaggttgtccagtgccagggtgcagctggtggagtcgtgggggagcggtggcccagccgtgggacgtcccaggactctcctgtacagtctntggtacttcaccgttagtactatgctatgctacgtcgggtccgccgggcctacgaggcgaaggggctgggagtgggtgactagttanactccgatgagtggacgactaagtaaactcctaacgctacgaccgtcggtaggaacgggcctattaccacctatcctacgagacgaactaacgtaccaacgaactacgtactagtactcgtanactaaactacgaacgtacgtacgtagaagtacgacgtaggaacggaacgtacggacgttggtacgttaacttacggtggtcggacgtaagaacgtagtaggtaggtacgggtacgtaagttaaacggg

SEQ ID NO: 230366 - DNA, 791 bp, Homo sapiens
  misc_feature: GYAE6OF01AUH4Y.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccagtggagtttgggctgagtcttgggttttcctcgttgtcttcgttttaaggaggttgtccaggtcgccgtagggtgctaggtcgttgggtggtaggtccggtggggggacgtcggtcggcccgaggtcccggtaggggacgtccccgaaggtacctcgtcctagtacgtgttctcgttggtaactttccgtaccgtttaaggttacctattgtactagtcgaccgtacggttccggggtcccggcccgggtctacccggagggaccggtaaacggggtcgttaggggacggttcggggtaggaccgttaacggtttacgtaacccgttaccgagttacgggaagttacggggaaggtactaacggtaacctaccgtacgtaccgacgtaccggtacgtaggacgggtaccctagtacccacctacgtaccgtaccgaagtaaccgtaacgtacctaaccgaaacgtaccgtacgtaccgttagtacgtacgtacgtaaacgttaaacggtaccgtaaaccgtacgtaccgtaagggtaccggtaacggtacgaacgggacccggtaggtacggttccgttaaggttacgttacgttacgtagggtacgacggtaggtaacgtacgttagggtagttaacgggtcgtaagggtttaaaccggg

SEQ ID NO: 230367 - DNA, 843 bp, Homo sapiens
  misc_feature: GYAE6OF01COBDA.3.4.A04.1.454.CMB.1.raw
  modified_base (715)..(715): a, c, t, g, unknown or other
  misc_feature (715)..(715): n is a, c, g, or t
  modified_base (778)..(778): a, c, t, g, unknown or other
  misc_feature (778)..(778): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttggctgagtcttgggttttcctcgttgcttacgtttttaaggaggtgtccagtcgccgaggtgcgaggcgtgggtaggtacggtcgggtagggggcggtcgggtccggaccgaccggtccgggtacggggtacccggtacccggaaacggttacccttccgtccgttacggtaaccgttcgttccgttaccggttaggttacctttcccgttaaaaccggttttacggtttaaccttagttcgtacgttagtccggaccggttccgggttcccgggggtccccggcccgggttccacccggggtaacggaccgggggaacggggttcgggtagggggttacgggttaggggtcggtaagttacgtttaactaccgtaccgtagtacggtaacggagggtacgaacgttaaactaaccgtacgtaaccgtacgtaacggtacccgtcggaagggaccggtacttaaccgtacaccgtaccgtacccgaacgtaacgtaacgtaacgtaacctaaccgaacgtaaccgtcgtacgtataccgttacgtagaacgtaagtaacgaacgtccgacggtaagnggtacgtacgacggacgaaccgggtcgtaggtacgtttaacgtttacggttacggttacgggntaacgggtacggtaaggttaggtacggttacgggttacgggttaccgttaaagggtttaaccggg

SEQ ID NO: 230368 - DNA, 1087 bp, Homo sapiens
  misc_feature: GYAE6OF01ASUOE.3.4.A04.1.454.CMB.1.raw
  modified_base (541)..(541): a, c, t, g, unknown or other
  misc_feature (541)..(541): n is a, c, g, or t
tcagagacgcactccacgaccggtgctcgatttagagtagtgatcgagggagctctgggagacgagcccagcactggaagtcgccggtgtttccattcggtgatcatcactgaacacgagaggactcaccagtggtaggttgggctggagtcgttgggttttcctgttgtcttacgttttaagaggttgtccaggtcgaccgaggtcgacgcgtcgtgggtaggtacgggttcgggttacggggggacggtccggtaccgggtcccccgtacgggtcccggttacggggggtaccggttacccccgtaacgggtaaacccttccgtttcccggttaacggttaaccgacggtttcccgttacgggttcggttaaccgttttacccggttaacccgttttaaagggtttacccttaagttcggtaccttaacggtcggacccggtaccgggttcccggggggtccccggtaccggggcccttaaccgggacggggtacccgggtaaagggggtccggttacggggtagggtttaccgggggnggttaaccgttaaggtttaccgtacccgtacccgtaggtggtaacggtagggtaaacgtacgtaaacggtttaaacgtacccgtacggtaccgtaccggttaccgggtacggtaaacgggtaacccgggtaccgttaactcccggtaaaccttccgttacccgtaaaccgggtaaacgtaacccgtaaaacccgttaaccgttaaacccgtaaacgggtaacccgttaaaccggtaccgtttacgggttaacccgttaccggtaacctaaacccggttaaaacgggtaaaccccgttaaccgggtaccccggaaccgggttaaacgggtaacccgggttaaccggttaaccggggaaccgggtaaccccggtaaaaccgggttccttaaacggggttttaaaccgtaccgggttttaaacgtaccgggttttaaccggggtacggttaaaccggggttacggttaaacccggtttaagggtttacccgggggtaaggttttaacgggggtaaaccggtttaaaacgggttttaaaccccggggggg

SEQ ID NO: 230369 - DNA, 665 bp, Homo sapiens
  misc_feature: GYAE6OF01BF6WD.3.4.A04.1.454.CMB.1.raw
  modified_base (264)..(264): a, c, t, g, unknown or other
  misc_feature (264)..(264): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttcttttaagaggtgtccagtgccaggtgcagcgtgggtggagtcgtgggggagcgtcggcccaggccgtggggacgtcccgaggacctctcctgtacngtctcgtgtacttctaccaggtttttttttttacatgtctatgacgtacgtcgggtccggccggccgtccgacggacggaacggggtcggtgggtaggtgggtggtacgtagttatacgtcctagtgtagtacgggaggtacgtaagtaacgtaccgtaacgtacgacgtaccgtaccggtacggaacgggtaccgtaacgttaccgacctactaccgtaccgaacgaacgtaactaaacgtaaccgaaacgaaccgtacgtacgtacgtactacgtacgtaactaacgtacgaacgtacgtacgtacgaagacgacgtacgacggacgacggtcgtagttacgttacgttagtaggtcggacgagagtagtaggtaggtacggtacgtaagttaaacggg

SEQ ID NO: 230370 - DNA, 717 bp, Homo sapiens
  misc_feature: GYAE6OF01A9K23.3.4.A04.1.454.CMB.1.raw
  modified_base (160)..(160): a, c, t, g, unknown or other
  misc_feature (160)..(160): n is a, c, g, or t
  modified_base (177)..(177): a, c, t, g, unknown or other
  misc_feature (177)..(177): n is a, c, g, or t
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagtcttgggttttccncgttgcttcttttaagnggtgtccagtgccaggtncagcgtggnggagtcgtgggggagcgtggcccaggccgtggggacgtcccaggacctctccgtggtacagtctcgtggacttcaccgttaggttactatgtactagtggactacgtgggtccgccgggctaccggaggccgaagggggcctagggacggtggggtacggtacgtaaggtttactacgtccgaagttggaacggtgggaacggtactaaagtaaacgtcccgtaacggcgtaacggtacttacccgggtaaggaacggggtacccgttaacgttccgaaccgtacgttaccgtacccggaagtaccgaaacctaaacgttaacccgaaacgaaccgtacgtacgttacggtaactcgtaacgaacctaagtaccgtaaccgacgtacccgtagacggacgtaaccgtacggaaacggtaccgaccggttaggttaacggtacggttaacgttacgttaggcggtaacgaggtaagtacggtacggtaaggtcgggtaacgtaggtaaacgggg

SEQ ID NO: 230371 - DNA, 1013 bp, Homo sapiens
  misc_feature: GYAE6OF01BD9YV.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccagtggagtttgggctgagtcgttcgggtttttcctcgttcgtactttacgttttaaggaggttcgttaccgaggttcgcccgtagggtcgaccgtaggtcggttgggtacgggtacgggttccggggtacgggggggtacggtccgggtaccggtaccccgacgggtcccgggttacgggggacccggtaccccggtaacgggtaaccctttccgtacccggttaacggttaaccgtacgggtttccttaccggttacggggttaacctttttaccccgttaaaccggtttttaacgggtttaacctttacggtacggtttaccttagggttccccggtaccgggttacccgggtttcccggggggtacccccgggtaccccgggttccgtaaccccggggtacgggggtaaccgggaaaccggggggtttacggttcgggggtaacgggggttttcgggggttaacggtaccgtttaagggtttaaccctaccggttccgaaggttcgggttaacggtaggggtaaccggtaattaaacccgggttaaacccgttcccgttaacggacccgttacggaccccggtttacgggaccgggtaaaccggtccgtaccgttacccgtaccgtaccgttaccgtaaccggaacggtaacctaaccgttaaaccgttaacccgtaaaccgtaaccggtaccgtaccgtttacgtacgtttaaccgaacggtactaaacggtacgtaacgtacggtaccggtagtaccgtagtacgggtacgtaacgggacggttccggtaacgttcggttaacgttagttacgggtaggtcggtacgggtagtacgtagggttacgttacgggttaggtacggttacccggttaagggg

SEQ ID NO: 230372 - DNA, 690 bp, Homo sapiens
  misc_feature: GYAE6OF01C2462.3.4.A04.1.454.CMB.1.raw
  modified_base (296)..(296): a, c, t, g, unknown or other
  misc_feature (296)..(296): n is a, c, g, or t
  modified_base (408)..(408): a, c, t, g, unknown or other
  misc_feature (408)..(408): n is a, c, g, or t
  modified_base (412)..(412): a, c, t, g, unknown or other
  misc_feature (412)..(412): n is a, c, g, or t
  modified_base (426)..(426): a, c, t, g, unknown or other
  misc_feature (426)..(426): n is a, c, g, or t
  modified_base (431)..(431): a, c, t, g, unknown or other
  misc_feature (431)..(431): n is a, c, g, or t
  modified_base (438)..(438): a, c, t, g, unknown or other
  misc_feature (438)..(438): n is a, c, g, or t
  modified_base (452)..(452): a, c, t, g, unknown or other
  misc_feature (452)..(452): n is a, c, g, or t
  modified_base (564)..(564): a, c, t, g, unknown or other
  misc_feature (564)..(564): n is a, c, g, or t
  modified_base (575)..(575): a, c, t, g, unknown or other
  misc_feature (575)..(575): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagtcgttgggtttttcctcgttgtcttcttttaagaggtgtccgagtgccaggtgcgagcgtgggtggacggtcggtagggggacggcggtccggccccgaaggcccggtggggaaccggtcccgaacggtaaccttcgtcccgtagtaccngtacttcgtggtacttctaaccgtttaagttaacgtatgtctaatcgaccgtacggttccgggtcccggccgggccctccggaggtacgaacggggtcgtgggaggtcgggnggtntacggtatcgtccngtagngtacggngtactaacgtaacncctagactacggtacgtcggtaacggaacgggtcctaactccgacctacgtaccgtacgaacgtaactaacctaaactacccgaaacgtaacgaacccgtgtactacgttanacgaacgtaanaacgaactaacgcgtagagacacggtagaaccggtacgtacgccgttagtacggttctaaggttcggagtacggataacgtgtaaacggtggttaacggacgtaagttaaacggg

SEQ ID NO: 230373 - DNA, 756 bp, Homo sapiens
  misc_feature: GYAE6OF01DLWVK.3.4.A04.1.454.CMB.1.raw
  modified_base (113)..(113): a, c, t, g, unknown or other
  misc_feature (113)..(113): n is a, c, g, or t
  modified_base (179)..(179): a, c, t, g, unknown or other
  misc_feature (179)..(179): n is a, c, g, or t
tcagagacgcactccacgaccggtgctcgatttagagtagtgatcgaggggagctctgggagacgagcccagcactggaagtcgccggtgtttccattcggtgatcatcactnaacacagaggactcacagtggagtttgggctgagtcgttgggttttcctcgttgcttcttttaagnggtgtccagtgccaggtgcagcgtggtggagtcggtgggggagcgtcggcccaggccgtggggacgtcccgaaggtacctctcctagtacagtctcgtaggtacttactaaccgtttaggttactatgtacctatcgcgtacgtcgggtcccgccggtcctccgaggcggaagggtcgtgggaggtcgggtaggctaaggttatacgtaccgtgtacggagtaagggacggtactaaaggtaaacctccgttacgaccgtaacgtaacccgttccgggtaacgggtaacgggtacccgtaacttcccaaacccgttacttacccgtacgaaacgtaacgtaaaccttaaacgtaaccgaaataaccgtacgtagtaccgttatcctaaggtaaccaaagttaaacgaaccgtaacgtaccggtaggaacggacggtaacgggtcggaaacggtacccggaggttaccgtaggtttacgtttaaacggttacgttcgggtaaacgggtacggtaacggtagggttaaacggttacgggttagggtttaaaccgggaccggtttaacggttaaacgggg

SEQ ID NO: 230374 - DNA, 823 bp, Homo sapiens
  misc_feature: GYAE6OF01C5F2Q.3.4.A04.1.454.CMB.1.raw
tcagagacgcactccacgaccggtgctcgatttagagtagtgatcaggggagctctgggagacgagcccagcactggaagtcgccggtgttccattcggtgatcatcactgaacacagaggactcaccagtggaggtttgggctgaggtcttgggttttcctcgttgcttcgttttaagaggtgtccagtgccgtaggtgcagtcgtgggtggagtcggtggggggagcgtcgggcccagcgtaggggacggtcccgaggtaacctctccgtaggtacgtagtcgtcgtggtacttacctaccgttaggttacctagtgtacctagtcgtaccgtaccggtcggggtcccgtccggggttacccgacggggacgtaacgggggcgttggggaacgggttggggtacggtaccgttaaggttaactaccggttaccgtaagtacgggtaagtacggggtaaggaacgttaaacgttaaacgtacccgtaacggacgtaacgtaccggtacgggtacggtaaaccgggtacgtactaccgaacccgtaacgtccgtaaccgaaagggaaccctaaccttaaacgtaacccgaaaagtaacccgtaccggtacttaacggaactttacccgggaagtaaacgtaaaccgtacgggtaaaacacccgggttaccgaaacgggtaacgggaacctaccggggtagtaacccgggaaccgttacgggacgtttaccggaagtttaacccgttaaggtgggactaacgggtaagtacggttaacgagggttaccggtaagggtacgttaaaggtaaacccggttaggggg

SEQ ID NO: 230375 - DNA, 728 bp, Homo sapiens
  misc_feature: GYAE6OF01DYQSS.3.4.A04.1.454.CMB.1.raw
  modified_base (264)..(264): a, c, t, g, unknown or other
  misc_feature (264)..(264): n is a, c, g, or t
  modified_base (365)..(365): a, c, t, g, unknown or other
  misc_feature (365)..(365): n is a, c, g, or t
  modified_base (552)..(552): a, c, t, g, unknown or other
  misc_feature (552)..(552): n is a, c, g, or t
tcagagacgcactccacgaccggtgctcgatttagagtagtgatcaggggagctcgtgggagacgagcccagcactggaagtcgccggtgtttccattcggtgatcatcactgaacacagaggactcaccatggtagttggctgagcttgggttttcctcgttgacttgtttaagaggtgtccagtgccaggtgcagcgtggtggagtcggtgggggagcgtcggcccaggccgtgggacggtcccgaggtaacctcgtccgtntacgagttctcgtaggtattaccacgttacggttactagtcgtcttatcgccgtacggtcgggtcccggccggtcgtccgaggaccggaggggcgtagggnggttgggtaggcttagttacgtacgtccgagtacgaaggtcggaacggtactaacggttaaactcccgtaacggccgtaaggtcccgtacggtcggaaacgggtcctacgttacccacctacgtaccctacgaacgtacgaaactaaccgttaccaaacgtacgaccgtacgttagtacgtacctanaacgtaatacgaaccgtacgtaccggaggtaagacggttacggacgggttaaccggaacccgtagggttaccccgtagggtttaacggtttaacgtttacggttacgggtacggacggttaaaggagttagggtaaccggtagggtttaacgggttgttaaacggtttaaacgggg

SEQ ID NO: 230376 - DNA, 689 bp, Homo sapiens
  misc_feature: GYAE6OF01CM98S.3.4.A04.1.454.CMB.1.raw
  modified_base (198)..(198): a, c, t, g, unknown or other
  misc_feature (198)..(198): n is a, c, g, or t
  modified_base (268)..(268): a, c, t, g, unknown or other
  misc_feature (268)..(268): n is a, c, g, or t
  modified_base (373)..(373): a, c, t, g, unknown or other
  misc_feature (373)..(373): n is a, c, g, or t
  modified_base (415)..(415): a, c, t, g, unknown or other
  misc_feature (415)..(415): n is a, c, g, or t
tcagagacgcactccacgaccggtgctcgatttagagtagtgatcagggggaggctcgtgggagacgagcccagcactggaagtcgccggtgtttccagttcggtgagtcatcactgaacacagaggactcaccatggagtttggctgagcttgggttttcctgttgcttctttaagaggtgtccagtgccgagggtncgagcgtgggtaggaggtggtgggggagcggtggcccaggccgtggggacgtcccgaggaactcgtaccngtaccagtctcgtggtattcacttaggttacatgcttagcacgtacgtgggccgtccgggactaccgaggacgaaggggctgggaggtggggtagactagtttanactacccgagttagagtcgggaaggtacaaacggttaaaccncgtaacgacgaacgtaccgtacggacgggaacgggccctaagttaccaacgtaccgtacctaaccgaacgtaaacgtaaactaaacgttaaccgaaaacgaaaccgtacgaccgttacggttaacctacgtacggaaacctaaagtaacgaaaccggtacgtaaccgtgaacggaacgaccggtagaaccggtacgaacgtcgtagtacgttagttaacctggtggaagtacgggaatacgtaaggttaggtaacggtagtaagttaaaacggg

SEQ ID NO: 230377 - DNA, 697 bp, Homo sapiens
  misc_feature: GYAE6OF01EMBYU.3.4.A04.1.454.CMB.1.raw
tcagagacgcactccacgaccggtgctcgatttagagtagtgatcagggggagctctgggagacgagcccagcactggaagtcgccggtgtttccattcggtgatcatcactgaacacagaggactcaccatggagtttgggctgagtcttgggttttcctcgttgcttcttttaaggaggtgtccagtcgccgagggtgcgaggtcgtgggtggagtcggtggggggagcggtcggcccaggtccgtgggacggtcccaggacctctcctagtacagtctcgtggtattcaaccgtttaggtactatgctatgactacgtcgggtccggcgggtctccgagggacgaagggggctgggaggtggggcgtacgtaggttactactccgatggacgtgggaggactaaagtaactccgtacgacgaacgtccgtacggtaggaaccggggtccctaagtttaccccaacccgtacttaccccgtaaccggaaaggtaaccgtaaacctaaaccgtttacccgaaaagaacccgtacgttaccgtttacgttaaccttacgtaacggtaactaaacgtagtaaaccgacggtaccgtaggaaccgagtacgtaggaccggacgtacggtacgtgttaacgttagttcgtaggtcgaacgtagagtaacgtagtacggttggtaacggttcgtaaacggg

SEQ ID NO: 230378 - DNA, 745 bp, Homo sapiens
  misc_feature: GYAE6OF01AQWBC.3.4.A04.1.454.CMB.1.raw
  modified_base (179)..(179): a, c, t, g, unknown or other
  misc_feature (179)..(179): n is a, c, g, or t
  modified_base (198)..(198): a, c, t, g, unknown or other
  misc_feature (198)..(198): n is a, c, g, or t
  modified_base (280)..(280): a, c, t, g, unknown or other
  misc_feature (280)..(280): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcgtcgggttttcctcgttgcttacgttttaagnggtgtccagtgccgaggtncgagtcgtgggtggagtcggtggggggagcgtcggcccaggtccgtaggggacggtacccgaggaaccttctcctgtaaccngttcctcgtcggtattcctaaccgtttaggttactacgtcgtctatcgaccgtacggtcggggtcccggccgggtcctaccggacgggaccggaaggggtcgtacggggtaggtcgggggtacgacgttaaggttactaccgtacccgtagtacggtagtcggggaacggtactaaacggtaacctcccgtaacgaccgtaacggttccgttaccgggtacggaaccgggtaccgttacttcccgaactaccggttacctaccggtaaagaaaccggtactaaacgttaaccgaaacgtaacgaccgtactacggtactacgtacgaacctaagtaaccgaacgtacaccggttagaacgtacgtacggtacggaacgtaccgaccgtcgtacggttacgtacttacggtgtacggacggaaagtggtaacgttagagggttaccggtaagtaacgtttaacggg

SEQ ID NO: 230379 - DNA, 972 bp, Homo sapiens
  misc_feature: GYAE6OF01C9Y8A.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactagaacacagaggactcaccagtggtagttggctgagcgttggttttcctcgttgcttacgttttaagaggtctccagtcgccgaggtcgcgagtcgtagggtgggacggtcggtggggggagcggtcggacccaggccgtgggaccgtccgaggtaacctcgtacctgtacgcgttactcgtggtaaccttccgtaaccgtttaacgggttaactagttacgtacttacgtcgtaccgtcgggttccggggtccccggaccggggtccctaccggaacggggtaaccggggtaaacggggggtccggttacgggggtaacggggttgggggggtacggttaccgtaaaacggttttaacggttaccaacccggtaggtaacgggtaggttaacgggggaaccggtaacgtttaaaacggtttaaaaccgttcccggtaaaccgtaccgggtaaacggtaaccccggtttacccgggtaaacgggggaacccgggttaccccgttaacgtttaaccccggaaccttaaccgtccccggtaaaccgtaaacggtaaacccggtaaacttaaaaaccccggttaaccgaaaaaccgggtaaacccgttaaccggtaaccggttttaaacggttaaccgtttaaccggtaactaaaacccgtttaaaacggaaccgtaaaccgttaaccggaaccgtaggtaaggtaaaccggtcgggttaacgggacccgttaaaacgggtccggttacgttttacgggtaaccgtttacgggtttaggaacgggtaacggtaacggtaaagtaacgggttgttaaacgggttaggtaaccggggtttaacggtaaaccgggtttaaaacgggg

SEQ ID NO: 230380 - DNA, 596 bp, Homo sapiens
  misc_feature: GYAE6OF01EU10F.3.4.A04.1.454.CMB.1.raw
  modified_base (257)..(257): a, c, t, g, unknown or other
  misc_feature (257)..(257): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttcttttaagaggtgtccagtgccgaggtgcagctgggtggagtcgtgggggagcgtggcccagccgtgggacgtcccagactctctgtacngtctctggattcaccttaggttactatgctatgctacgtcgggtccgccgggctccgaggcgaagggcgtggagtggggtgctagttatactccagtgagtggagactaagtaaactccgtaacgcgacgtacgtccggtaggaacgggtccgtattccgaacctactacctaccgaagaacgaactaacttaaccgaacgaaccacgtctagtaactcgtacaccgtaagtacgaacacgaccgtaggagacgcgtaggacgacgacggtcgtacgtacgttacgttagtggcggtagaagtagtagtaggtaggttcgggtagtaaggttaaacggg

SEQ ID NO: 230381 - DNA, 744 bp, Homo sapiens
  misc_feature: GYAE6OF01CZCCE.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttccttgttgcctattttagaaggtggccagtgtgaggtgcagctgggtgggaggtcggggggagtcgttggtccaggccgtgggggtccctgagctctcgtgtgcagcctctggtacttctacctttagtacgtcttcttggatacgaacgtgggtcccgcctagtcctacggaacggggaacgggggtcgtagggagggttggggtaccggacctaacgttcggaaacgccgaagtagtacgggaagttagaagtaaaagttaactaagtcggtaggtacttcggtcggttagggaacggggtaccgtatttaaccgaacccttagtttaacccgaaggtaaccgaacccgaaaccggtaaccgtaaacgtaaccgtactaatttacgttacgtacttacgaactaaacgtgggtacaacgtcccgtaggaacccgtacccggaaggtaaccgacggttcgttacggttttacgttccgtacggtcggtaccgggtccggtacgggtaactaacgggtaacccggtaaaaccgttcggggacccgggtacggtaacccgggaacccggtttccgacccgttaacccgg

SEQ ID NO: 230382 - DNA, 729 bp, Homo sapiens
  misc_feature: GYAE6OF01BOD7C.3.4.A04.1.454.CMB.1.raw
  modified_base (174)..(174): a, c, t, g, unknown or other
  misc_feature (174)..(174): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagnggtgtccagtgccaggtgcagcgtggtggagtcggtggggggacggcggtcggccccaggcccgtggggacggtccccgaaggaacctctcctaggtacagtctctgggtacttcaccgtttaggttactagtgtctatgcacgtgggtccgccggctccgaggcaaggggcagggagtgggtggactaagttatactccgatcggatcgggaggacaaggttaaactccgtaacgacgtaacggtacgtcccgggtagggaaccgggtaccgtacgttaccaaccctacgttacccgtaccgtaacgaaacggaaccttaaaccgttaaccgaaaacggaaccgtaaccggtacctttaacggttaaccgtcgttaacggaactaaaacgtacgaaaccgtacggtaccgtaagaacggtacgtccgaaggacggtaaccgtaaccgggtgttacggttacgttaacggtttaccgtaggttaccggaaggtaacggtaaaggtacggtaacgggtaagggttacgggttaccgtaacggtttaaaaccggggg

SEQ ID NO: 230383 - DNA, 858 bp, Homo sapiens
  misc_feature: GYAE6OF01D5E8H.3.4.A04.1.454.CMB.1.raw
  modified_base (161)..(161): a, c, t, g, unknown or other
  misc_feature (161)..(161): n is a, c, g, or t
tcagagacgcactccacgaccggtgctcgatttagagtagtgatcaggggagctctgggagacgagcccagcactggaagtcgccgggtgtttccattcggtgatcatcactgaacacagacggactcaccgatggagtttggctgagtctgggttttccncgttgcttactttagagtctaccaggtcgccgaggtcgcgagtctgggtggagtcggtgggggtacggccggtcggccccgaggcccggtaggggtaccggtccccgaaggtaaccttcgtccgttgtaacgcgttccgttacgtcggtacttttaccgaaccgttttaggttaactagtcgcttaacgtcgtaccgtaccggtttcggggcccccgggtaccgggtaccgttaccggaacggggttaccgggaacgggggtccgtggggtaaacggggttgggggttcggactttaaagggttttcaacccgttaacccgttagttagggaaggttacgggggaacggttacctaaaagggttaaaaccctttcccggtacggaaccgtacgtaaccccggttacccggtaagggaaaccgggttccgtaacttcccgaaacctcgtacctaaccgaacgaacggaaccttaaactaacccgaacgtaacgtaccgtacgttacgttacgtacgttaccgaaagtaaacgaccggtaacaacgtccgttaagaaccgggtacgtaccgaaggggacccgtaaacggtcggttacgttacggttaagttaaaccgttacggttggtaccccgagggtttaagaacgggttactttagggtaacccgttggggttaaccgtaaggtttaaaccggggg

SEQ ID NO: 230384 - DNA, 790 bp, Homo sapiens
  misc_feature: GYAE6OF01BTRVO.3.4.A04.1.454.CMB.1.raw
  modified_base (161)..(161): a, c, t, g, unknown or other
  misc_feature (161)..(161): n is a, c, g, or t
  modified_base (183)..(183): a, c, t, g, unknown or other
  misc_feature (183)..(183): n is a, c, g, or t
  modified_base (761)..(761): a, c, t, g, unknown or other
  misc_feature (761)..(761): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccagtggagtttgggctgagcgttgggttttccncgttgcttacttttaagaggtntccagtgccaggtgcagctgggtggagtcgtgggggagcgtcggcccaggccgttgggacggtcccaggtaacctcgtcctgtaacgcgttcctcgtggtacttcctaaccgttttaggtactaagtggacttagtacggaccgacggttccggggtacccggcccggggtccttaccggaacgggaccggttaagggggcgttacggggaaggttggggtacggtccgttaaagggtttactaaccgttcccgaaggttaacggaagggtttacgggaacgggtaacccgtaaagggttaaaaaccttcccggaacggtacccgtaacggtaaaccggtttccccgggaaagggttaaccggggacccttaaccgttacccgtaaccgtaaccttacccgtaaccgttacgggaaacgtaaccgtaaaccgtttaacccggaaacgtaaacccgtacggtaccgttacgttaaactccgtacgaacctaaagttaccgaacgtacgaccgtaggaacgtacggtacgaggaccggtacgaggtctaggtagtacgtagtacgtggacgaggtaacgngtacgtaggtacggtagtacgtaaacggg

SEQ ID NO: 230385 - DNA, 667 bp, Homo sapiens
  misc_feature: GYAE6OF01A6KXB.3.4.A04.1.454.CMB.1.raw
  modified_base (174)..(174): a, c, t, g, unknown or other
  misc_feature (174)..(174): n is a, c, g, or t
  modified_base (347)..(347): a, c, t, g, unknown or other
  misc_feature (347)..(347): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagnggtgtccagtgccaggtgcagctggtggagtcgtgggggagcgtggcccagccgtgggacgtcccaggacctctcctgtacagtctcgtggattcaccttaggttactatgctatgctacgtcgggtccgccgggctccgaggcgaaggggctgggaggtgggtgctagttanactccagtgagtggacgcaagttaaactccgtaacgcacgtacgtccggtaggaacgggccgtattccgaacctactctaccaagaacgtaactaaacgttacccaaacgaaccgtacgtaccgttagttacttaccgtacgaacctaaacgttacgaaaccgtacggtacccgtagggaacgtacggtaccgtagggaaccggtaaccgtacgggtaccgttaggttaacggtttacgtttaaccggttggtacggaccggtaaggtaacggtacgttaggaacgggtttcggggtaaaccgtaaggtttaaaccgggg

SEQ ID NO: 230386 - DNA, 879 bp, Homo sapiens
  misc_feature: GYAE6OF01EFQ35.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggtaggtttgggctggagtcgttgggtttttccctcggtttgtctttacgtttttaaaggaggttcgtcccgtaaggttcgccgtagggttcgccgtaggtcgttggggtcggtaggttcgggtggggggacggtccggtcgggcccctagggtcccggtgggggaccggtccccgaagggtaacccttccgtcccgtacgtacgtacgttcctcgtaggtacttccgtaaccgtttaggttactagtcgtcttagtcggccgtaccggttcgggtccccggcccgggtcgtcccggaagggcccggaaggggccgtaggggtagggtcgggtcggtacgttaagtttactaccgtaccaaggtggtaacgtggggaaacgtacgtaaacgttaaacgttacccgtaacggtacgtaacgttcccggttaccgggtaagggtaaacccgggtccgtaccgttaacctacccgtaacgttcctaacgaacggtaacgttaaaccgtaacgttaacccgaaaaccgaccggtaaccgtacgttaacggttaaccttacgtaacgtaaacctaaacggtaacgaaccgtaacggaccgtaacggtaacggtcgggtaaccgtacggaaaccggggtaccgaccggttcggttaacgttacgtttaacgttacgggtacgtaacgggaaccggtaaggtacggtacgggttaacgtagggttaaaccggggttataaacggggtttaaacgg

SEQ ID NO: 230387 - DNA, 738 bp, Homo sapiens
  misc_feature: GYAE6OF01E1Y7D.3.4.A04.1.454.CMB.1.raw
  modified_base (224)..(224): a, c, t, g, unknown or other
  misc_feature (224)..(224): n is a, c, g, or t
  modified_base (669)..(669): a, c, t, g, unknown or other
  misc_feature (669)..(669): n is a, c, g, or t
tcagagacgcactccacgaccggtgctcgatttagagtagtgatcgaggggagctctgggagacgagcccagcactggaagtcgccggtgtttccattcggtgatcatcactgaacacagaggactcaccatggagtttgggctgagcgttcggtttcctcgttgctttagtttagaggtcgtaccgagtcgccgtaggtgcgagtcgtggtggtacgttcggnggggtacggcgtcggacccgaggtccgtgggacggtacccgagtacctctcctagtactagttctcgtgtaccttccgtaaccgtttagttacctagtcgtactacgtcgaccgtaccggttccggggcccggtccgcccgtaccggacgggaccggtaaggggtccgtagggtagggtcgggtagtaccgttagttacgtaaccgtccgtagtcggaacggttggaacgtacgtaaacgtaactcgtacgcgaaggtccgtggaacggtaacggtcccttaagccctaacgtctacgaccgaagtaccgtaaccttacgaaccaacgactaacgtcgtatacgtcgtaaccaagtaacgtacgaaacgtcgcccgttaaagacccggtagaccgtacggtaacgcggttaaccgtgttaaacggttacgtacgtttaccggggnggtaccggtaacgtaacggtacgtaaggttacggtaaccggttacgggttaaacgtaacggttaacggg

SEQ ID NO: 230388 - DNA, 784 bp, Homo sapiens
  misc_feature: GYAE6OF01A50PF.3.4.A04.1.454.CMB.1.raw
  modified_base (277)..(277): a, c, t, g, unknown or other
  misc_feature (277)..(277): n is a, c, g, or t
tcagagacgcactccacgaccggtgctcgatttagagtagtgatcgagggggagctctgggagacgagcccagcactggaagtcgccggtgtttccattcggtgatcatcactgaacacagaggactcaccatggagtttgggctgagcgttgggttttcctcgttgcttcttttaagaggtgtccagtcgccgtaggtgcagcgtgggtggaggtcggtgggggaggcgtcggcccaggtccgtagggacggtcccaggtacctcgtccgtgtacngtctctggtattcgacctttaggttactatgtctattcgctacggttcgggtcccggccgggcctccgaggccggaaggggccgttagggacggttggggtcggactaaggtttactaactcctagtggacgtgggaacgagtaacgttaaacgtccgtaacgcgtaacgtaccgtaccgggtacggaacgggtacccgttaacgttccaacccgtacgttacccgtaccgtaaaggtaaaccgtaaactaaaccgttttaaacccgaaacggtaaaccgtaaccgtaaccgtttaacgttacgttaaccgttaacgaaaccgttaaaagtaacggtaaccgaaccggtaccgtaaggacgtaacggtaccgacggtaaaccggaccgtaaccgggtacgtttacggttaacggtttaacgttacggttacggtacgggtaacgaaaggtaacggtagttacggggtaaggttaccgggggttaagtaaccggttttaaaacggggg

SEQ ID NO: 230389 - DNA, 801 bp, Homo sapiens
  misc_feature: GYAE6OF01C2PJL.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagagactcaccagtggagtttgggctgagcttgggttttcctcgttgcttcttttaagaggttcgtccagtgcccgtaggtcgcaggtcgtgggtggaggttccggtggggggacggcggtcgggcccctaggcccgtggggtacggtccccaaggaaccttcctccgtgtaccagtcctctggtacttcctaccgtttaggttactagttgctatcgcctacgtcggggtcccgccgggtcctccggaggtaccggaagggggtccgtaggggtacggttggggtacgtacgtaaggtttaactaccgttacccgagttcggaagtggggaacggaacttaaaggttaaacctcccgttaacggcctaaacggtacccgttaccgggtagggaaaccgggtcccgtaacgtttaccccgaacccgtaacgttcccgtaacccgtaacggtaacgtaaacccgttaaaacgttaaccccggaaacgaacccggttaaccgtcctttacgggttaaccttccgttaagaacccgttaaagtaacccgtaaacgccgaccgttagggaacgttccggaacgtacgggtaacgacccgttacgggtcgtttaggtacgtttaacgtttagttcgggtacggagtagtacggtagtcggtaagttacgggtaagttacgtaaaccggg

SEQ ID NO: 230390 - DNA, 658 bp, Homo sapiens
  misc_feature: GYAE6OF01C8EI2.3.4.A04.1.454.CMB.1.raw
  modified_base (386)..(386): a, c, t, g, unknown or other
  misc_feature (386)..(386): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttgttttaagaggtgtccagtgccaggtgcagtcgtggtggagtcggtgggggagcggtcggcccaggccgtggggacgtcccgaggaactctcctgtacagtctcgtgacttctaccgttagttactatgctatgctacgtcgggtccgccggcctcgaggacgagggcgtggcgtgggtcgcgtagtatactccagtgagtggaggtactaagtaaacnccgtaagcgtacggtacgtccggtaaggacgggtaccgtacgttacccacctacgtaccgtaccgaagtaacgtaacctaaacgttaccgaaacgaaccgtaccggacttacgtaactcgtagaaacctaaacgtacgaaacctacgggtacctaggaacggtacgtcggtacggaacggtaacccgtaccgggtcgttaggtagtttaacgttcgtacggtcggtacgaggtaagtacggtaggttagggacggtagttaaagttaacggg

SEQ ID NO: 230391 - DNA, 652 bp, Homo sapiens
  misc_feature: GYAE6OF01B71YS.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttcttttaagaggtgtccagtgccaggtgcagctgggtggagtcgtgggggagcggtcggcccagccgtgggacgtcccgaggactctcctgtacagtctcgtggtacttcgtaccgttaggttactagtgtactatcgctacgtcgggtccggccggctccgaggcgaaggggctagggaggtgggtgtcgtagttactactccagtaggagtagggagacgtaagtaaactccgtacgacgacgtaccgtacggtacggaacgggtccgtacgttaccaacctacgtcctacgaacgtactaacgtaacttacccaaacgaacctacgtccgttaagtacttacgtacgtaactaaacgtcgaacgtaccgtcgtagagtacgaccgtaggacggtacgaccggtagttacggttacgttacgttacgtacggtcgaggtaacgtaggtaacttagggtaagtcgggtacgtaacgttaaacggg

SEQ ID NO: 230392 - DNA, 678 bp, Homo sapiens
  misc_feature: GYAE6OF01EVVAB.3.4.A04.1.454.CMB.1.raw
  modified_base (195)..(195): a, c, t, g, unknown or other
  misc_feature (195)..(195): n is a, c, g, or t
  modified_base (203)..(203): a, c, t, g, unknown or other
  misc_feature (203)..(203): n is a, c, g, or t
  modified_base (255)..(255): a, c, t, g, unknown or other
  misc_feature (255)..(255): n is a, c, g, or t
  modified_base (334)..(334): a, c, t, g, unknown or other
  misc_feature (334)..(334): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgtcttcttttaagaggtgtccagtgccaggtncagctggngagtcgtgggggagcgtcggccagccgtgggacgtccaggactctctgtacngtctcgtgtacttctaccgttaggttactatgctatgcacgtcggccgccggctccgaggacgagggtctggagtgggngctagttacactccagtgagtgggacgtactaagtaactccgtaacgcgtacgtaccgtccggtaaggaaccgggtacccgtaattacccgaaccgtaacttcccgtaaccgaagtaaccgaaccgtaaaccgttacccgaaaaggtaaccctaccgtacgttaacgtaacttcgtaacgaactaaacgtacgtaaacctacggtaccgtaggaacgtaccgtacggtaacggaacggaccggtaccgggttatcgggttaacgttacgttacgtagggtacgaacggaaggtacgtaaggttacggtagggttacggggtaacctaagggtttaaacccgggg

SEQ ID NO: 230393 - DNA, 654 bp, Homo sapiens
  misc_feature: GYAE6OF01AHGSW.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttctttttaagaggtgtccagtgccgaggtgcagcgtgggtggagtcgtgggggaggcggtcggcccagccgtgggcggtccaggacctctctgacagtctcgtggtacttctaccttaggttactatgtctatgcacgtcgggtcccggccggcctccgaggcggaacggggcgtgggagggtggggtggcgtagttactacgtccatggagtgggacggacaacgtaactccgtacgacgacgtacgtccggtaggaacgggtaccgtacgtaccacctacgtacctaccgaacgtaacgaactaacttaaccgaacgtaaccgacgctacgtactacgtacgaactaacgtacgaactacggaccgtaggacgacgtacgacggacggaccgacggtacgttcgggttacgttacgtttacggtaggttacggacgggtaagtaaggtacgtaggttaggtcgggtaagtaaccggttaaacgggg

SEQ ID NO: 230394 - DNA, 598 bp, Homo sapiens
  misc_feature: GYAE6OF01D0BWX.3.4.A04.1.454.CMB.1.raw
  modified_base (477)..(477): a, c, t, g, unknown or other
  misc_feature (477)..(477): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttcttttaagaggtgtccagtgccaggtgcagctggtggagtcgtgggggagcgtggcccagccgtgggacgtcccaggactctcctgtacagtctctggattcaccttaggttactatgctatcgctacgtgggtccgccgggctccgaggcgaaggggctgggagtgggtggctagttatactccatgatggagacaagtaaactccgtacgcagtactccgtaggaacggccgtaattaccacctaatcctacaagacgaacaattacccaaagaacacgccttagtactctagactaaatacgaaacncgacctggaacgagtcgtagaacggaaccgtacgggtcgttaggttacgttaacgttagttacggtaggaccgtagaaacggtgtaaggtaggtttacggggtacgtaaggtttaaacggg

SEQ ID NO: 230395 - DNA, 955 bp, Homo sapiens
  misc_feature: GYAE6OF01D5H7Y.3.4.A04.1.454.CMB.1.raw
  modified_base (52)..(52): a, c, t, g, unknown or other
  misc_feature (52)..(52): n is a, c, g, or t
tcagagacgcactccacgaccggtgctcgatttagagtagtgatcagggganctctgggagacgagcccagcactggaagtcgccggtgtttccattcggtgatcatcactgaacacagaggactcaccagtggagtttgggctgagtcgttgggttttcctcgtttgtcttacgttttaaggaggttcgtccgaggtcgccgtagggtgcaggtcgttgggtgggtacggtcgggtggggggtagggtccgggtccgggccccgacggtcccgggttcgggggtaccggttaccccgaagggtaacccttccgttacccgttacggttaacctacggttccgttacgttaggggttaacctttacccgttaacccgttttaagggttttaaccgttagtttacggtaccttaagttccggcccggttaaccggggttccgggggtaccccgggtccccggggtacctaacccggggtacgggggaccgggtaaacgggggtcggttggggtacgggttggggtacggtacgttaagtttactaccgtacccgtagtcggtaaggtcggggtaacgtaaccgttaaaggttaaacctcccggtaacggaccgtaacgggtacccgttaccgggtaagggtaaccgggtcccgtaacttaccccgtaaccgtaccgttaccgtaacccgtaacggtaaacgtaacccttaaacgtaacccgaaacgtaacccggtacgtacgttaacggttaccttacggtacgtaaaccgtaaagtaaccgtaaccgaacgtcccgtaaggtaaccggtacgacggttaacgggaaccgttaaccggtaacggtccggtttaggtttaacggttacgtttacggttagggtacggaacgggtagttaacgggtaacggtttacgggttaaggtaaccgggttaagttaacgggttaaaaccgggg

SEQ ID NO: 230396 - DNA, 681 bp, Homo sapiens
  misc_feature: GYAE6OF01E4PH1.3.4.A04.1.454.CMB.1.raw
  modified_base (156)..(156): a, c, t, g, unknown or other
  misc_feature (156)..(156): n is a, c, g, or t
  modified_base (344)..(344): a, c, t, g, unknown or other
  misc_feature (344)..(344): n is a, c, g, or t
  modified_base (519)..(519): a, c, t, g, unknown or other
  misc_feature (519)..(519): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttggctgagctggttttccncgttgctctttaagaggtgtccagtgccaggtgcagcgtggtggagtcgtgggggagcgtggcccagccgtgggacggtcccaggacctcgtcctgtacagtctctggtacttccaacctttaggtactatgtcctatcgcacgtcgggtcccgccggcctaccgaggacgaggggctgggagtgggngtcgaggttactatccagtgagtggacgacaaacgtaaactcccgtaacgaccgaacggtaaccgtccgtaagggaacgggtacctacgtaccctaaccctactacccgttaccgaacggtaacgaaacctaaaccttaaccgaaacgaaacaccgtcgtacgtaactaccgtanaacctaaagtacgaaaccacggtaccgtagggaaacgacggtacggtaggaaaccgggtacggaacccggttacgttggttacgttaacggttacgtacgggtacggacggtaaaggacgtaaggtacggtacggttggggtaaccgtaaggtttaaacggg

SEQ ID NO: 230397 - DNA, 724 bp, Homo sapiens
  misc_feature: GYAE6OF01BPSAX.3.4.A04.1.454.CMB.1.raw
  modified_base (263)..(263): a, c, t, g, unknown or other
  misc_feature (263)..(263): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttcttttaagaggtgtccagtgccgaggtgcagcgtgggtggagtcggtgggggagcggtcggcccagccgtgggacgtcccaggactctccgtgacngtctcgtggattcacgttaggttactatgctatgcacgtcgggtccgccgggctccgaggcgaaggggctgggagtggggtgactagttatactccagtcgagtgggaggctaagtaactcctacgcagtaccgtccggtaggaacgggtcctacttaccaaccgtactccctacgaaggaacgtaactaacttaacccgaaagaacccgtaaccggtacttacggttactaccgtaacgaacctaaaagtaccgaaaccgtacggtaaccccgtaaggtaaacgggtaaccgtaccggttaacgggaaaccgggtaacccggaaccgggttcgtttaagggtttacgtttaaaccgtttttacgggtacgggtacgggtaaccgggtaaagggtaacgggttaaagttaggggttaaggtttaccggggggtaacgttaaaccggtttaaaaccgggggg

SEQ ID NO: 230398 - DNA, 738 bp, Homo sapiens
  misc_feature: GYAE6OF01B4V3S.3.4.A04.1.454.CMB.1.raw
  modified_base (680)..(680): a, c, t, g, unknown or other
  misc_feature (680)..(680): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccagtggtagtttgggctgagtcgttgggttttcctcgttgtcttacgttttaagaggtgtccagtcgcgtaggtgcagtcgtgggtggtacgtcgggtgggggacgtcggtcggccccgaggtccggtggggaccggtccccgaaggtacctccgtcgtagtactcgtctgtcgttacttcctaaccgttagttactagtcgtactagtcgccgtacggtccgggtcccggccggtccgtccggaagggtccggaaggggtcgtagggtagggttcgggtgtaaccgtagttaaacttcccgtaccgaagtagtacggtaggaccgtaacgttaaacgttaacgtccctaaggacgttaacggacccggttacggtaagggaacccgggttaccgttactaccccgtactaccgtaccgtacgtaaccgaacgtaactaaccgtaaccgaaacgaacgtacctacgtagtaaccttcgaataacgaaacgtaccgtaatacgtaccgtgaacggactcggaagcggtaacgtcgtgtgttacgtagttaggnggttaacgacgtaggtaaagtggtaacggaggtttaacgggtgtaaggtttaaacggg

SEQ ID NO: 230399 - DNA, 610 bp, Homo sapiens
  misc_feature: GYAE6OF01EMB1E.3.4.A04.1.454.CMB.1.raw
  modified_base (160)..(160): a, c, t, g, unknown or other
  misc_feature (160)..(160): n is a, c, g, or t
  modified_base (261)..(261): a, c, t, g, unknown or other
  misc_feature (261)..(261): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcgttgggttttccncgttgcttacgttttaagaggtgtccagtgccaggtgcagcgtgggtggagtcgtgggggagcgtggcccagccgtgggacgtcccaggactctctgtacngtctctggtattcaccttaggttactatgctatgctacgtgggtccgccggctccgaggcgaagggctgggagtgggtgctagttactactccgagtcggatgggagacgtagtaacgtcctacgacagtaccgtccgtaggaacggcgtactaccacctatcgtaccagaacgaactaacttaccaacgtaaccgacgtcgttagtactacgtacgaacgtaaatcgaaacgacgccgttagacgagacgtaggacggacgtacggtcgttagttacgttacttaggtacggtcgacggaacgaaggtacgtaggtaacggttcgggttacgtaaggtttaaacgggg

SEQ ID NO: 230400 - DNA, 772 bp, Homo sapiens
  misc_feature: GYAE6OF01EQ9BD.3.4.A04.1.454.CMB.1.raw
  modified_base (622)..(622): a, c, t, g, unknown or other
  misc_feature (622)..(622): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttggttttcctcgttgtcttactttaagaggtcgtccagtcgccgaggtgcgagcgtgggtggaggtcggtgggggaggcggtcggcccagccgtgggacggtacccgaggtaacctcgtcctgtacgtacgtctctggtactttccgtaaccgttttaaggttacttagtcgacgttagtcgtaccgtacggtcgggggttccccggcccgggtaccgtaccggaggggaccggaacggggtccgttggggtacgggtggggtcggtaacgtaggtttaactaaccgtccgtaagtacggtagttcggggaacggtaacgtaaaacggttaaaaccgttccgtaacgaccgtaacggtacccgttcgggtaaacgggtaacgggtccgtaaccgttacaaccgtaacgttccgaacccgaaagtaacgtaacctaaacgtaaccgaaaacgaccgtaaccgattacggttaacnccgttaagaacctaagaacccgtaacgcgtacgtagagtacgacgtacggaacggaacccgtcggtagttagtacgttacttcggaggtagaacggtaagtacgttaaggtgggttaagggttacggtaaagttagggttaaaaccgggg

SEQ ID NO: 230401 - DNA, 750 bp, Homo sapiens
  misc_feature: GYAE6OF01DR1DZ.3.4.A04.1.454.CMB.1.raw
  modified_base (161)..(161): a, c, t, g, unknown or other
  misc_feature (161)..(161): n is a, c, g, or t
  modified_base (197)..(197): a, c, t, g, unknown or other
  misc_feature (197)..(197): n is a, c, g, or t
  modified_base (262)..(262): a, c, t, g, unknown or other
  misc_feature (262)..(262): n is a, c, g, or t
  modified_base (580)..(580): a, c, t, g, unknown or other
  misc_feature (580)..(580): n is a, c, g, or t
tcagagacgcactccacgaccggtgctcgatttagagtagtgatcaggggagctcgtgggagacgagcccagcactggaagtcgccggtgtttccattcggtgatcatcactgaacacagaggactcaccatggtagtttggctgagtccttggttttccngttgcttcttttaagaggttgtccagtcgctaggtncagtctgggtggagtcgtgggggagccgtggcccagccgtgggacgtccaggaactctctgtacngttctgtggacttctacgttagttacatgctatcgactacgtcgggaccgtccggtctacccggaggccggaaggggtctaggggacgttgggggtacgacgttaagttacgtaaccgttcccgaagtaggtaagttaccggggaggtaacctaaaggttaaacctaccgttaaaccggacgtacgtaacccgttcccgggtaaagggaaccgggtacctacgtttacccaaccctagtccgttaaccgaacgtaaccgaacgttaaactaaccggtaaacgaaccgttaaccggaccgttacgttactaccgttaanaacccgtaaagtaccggtaaacacggttaccgttaggaaacgacgtaacggttaacgggacggaacccgttaaccggtcgtttaacggtaacggtttaacgttacgttacgggtaggaaccggtagaacggtacgtaaggttagttacgggtaagtaacggttaaacggg

SEQ ID NO: 230402 - DNA, 702 bp, Homo sapiens
  misc_feature: GYAE6OF01DDVSQ.3.4.A04.1.454.CMB.1.raw
  modified_base (289)..(289): a, c, t, g, unknown or other
  misc_feature (289)..(289): n is a, c, g, or t
  modified_base (295)..(295): a, c, t, g, unknown or other
  misc_feature (295)..(295): n is a, c, g, or t
  modified_base (434)..(434): a, c, t, g, unknown or other
  misc_feature (434)..(434): n is a, c, g, or t
  modified_base (529)..(529): a, c, t, g, unknown or other
  misc_feature (529)..(529): n is a, c, g, or t
tcagagacgcactccacgaccggtgctcgatttagagtagtgatcaggggagctcgtgggagacgagcccagcactggagtcgccggtgtttccattcggtgatcatcactgaacacagaggactcaccagtggtagtttgggctgagtcgttgggttttcctgttgtcttacgttttaaggacggtgtccgagtcgcccgagggtgcgaggtcgtagggtggtaggtggtggggggagccggtcgcccgacggcggtagggaccgccgaggacctcctccgtagtacngtcctntaggattaccgtaccgttaaggttactatagtctagtcgtcgtacggtccgggtcccgccgggtcaccgaggacgacgggcgtgggtaggtgggtcgatagttacgtacgtccaagtgaggaggagaactaagtaaacncgtaacgacgtacgaccgtacggtacggaacgggtccgtataccgtaactactcgtaacgagaacgtaaaccaacgttaacaaacgaactaacgngttatacgtactacgaacctaaagtaccgacgtaacgtccgaggtaccaggacgttacggacgaccggttcggacgttagtacggtttaacgtacggttacgggtgaaccggtagtaacgggtacggttagggtaacgggttacgggttaaccgtaaacggtttaaacggggg

SEQ ID NO: 230403 - DNA, 678 bp, Homo sapiens
  misc_feature: GYAE6OF01AMC2K.3.4.A04.1.454.CMB.1.raw
  modified_base (281)..(281): a, c, t, g, unknown or other
  misc_feature (281)..(281): n is a, c, g, or t
  modified_base (371)..(371): a, c, t, g, unknown or other
  misc_feature (371)..(371): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagtcttgggttttcctcgttgcttcttttaagaggtgtccagtgccgaggtcgcagcgtgggtggaggtcggtggggggaggcggtcggccccgagtcccggtgggacggtcccgaaggtacctccgtccgtgtacncgttctcgtggtacttcaccgttaggttactatcgctatgcacgtcgggtccgccgggcctccgaggccggagggtcgtggagggtgggnggtacgagtttatacgtcccgagtcggagtgggacggtataacgttaaacgtaccgtacgacctacggaccgtaccggtacggaacgggtcgtacgtccgactactctaccgtagactaacgtaacttaaccgaacgtaacacgacctagtacgttcagaacctaaacgactaaacgcggaccgtagacgacgacggtacggtaaccggacgtacggtccgttaggtacggtaacgtttacggtaggtacgggacgtaaggaggtacgttaggtaaggttacgggtcgggttaacgtttaaacgggg

SEQ ID NO: 230404 - DNA, 753 bp, Homo sapiens
  misc_feature: GYAE6OF01D35ZW.3.4.A04.1.454.CMB.1.raw
  modified_base (156)..(156): a, c, t, g, unknown or other
  misc_feature (156)..(156): n is a, c, g, or t
  modified_base (176)..(176): a, c, t, g, unknown or other
  misc_feature (176)..(176): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttggctgagcgtggtttccngttagcttctttaagaggtntcagtgccgaggtcgcacggcgtgggtaggaggtcggtgggggagtcggtcggaccccgtaggccgtaggggaccgtacccgaaggtacctccgtccgtagtaactagttcgtcgtaggtaccttaccgtaaccgtttacggttacctagtcgtacttatcgaccgtacggtcgggtccccggccgggtacctccggacgggacggaacggggtcgtagggacggttgggtcggtacttaacggttactacgtcccgtagttaggacgtacgggaacggtactaacggttaaacctccgtacgacgtacgtaccgttacggaggaaccggctacgttacacctagtcctacgaagtacgtaactacgtaaaccgaacgtaaccgtacgtcgtacgttactacgtacgtaaactaacgttaacggaaaccttcggacgtaggtaacgagtacggacggacgggtaaccgtacgggtccttagggttaaacgtttcgttacgggaacggttccggaaggttacggtaaaggttacgacgggttaacggttaccgggttaagtacgtttaaaaccggggg

SEQ ID NO: 230405 - DNA, 889 bp, Homo sapiens
  misc_feature: GYAE6OF01BEWMC.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacaggagactcactagtggtaggttggctgacgtcgttcgggttttcctcggttcgtctttacgtttaaggaggttcgtccgtaggtcgaccgtagggtcgacgtaggtcggttggggtaggtacgggttcggggtgggggggacggtccggtccgggccccgtaggtccggtaggggtaccggtacccgaaggtaaccttccgtccgttagtactcggttccttacgtggttacttacccgttaaccggtttaaggtttaacttacgtgtaccgttagtcggtaccgtaccgggtccgggggtccccggtccgggtccgtaccgggaacggggtaccgggtaacgggggtcggtacggggtagggttacgggggtcggtaccgttaaggtttaaccttaccgtaccgtagtacggaggtgggacggactaaacggtaacctccggtacgacgtaccgtacggtacggagggtaccggtacgtacctaccaacgtccgtacaaccgagaacgtaaactaccttaaccggaaatacccgtacgtacgtagttaccgtacgtaaacggtaaccaaggtttaaccgaacggaccgttaccggtaggtaacgtccgggtaacggtacggggtaccggaccggttaaccgggttagtttaaccggttttaaccggttaacgtttacgggtacggggttaaccgggaaagttaaacggtagggtttacggtaggggttaaaacccggttcgggttaaaccgtaaagggttttaaccgggg

SEQ ID NO: 230406 - DNA, 825 bp, Homo sapiens
  misc_feature: GYAE6OF01CJ7S9.3.4.A04.1.454.CMB.1.raw
  modified_base (181)..(181): a, c, t, g, unknown or other
  misc_feature (181)..(181): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctggagtcgttgggttttccctcgttgcttcttttaaggnggtgtccaggtcgcctagggtgcagtcgtgggtggaggtcggtgggggagcgtcggcccaggccgtgggacgtccgaggtacctcgtcgtagtactagttctcgttaggtacttccgtaaccgtttaggttacttagtgtacttacgtgaccgtacggttccggggtcccgccgggtcctaccggagggacggaacgggggtcctaggggtacgggttggggtagtaccgtaggtttaaccgtaccgttacccgtaaggtacgggtaaggttacggggggtaagtaaccgttaaaacgttaaccgttaacccggtaacggaaaccgtacgggtaacccgttaccggggtaaacgggtaccgggtacccgttaacctacccgtaaccgttaaccgttaccaaccggaaacgttaaaccggtaacctaaaaccgttaccggaaacgaaaccgtccgttaacgttaccgttagtaaccgtacgtaaaccgtaaggtaaccgtaacgacccggtacgtaagaacggacgttacgacgtaacggtaccggtcggtacgtttagtacgttaacgttgacgggttacgacggtaacggtaagttcggtaaacggttggttaaacgggtacgttaaacgggtttaaacgggg

SEQ ID NO: 230407 - DNA, 771 bp, Homo sapiens
  misc_feature: GYAE6OF01BUBQ2.3.4.A04.1.454.CMB.1.raw
  modified_base (167)..(167): a, c, t, g, unknown or other
  misc_feature (167)..(167): n is a, c, g, or t
  modified_base (298)..(298): a, c, t, g, unknown or other
  misc_feature (298)..(298): n is a, c, g, or t
tcagagacgcactccacgaccggtgctcgatttagagtagtgatcaggggagctcgtgggagacgagcccagcactggaagtcgccggtgtttccattcggtgatcatcactgaacacagaggtactcaccagtggtagtttgggctggacgtcgttgggttttccncgttgccttacgttttaaggaggttcgtccgaggtcgccagggtgccgaggtcgtgggtggagtcggtgggggagtcggtcggccctaggccgtaggggacgtcccaaggtaacctcgttccgtagtacgngttctcgtggtacttccgaactttaggttactatcgtcgtatcgcgtacggtcgggtccgccgggctaccgaggacggaacggggtcctggggaggttcggggtacgtacgtaaggtttactaactccgtaagttcggagtacggggaactaccggtaaacgttaaacgtccggtaacgtaccgaaacgtcccgtttaaccgggtaaacggtaccggggtaccctaacgttcccgaaacccggttatacccggtacgtaaacggaacgtaacgtaacgttaacccgaaacgtaaccgtacgtaccttacgtacttactaacgactaaacgtacgaacgtccgcgtaggaacgtggtacgagggaccgacggtaccggtcgttaaggttcgttaacgtttacggcgggttaaacgcgggtaaagtaggtacggttaaggtaccggttacgggttagttaaacgttaaaccgggg

SEQ ID NO: 230408 - DNA, 815 bp, Homo sapiens
  misc_feature: GYAE6OF01DGWT3.3.4.A04.1.454.CMB.1.raw
tcagagacgcactccacgaccggtgctcgatttagagtagtgatcgagggagctctgggagacgagcccagcactggaagtcgccggtgtttccattcggtgatcatcactgaacacgagaggactcaccagtggagtttggctgagtcgttcgggttttcctcgttgtctttacgttttaaggaggttcgtccgagtcgaccgtaggtgcgaggtcgtgggtgggtacgtcgggtgggggacgccggtccggcccgaggccggttggggaccgtacccgaaggtaccttccgtcgtagtaccgtagttcctcgtaggtacttaccgttaaccgtttaacggttaactagttcggtacttacgtcgtaccgttacgggtttccggggtccccggtccgggccctaccggacgggacggtaacgggggtcgtacggggtaggttcggggtacgtcgttaagtttaactacgtacccgagttacgaggtacgggagtaaccgtaaagtaacccgttccgaaccgacgtaaccggtccggtacggtacgggaaccggtccgtacgttacccgacctacgttccgacgtaaacgaacctaacgtaaacgttacccgaaacgtaccgtacccggttacgtacgttacgtacgtacgtaaacctaagtaccgaacgtaccgtaccgtagaacggtcgtaggtaccggaaacggtacccgtacggttaccgttaggttaaccgttaacgtttcggtaggtacggtaacgaagtacggtaacggttacggtaggttaacggtacgttaacgggttaaaccggg

SEQ ID NO: 230409 - DNA, 857 bp, Homo sapiens
  misc_feature: GYAE6OF01AC010.3.4.A04.1.454.CMB.1.raw
  modified_base (674)..(674): a, c, t, g, unknown or other
  misc_feature (674)..(674): n is a, c, g, or t
tcagagacgcactccacgaccggtgctcgatttagagtagtgatcagggggatcaggactcctcagttcaccttctcacaatgaggctccctgctcagtctccgtggggcttgctaatgctcgtggtccaggactccgaggtgggatgttgtgatagactcgacgtctaccacgtcctccgtcgtcccgtactacccgttgggacctacggcccggtccctaccacgttccgtccgtggtaccgtacgggttactaacggttacaaaacggtcccttaccgggtaatacctacggtacgtaacgtaacggtaaaccctacccgtttaagttacgggtaacttttacgggttacgaacggtacggaacggtacggacccgtaacggtaccctaaacgtcctaaccggaaacggtccgttaaaccttaagttttaccgtaacggtttaccggtaaccggtaacgttccggtaacgggtaccaaggacctaagttacgtacgtacggacggtacgacggttagggaccacgggtactgttaacgtcgttaccgaacgtaagttaacgaaacgtcgaagaccgggttaggtaggacggtagtaggtaacggtagtttaacggttgggttaacttagcgtactacggtacgaacgtaacgggtaacctacgggttaacncccgggtaaccgttaccggaccggtttacccgggaaccggtacccggggttaaacgtaaacgggtaaccgtaaaccggtaaccgaaaacgggttacggtaggttaacccggccggtttacgaaaccccggttaccggttagtttacccgtaaggtttccttaaacccgtcccgttaaacccgg

SEQ ID NO: 230410 - DNA, 883 bp, Homo sapiens
  misc_feature: GYAE6OF01BK9GX.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccagtggtagtttgggctggagtcgttgggtttttccctcggtttagtctttactttttaaaggacggttcgtccctaggtcgccgagggttgcgaggtcgttgggtggaggtcggtggggggaggtcggtcggcccaggtccgtaggggaccggtccccgaaggaaccttccgtccgtgtaccgagttcctcgtggtactttccgtaacgtttaggttactacgtgtcttagtcgacctacggttccggggccggtcccgggccttacccggacggtaccggtaaacgggggtccgtagggggtaacgggtggggggttacggtaccggtttaaggtttaaaccgttccgttaacccgtaaggttggaagggttacggggaacggtacgtaaacggttaaaacccgtcccgtaaaccgtacggaaacccggtaccggttaccgggtaagggtaaaccggggtcccgtaacgttacccggaaccttacgttacccgaaccgaacgaaaccgtaaacctaaacgttaaaccgaaaccgtaaaccgtaccggtacgtttacgtaaccgtaccgtaagaaaccttaaacggtaacgaaacgtacccggtaccgtaaggaaccgggaacgtaaccggttaacgggaaacgggtacccgtaacgggtaccgttaccggttagttaccggttacgtacggtacggaaggtagtaacggtacggtaggtaacggtttacgggtaacgtaacggttaaaccggg

SEQ ID NO: 230411 - DNA, 917 bp, Homo sapiens
  misc_feature: GYAE6OF01C35XF.3.4.A04.1.454.CMB.1.raw
  modified_base (183)..(183): a, c, t, g, unknown or other
  misc_feature (183)..(183): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccagtggacgtttggctgagtcgttcgggttttcctcgttgacttacttttaaggnggtcgtccaggtcgccgtaggtcgcagtcggtggtggagtcgggtgggggagtcggtcgccaggccgtggggaacgtcccgaaggtaccttcgtcgtagtacgtacgttctcgtaggtacctttacgtaacccgtttaaggtttaacctagttacggtaccttagtaccgaccggtaaccgggtttcccgggggtccccggtacccggggtaccccgtaccgggaaacgggtacccgggtaaagggggttccggtaggggtacgggtttaggggtacggtaccgttaaacgggttttactaccgttaacccgtaggttagggtaacggttaacggggtacggtaaccgttaaaacgggttaaaaccgttaccccgttaaccggtaacccggtaaaccgggttaacccccgggtttacggggtaaaacccggggtaaccgggtttaaccccggtaaccgttttaaccccgaaaccccgtttaaccgttaacccccgttaaaccgggaaacggtaaaccgttaaacccgttaaaccgttaaacccggtaaacgaaccgtaaccggtaccgttataccgttacgtaacgaactaaacgtacgaacgtacgtacgtagagtacggtacgacggtaacggaccggtacgttcgttacggtagttaacgttaggtacgttacggacggtaaagtaggttacggacggttaggtaacgggtacgttaacggttaaacgggg

SEQ ID NO: 230412 - DNA, 780 bp, Homo sapiens
  misc_feature: GYAE6OF01CVRIS.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttcttttaagaggtgtccagtgccaggtgcagtctgggtggagtcgtgggggaggcgtcggcccaggccgtggggacggtcccaggaacctctcctgtacagtctctggtacttcaccttaggttactatgctatgctacgtcgggtccgccggtcctccgaggacgaaggggtctagggaggtgggtaggcgtaggtttaactactacccgtagtcggtaagttggggacggactaaacggtaaaacttcccgtaaacggccgtaaacggtacccgttccggtagggaaacggggtacccgtaacgttaccctaacccgtaactacccgttacccgaaacggtaacgaaaccgttaaaacgttaaccccgaaacgtaaaacccgtaaccggtaccgttaacgttaaccgttaccgtacggaaaccttaaaacgttaacggaaaaccgtaccggtaacccgtagggaaaccggtaggtaacccgttagggaaaccgggtaaccgtaaccggggtcttaagggttacgtttaaagtttacccggttaggtacgtacgggaaagtaacggtagttacgggtaaggttcggggttaacgtaaacggtttaaaacgggg

SEQ ID NO: 230413 - DNA, 897 bp, Homo sapiens
  misc_feature: GYAE6OF01CAN6S.3.4.A04.1.454.CMB.1.raw
  modified_base (217)..(217): a, c, t, g, unknown or other
  misc_feature (217)..(217): n is a, c, g, or t
  modified_base (290)..(290): a, c, t, g, unknown or other
  misc_feature (290)..(290): n is a, c, g, or t
tcagagacgcactccacgaccggtgctcgatttagagtagtgatcaggggagctcgtgggagacgagcccagcactggaagtcgccggtgtttccattcggtgatcatcactgaacacagaggactcaaccgagtggagtttgggctggagtcgtttgggtttttcctcggttgtccttacgtttttaaggaggttcgtccgaggtcgccgagggtncgagtcgtgggtggagtcggtgggggacgcgtcggcccagccgttgggacgtcccgaggtacctcgttccgtntacgacgttctcgtacggtaactttaccgtaaccgtttaaggttaacctagtcgtaccttaagtcggtaccgtaacgggttccgggggtcccggtcccggggaccttacccgggaaacggggaccgggtaaacggggggtccggtttaggggaacggggtttgggggttacggtaaccttaaaggtttttaaccgacgttaacccgtaggttacgggtaaaggtacggggaacggaacgttaaacggttaaacgtcccgtaaccggacgtaacggaaccggttccgggaaagggtaacccgggtccttaaccgtacccgtaacctaacgttaccgtaacgaaggtaaaccggtaactaaacgttaacccgaaacgtaaccgtaacgtcgttaaccgtacttaccgaagtaaaccgtaaacgtaaccgtaaacggaccgtaaccgtaacggaacgtaacggtacggtaacggaaccgggtaaccggttacgggttacgttacggttaacgtttaacggtttacggtacggttaacgggaccggttaaaggagggttaacgtagggttaacggttaacggggtaaccggttaaaggtttaaaaccgggg

SEQ ID NO: 230414 - DNA, 692 bp, Homo sapiens
  misc_feature: GYAE6OF01EG5CW.3.4.A04.1.454.CMB.1.raw
  modified_base (157)..(157): a, c, t, g, unknown or other
  misc_feature (157)..(157): n is a, c, g, or t
  modified_base (312)..(312): a, c, t, g, unknown or other
  misc_feature (312)..(312): n is a, c, g, or t
  modified_base (377)..(377): a, c, t, g, unknown or other
  misc_feature (377)..(377): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcgtggtttccncgttagctacgtttaagaggtgtcgagtgcagtgcagctggtggagtcgtgggggacgcgtcggcctaggccgtacggggacgtacccaaggtaacctctaccgtagactaggttctacgtggacttaccgacctttaggttaactatcgtactnggctacggttcgggccggcggctccgaggacgagggcttagggaggtgggcgataggttataccnccgtaagtggaagtgggaaggtactaaagtaacctcggtacacgacggaccgttcggaactagggggtaccctacgttaccaaccgtacctaccgtacccgtaagaacgtaactaaactaacccgaaacgtaaccgtaacgaccgttacgtaactactaacgtaactaaagtcgtaaacgtacgtacggtaaccgtaggtaccgtacgtaggtacggtacgtaccggacgttaggttacgttacgttacgtaggtcggtaacgaaggttaggtaacgtacggtagggttaggttaccgtaaggtttaaaccgggg

SEQ ID NO: 230415 - DNA, 725 bp, Homo sapiens
  misc_feature: GYAE6OF01BIC3E.3.4.A04.1.454.CMB.1.raw
  modified_base (278)..(278): a, c, t, g, unknown or other
  misc_feature (278)..(278): n is a, c, g, or t
  modified_base (373)..(373): a, c, t, g, unknown or other
  misc_feature (373)..(373): n is a, c, g, or t
  modified_base (669)..(669): a, c, t, g, unknown or other
  misc_feature (669)..(669): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccagtggagtttgggctgagtcgttgggttttcctcgttgcttcgttttaaggaggttgtcccaggtcgccgtaggtgcagcgtgggtggaggtcggtgggggacgcgtcggccagccgtggggacgtcccgaggtacctctccgtgtacngtctcgtggtacttcgtaccgtttaggttactagtcgctagtgactcgtcgggccgcggctcgaggcgagggcgtggaggtgggtgctagttacncgtccagtgagtgggaacgtcgtaaacgtaaactccgtaacgctaacggtaccgttacccgggtagggaaccggttcccgtaattacccaaaccgttcgttaccctacccgaaaggtaaaccgttaaccctaacgttacccgaaaagtacccgtacggtaccgttacggtaacttccgtaagaaacctaaaggtccgaaaccgtcggaccctaaggaacggtacgtacccggaggaaaccgggttccaagggttcgttaacggttaggtttactaccggtagggtcgtaaacgggngtaacggtttacggacgggttaccggtaaggggttaacctagggtttaaaaccggg

SEQ ID NO: 230416 - DNA, 737 bp, Homo sapiens
  misc_feature: GYAE6OF01C5HIL.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaaacacagaggactcaccatggagtttgggctgagcgttcgggttttcctcgttgcttacttttaagaggtgtccagtgccaggtgcagtcgtgggtggagtcgtgggggagcgtcggcccagccgtggggacgtccaggtactcctcgtgtacgatcgtctggtacttcgtacctttaggttacctatcgtactatgctacggtcggggtcccgccgggtctaccgacggacgaacggggtctgggtaggtgggtggactagttactctaccgatggtagtagggacgtacgtaaacgtaacctccgtaacggaccaacgtaccgttacggtacgggaacgggtccgtacttaccgacctacgtacctaccgaagtaaacgtaaacgtaacttaacccgaaacgaaaccgtaccgtacgtacgtacttcgacgtaacgaaagtacggaacctacggtaccgtaggacggtacgtaccgtacgggaacggtaacccggtaccgggttacgttaggttacggtttaacgtttacggttacgggttaacggaccgggtaagggtaacgttaacgggttacggtaacggggtttccggggtaacgttaaacgggtttaaaacccgggg

SEQ ID NO: 230417 - DNA, 765 bp, Homo sapiens
  misc_feature: GYAE6OF01BNRQF.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttcttttaagaggtgtccagtgccaggtgcagcgtgggtggagtcgtgggggaggcgtcggcccagccgtgggacggtcccgaggacctctcctgtacagtctcgtggattccaccttaggttactatgtctatcgcctacgtcgggtccggccgggtctccgagggcgaagggggctgggaggtggggtggacgtaggtttatacgtccctagtcggagtggggacggtacgtaaacgttaaaccgtcccgtaacggtaccgtaacggtacccggttacccggttacggggaaaccggggtcccgttaacgttaccccgtaaaccccttaaccgttacccgtacccgtaaaggaaacgtaaacccgttaaactttaaccccgaaaacggtaaaccctaacggttacgtacgttacgttaacgttaccgtaacgaaactaaacgtaacgtaaccgaccgtaccgaaggtacggaccgtacggaacgggacggtaccggtaccggttacggtttacggttacgtttacggttacggttggtacggtacggaaggtacggttaggtacgggttacgggtacggttacggttaaaacccgggg

SEQ ID NO: 230418 - DNA, 695 bp, Homo sapiens
  misc_feature: GYAE6OF01C8J32.3.4.A04.1.454.CMB.1.raw
  modified_base (136)..(136): a, c, t, g, unknown or other
  misc_feature (136)..(136): n is a, c, g, or t
  modified_base (183)..(183): a, c, t, g, unknown or other
  misc_feature (183)..(183): n is a, c, g, or t
tcagagacgcactccacgaccggtgctcgatttagagtagtgatcaggggagctctgggagacgagcccagcactggaagtcgccggttgtttccattcggtgatcatcactgaacacagaggactcaccagtggngtttgggctgagtcgttgggttttcctcgttgcttacgttttaaggnggtgtccaggtcgccgaggttgcgagtcgtgggtggaggtcggtgggggagcggtcggcccaggccgtggggacgtcccaggtacctctcgtgtacagtctcgtggtacttctacctttaggttactagtcgctatgcgtacgttcggggtcccgccgggtctccgagggacggaacggggctagggtaggtggggtgcgtaagtttacgtactaccgtagtacggtagtgggaacgtacgtaaagttaaacctccgtaaccgcgtaacgtaccgttaccgggtacgggaaccgggtcccgttagttcccgaaccgtacgttaccgtaccaaggtaacgtaacctaacgttaacccgaaacgaactaaccgtcgtagttacgttacgtacgaactaaacgtacgaaccgacgtacgtaggaagcgtacgtaggaacggaccgacgtgtacgtacgttagttacgtcggtagacgtagtagtaggtagtaggttacggtagtagttaaacggg

SEQ ID NO: 230419 - DNA, 790 bp, Homo sapiens
  misc_feature: GYAE6OF01BF111.3.4.A04.1.454.CMB.1.raw
  modified_base (167)..(167): a, c, t, g, unknown or other
  misc_feature (167)..(167): n is a, c, g, or t
  modified_base (175)..(175): a, c, t, g, unknown or other
  misc_feature (175)..(175): n is a, c, g, or t
tcagagacgcactccacgaccggtgctcgatttagagtagtgatcagggggagctctgggagacgagcccagcactggaagtcgccggtgtttccattcggtgatcatcactgaacacagaggactcacatggagtttgggctgagcttgggttttcctgttgcttnttttaagnggtgtccagtgccaggtgcagtcgtgggtggagtcggtaggggggagcgtcggacccagcccgtggggaccgtcccaaggaccttcgtccgtagtacctagtctcgtggtacttccaccgtttaggtttactactgtactatgacctacggttccggggcccggtccgggtcctccggagggaccggaaggggtcggtacgggtagggttggggtcggtacttaaggtttactacctccgtagttacgggagtagggtaagggacctaaaggttaaacctaccgtaaccggactaaccggtaaccgttaccgggtaagggaaccggggtccgttacgtacccgtaaccgtacttcccgtaaccgaaggtaaaccggtaaactaaaccgtaaaccccgtaaacgtaaacccgaccggttaccttacggttaccttacgtaacggtaactaaacgttcggaaaccgtacggaccctagggtaacggaacggtacggtaaggaacgggtaccggtaaccggttgtacggtttacgttaagtttaccggttggtccggaacggtaagtaaggtacgtaaggtgggttaacggggttacgtaaaggtttaaacccggggg

SEQ ID NO: 230420 - DNA, 795 bp, Homo sapiens
  misc_feature: GYAE6OF01E2EAR.3.4.A04.1.454.CMB.1.raw
  modified_base (219)..(219): a, c, t, g, unknown or other
  misc_feature (219)..(219): n is a, c, g, or t
tcagagacgcactccacgaccggtgctcgatttagagtagtgatcaggggagctctgggagacgagcccagcactggaagtcgccggttgtttccattcggtgatcatcactgaacacagagactcacatggtagtttgggctgagtcgttggtttttcctgtttgtcttacgtttttaaggaggttgtccgagtcgccgaggtgcaggcgtgggtggnggtcgggtggggcggcggtcggccgaggccggtaggggtacgtacccgaggtacctctccgtagtactgtctcgtaggtacttcctaccgtttaggtactagtgtactagtcgaccgtccgggttcggggtcccggacccgggtcctccgggacgggaccgggtaagggggtccggtaggggtacgggttggggaggtacgttagttaccgttactaccgtagtcgggagtacgggagtaaccgtaaacgttaaccgtccgaaccggagtacccgtacggttcgggaacggggtaaccggtccgttaacctaccgtaacccgttacgtaccgtaaccggaaacgtaaccgtaaacctaacgttaaaccgaaaaccgtacgacccgttacgtttacgtaccttacgtaacgtaacgtaacgtaacaaccgtacgtaccgtaggtaacgacggtacgtaggaccggtaccgtcggttacgttaggtttacgttacgtttaccgttagggaacggacggttaacggagttaaagggtggttaacgggttccgggttaaaggttaacgggttaaacgggg

SEQ ID NO: 230421 - DNA, 697 bp, Homo sapiens
  misc_feature: GYAE6OF01AL5MZ.3.4.A04.1.454.CMB.1.raw
  modified_base (315)..(315): a, c, t, g, unknown or other
  misc_feature (315)..(315): n is a, c, g, or t
tcagagacgcactccacgaccggtgctcgatttagagtagtgatcagggggagctctgggagacgagcccagcactggaagtcgccggtgtttccattcggtgatcatcactgaacacagaggactcacagtggagtttgggctggagtcttgggtttcctcgttagtcttacttttaaggagtcgtccaggtcgccgtaggtgctagcgtgggtggtagtcggtgggggagcggtcggaccaggcgtgggtacggtccctaggtacctctcgtagactggtctcgacggtattcctaaccgttaggtactacgnggtactagttcgacctcgggtaccgggtccggacccggtcgtaccggtgggacggtaaggggtccggtaggtcgggttagggtcgaacgttaacgtttacaccgtaccgaggtcgacggtacggtacgggtaactacggttaaacctcgttaacgccgtaagaccggtacggtggacggtcctacgtacacctcgtactacgaacggtacaacgtaacctacgaacgttacgagtaccttggtaactcggtactaacgaacgtcgtaacgacgttacggtacgaacggttctaacgggtacgacgtacggtagttccctagtaccgttagtggtacggtgaagtaatcggagttatacggttggaaccgttgtaaaccgggg

SEQ ID NO: 230422 - DNA, 782 bp, Homo sapiens
  misc_feature: GYAE6OF01C9UZT.3.4.A04.1.454.CMB.1.raw
  modified_base (183)..(183): a, c, t, g, unknown or other
  misc_feature (183)..(183): n is a, c, g, or t
  modified_base (187)..(187): a, c, t, g, unknown or other
  misc_feature (187)..(187): n is a, c, g, or t
  modified_base (202)..(202): a, c, t, g, unknown or other
  misc_feature (202)..(202): n is a, c, g, or t
  modified_base (281)..(281): a, c, t, g, unknown or other
  misc_feature (281)..(281): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcgaccagtggtagtttcgggctgagtcgttggtttcctcgttgcttacgttttaaggnggtntccagtcgccaggtnacagcgttggtgtagtcggtagggggacgcgtcggcccaggtccgtgggacgtaccgaaggtacctctccgtagtaccngttcacgttggtacttacctaaccgtttaggttaacctagtcggtaccttatcggtacctacggttcggggtcccggaccgggtccgtaccggaagggtaccggaaacgggggttcgtacggggtacgggtacgggtacggacgttaagttttacctacgtacccgtaagtgaaaggtcggggaagtaccgtaaaggttaaaccctccgtaacgacgacggtacgtaccggtaaaggacccgggactaaccgttacgaacccgttacgtacccgtaccgtaaagtacctaaacgttaaaccgtaccgaaaaccggtacgtaaccgttacgtaccgtaagtttccgaaacggtaacctaaacgttacggacctaaccgggtacctaagggacctagggttacccgagggttaacggacctaggtccgtttaggaacgttacgttacgtgggccgtaagtaccggtagtaggtacgtacggttacggtaactaacggtacggg

SEQ ID NO: 230423 - DNA, 840 bp, Homo sapiens
  misc_feature: GYAE6OF01DTLW3.3.4.A04.1.454.CMB.1.raw
  modified_base (468)..(468): a, c, t, g, unknown or other
  misc_feature (468)..(468): n is a, c, g, or t
tcagagacgcactccacgaccggtgctcgatttagagtagtgatcgaggggagctcgtgggagacgagcccagcactggaagtcgccggtgtttccattcggtgatcatcactagaacacgagagactcacagtggtgtttggctggagtcgtttggttttcctcggttgtacttgttttaaggaggttgtccgtaggtcgccgtaggtcgacgtgtcggttgggtggtaggttcgggtaggggggacggtccggttccgggaccccggacggtcccggttacgggggtaacccggttaccccgaacgggttaacccttccgtttacccgagttacctacgttccttacggtaggttacctttaccgttaaccgttttaaggtttacctacggttcgtaccttagtccgccggttacgggttccggggtccccgaccggggtcctacgggacggacgggtacggggtnttaggggtgggtcgggtgaacgttacgttactacgtaccgagttagggacgtacggaggtaacctaaacgtaacgtccgtaaccggtcgtaaacggtcgtacccgggtaagggtaaccggtaccgtaacgttacccaacgtaccgtacgtaccgtaacgtaaccgtaaacctaacgtaaaccgaacgtaaacgtccgtaacgttaacgttactaacgtaacgtaacgtaaacgtaacgaacgacggtacctaggacctaacggcgtacggacggtaaccgtacggtacgttaggttacgttacggttacgtaggtacggaaggtacgtaaggtgtaacggtaggttaacggttaaagtacggttaaaacggg

SEQ ID NO: 230424 - DNA, 645 bp, Homo sapiens
  misc_feature: GYAE6OF01DOJIO.3.4.A04.1.454.CMB.1.raw
  modified_base (264)..(264): a, c, t, g, unknown or other
  misc_feature (264)..(264): n is a, c, g, or t
  modified_base (298)..(298): a, c, t, g, unknown or other
  misc_feature (298)..(298): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttcttttaagaggtgtccagtgccaggtgcagctgggtggagtcgtgggggagcggtcggcccaggccgtggggacgtcccgaggaactctcctgtacngtctcgtggacttcaccttaggttactatgctangcctacgtcggggtccgccgggtctccgagggacgaggggctgggaggtgggtggctaagttactactccagtaggagtagggacgtacgtaagtaaacgtcccgtaacgcgaacgtaccgtaccggtaggaaccgggtcctaacttcccaaccgtactccgacgaagtacgaactaaactacaaacgaaccgtacgtactagtactctagacctaaagacgaactacgaccgtagacgacgtacgacggaacgaccgtacggtaccgttaggtacgttagttaacgtggtacggacggtagtaacggtgttaacgggaggttacgggtacggttagttaaacgggg

SEQ ID NO: 230425 - DNA, 728 bp, Homo sapiens
  misc_feature: GYAE6OF01BFES2.3.4.A04.1.454.CMB.1.raw
  modified_base (687)..(687): a, c, t, g, unknown or other
  misc_feature (687)..(687): n is a, c, g, or t
  modified_base (692)..(692): a, c, t, g, unknown or other
  misc_feature (692)..(692): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccagtggagtttgggctggagtcgttcgggtttttccctcgtttgtctttcgttttaaggacggttcgtcccgaggttcggccgagggtcgcgaggtcgtgggtggacggttcggtggggggacggcggtcggcccgacgggtccgtagggggaccggtccccgaacggtacctccgttccgtagtacctgtctcgtgtactttaccgtaaccgttttaaggtttacctattcggtacttacgtcgccgtaccggttcccgggggcccggtcccgggtccgtacccgggacggtaccggaagggggtcgtaggggtacggtggggtgtaacgtagtttaccgtatccgtagtggtagtagggacgtactaaacgttacgtaccgcgacgacgtacggtcggacggacgggtacctactccacctactaccgacgaagactaacgtaacgtaaccgaagaaccgtcgtacctagtacgtactacgtaactaagactacgaacgtcgaaggacgagtacgacggagtcggacgttaggtacgttagttacgtgacggtaggngaagngtaagtacggttaggacggttacgtaaggttacggg

SEQ ID NO: 230426 - DNA, 679 bp, Homo sapiens
  misc_feature: GYAE6OF01A157X.3.4.A04.1.454.CMB.1.raw
  modified_base (505)..(505): a, c, t, g, unknown or other
  misc_feature (505)..(505): n is a, c, g, or t
  modified_base (618)..(618): a, c, t, g, unknown or other
  misc_feature (618)..(618): n is a, c, g, or t
tcagagacgcactccacgaccggtgctcgatttagagtagtgatcaggggagctctgggagacgagcccagcactggaagtcgccggttgtttccattcggtgatcatcactagaacacagaggactcaccatggagtttgggctgagtcttgggttttcctcgttgcttcttttaagaggtgtccagtcgccgaggtgcagtcgtgggtggaggtcgtggggggaggcggtcggccccgaggccgtggggacggtcccgaaggaacctctccgtagtacagtctcgtggtattacctactttaggttactatgctatgctacgtggggtcccgccgggctccggagggacgaggggtcgtagggaggtgggtggacgtagttatactccagtcgagtgggaacggacgtaagtaaacctccgtaacgaccaagaccgttcggacggtaacgggcccgtattacccaccgactcctacgaagacaacgtaaacttacccggaaanaaccaccgtacttacgtacttactagaactaactacgaaactcggtaaccgacgggtaagacggttacagggaaccggtacgtaccgggtgtttagtacgttatttaaccggngggttaacgacgaaggtagtaggttacgtagggttcgggtaaacgttacgggttaaacggg

SEQ ID NO: 230427 - DNA, 756 bp, Homo sapiens
  misc_feature: GYAE6OF01AZYKH.3.4.A04.1.454.CMB.1.raw
  modified_base (154)..(154): a, c, t, g, unknown or other
  misc_feature (154)..(154): n is a, c, g, or t
  modified_base (233)..(233): a, c, t, g, unknown or other
  misc_feature (233)..(233): n is a, c, g, or t
  modified_base (505)..(505): a, c, t, g, unknown or other
  misc_feature (505)..(505): n is a, c, g, or t
  modified_base (723)..(723): a, c, t, g, unknown or other
  misc_feature (723)..(723): n is a, c, g, or t
tcagagacgcactccacgaccggtgctcgatttagagtagtgatcagggggatcaggactcctcagttcaccttctcacaatgaggctccctgctcagctccgtgggctgctaatgctcgtcgggtcccaggactccgaggtgggagttgttgngtatcgtactctagtcctccactcctccgtccgtcccgtacctaccgtaggacaccggcccggcctcacgttcctccgngacgtacggtctacgacaacgtccgtagtaactacgagtagaacgtacgtaacctaccttaggttagttagttacggttacacgacgacggacggccgacgtaacctatccggacgacggtaccttacgttaatttacgttaacggttacccgtacgggtccgtacggtaccgggtaccaacgtacgtcgtacgtacgcgggtaggtacgtacgggtccggtcgacggtactagttaccggttacttaaacgcctaaaggtaactaacggtntagggacggggtaagggtacgggacgttagggtaaggttagggttacggtttttcgggtttaaggtttaacgttcgtaggaaccgtagggttaacgccgggtaaaagtcccgtaacggttccgtacgggtaccccgttacgggacgtaccccggaacggtaaaccggggacgttaaggaacctaggtacccgaagcggttcggacggttcaacccgtnccgttacttccggtactccgtgtaccctccccg

SEQ ID NO: 230428 - DNA, 714 bp, Homo sapiens
  misc_feature: GYAE6OF01A45SW.3.4.A04.1.454.CMB.1.raw
  modified_base (199)..(199): a, c, t, g, unknown or other
  misc_feature (199)..(199): n is a, c, g, or t
  modified_base (261)..(261): a, c, t, g, unknown or other
  misc_feature (261)..(261): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcgttgggttttcctcgttgcttattttaagaggtcgtacagtgccgaggtgcngcgtggtggagtcggtgggggagcgtcggcccagccgtgggacgtccaggactctctgtacncgtctcgtgtattcctacgttaggttactgtgtctatcgctaccggtcgggcccggccgggtccaccggagggacggaaggggtcgtagggtgggtacgggtcggtacgttaaggttaactaccgtaccgtagtaggtaaggtacggggaacgtacgtaaacgttaaacctcccgtaacgggactaccgggtaccgtaccggggtaaagggtaaccgggtaccctaacgtacccgaaccttacgtacccgtaaccgaagaaacgtaacctaaccgtaaacgaaaccgtaccgtaccggtactagtacgtacgacgtaactaacgtacgaaccgtacgacggtagacggtacgacggtaggaacggtactcggtcgtacggttgtacgttacggtaggtacgacgggtagtaacgtacgtacgggttaaggtcggtaaagtaacggttaaaggg

SEQ ID NO: 230429 - DNA, 729 bp, Homo sapiens
  misc_feature: GYAE6OF01BVO91.3.4.A04.1.454.CMB.1.raw
  modified_base (263)..(263): a, c, t, g, unknown or other
  misc_feature (263)..(263): n is a, c, g, or t
tcagagacgcactccacgaccggtgctcgatttagagtagtgatcaggggagctctgggagacgagcccagcactggaagtcgccggtgttccattcggtgatcatcactgaacacagaggactcaccagtggagtttgggctgagcttgggttttcctcgttgcttctttaagaggtgtccagtgccgaggtgcagcgtgggtggagtcgtgggggacgcgtcggcccagccgtgggacgtccgaggtactctacgtgtacngtctcgtgtacttctaaccgttaggttactatgactatcggtccaccggtcggggtcccgaccgggtccgtaccgagggccggtaagggggtcgttaggggacggttggggtacggtaccgttaagtttaacgtacttaccccgaaagttcggtaacgtggggaacgtacctaaaggtaaaacctccgtacgtacgaacggtaccgtacggtaggaacgggacccgtaacttacccgaactactaccgtacaaggaaactaactaaaccgtaaccgaaacgtaactaaccggacttagttaacgtctaaggaacgtaaacgtccgaaaacctacggtaccgtaaggaaccgacgacggtacgggaacccgtaacggtcgacggttagttacgttaacgttagttcgggacgaggtaacgaagtaggttaggtaaccggttgggtaaccgttaaagggttaaacggg

SEQ ID NO: 230430 - DNA, 639 bp, Homo sapiens
  misc_feature: GYAE6OF01CBUX2.3.4.A04.1.454.CMB.1.raw
  modified_base (210)..(210): a, c, t, g, unknown or other
  misc_feature (210)..(210): n is a, c, g, or t
  modified_base (252)..(252): a, c, t, g, unknown or other
  misc_feature (252)..(252): n is a, c, g, or t
  modified_base (305)..(305): a, c, t, g, unknown or other
  misc_feature (305)..(305): n is a, c, g, or t
  modified_base (332)..(332): a, c, t, g, unknown or other
  misc_feature (332)..(332): n is a, c, g, or t
tcagagacgcactccacgaccggtgctcgatttagagtagtgatcgagggggagctctgggagacgagcccagcactggaagtcgccggtgtttccattcggtgatcatcactgaacacagaggactcaccatggtagtttgggctgagcggtcggtttccgcgtagctctttaagaggtgtcagtcgccaggtgcagctaggtgcgtgnggggagtcgtgccagctgggacgtccaggtactcgctgtacngtctgtggtatcgtaaccttaggtactatgctagcgcacgttcggccgcggcnccgagacaagggtcgtaggcggtgggngtactaaggtatcgccttaagtcggagtagggacaccgtaaaggtaaaccgtcgtaacaccgaacggtaccgttaccgggacgttaaccgggacggttacgttacgacccgtagttacctaccgtaggtaacaaccggttaaactaccctaaagaaccgttaacggcttaggtaccttacctaaggaacctaagacgtaacgtacggaccttaggaagtccgagttacgacgtaaccgtgtaccgtagtacgttaccgtagtcgtagacgtcgaagtactaaggtgtcggtaagtcgttaaaccggg

SEQ ID NO: 230431 - DNA, 884 bp, Homo sapiens
  misc_feature: GYAE6OF01AW1S4.3.4.A04.1.454.CMB.1.raw
  modified_base (124)..(124): a, c, t, g, unknown or other
  misc_feature (124)..(124): n is a, c, g, or t
  modified_base (181)..(181): a, c, t, g, unknown or other
  misc_feature (181)..(181): n is a, c, g, or t
  modified_base (393)..(393): a, c, t, g, unknown or other
  misc_feature (393)..(393): n is a, c, g, or t
tcagagacgcactccacgaccggtgctcgatttagagtagtgatcaggggagctctgggagacgagcccagcactggaagtcgccggtgtttccattcggtgatcatcactgaacacagagacncaccagtggagtttgggctgagtcgttgggttttcctcgttgtcttacgttttaagnggtctccgagtcgccgtaggtcgacgtaggtcgtgggtgggtacggtcgggtaggggggacggtccggcggacccgcggccggttaggggaaccgtcccgaaggtacctcgtctgtactagtcgtcgtagtactttacctaccgttagtactactagtactacgtgcgtacggtcgggtccggtccgggcctaccggaggaccggaggggtntacgggaggtagggtcacgtagttaactaccgtaccagtgtaacggtaggaacgtaacgtaaacgttaaacctacggttacccgtaaacgtacggaaaccggtttacccgggtaacgggtaaaccgggttaccggtaaccgttaacccctaaaccgttacccttaacgtaaacccgttaacgggttaaaccgaaaaccgtttaaaccggttaaaacccaaaccggtaaaccgttaaccgtacccggttaaagtacccgttaacggtaactaaaccgttaaacggttaaccggtaaacgttacccgggttaaaccgtgtaaaccgggttaaacgtaacggggttacccgtaacgggtaaaccgggtacccgtaccggggttttaaatacggggttaaaaccgttcgggtacggttaacggtaacgggaacttaacgggtagggttaaacgttacggggtacccgttaaagggttaacggtttaaaaaccggg

SEQ ID NO: 230432 - DNA, 591 bp, Homo sapiens
  misc_feature: GYAE6OF01BCDT6.3.4.A04.1.454.CMB.1.raw
  modified_base (159)..(159): a, c, t, g, unknown or other
  misc_feature (159)..(159): n is a, c, g, or t
  modified_base (247)..(247): a, c, t, g, unknown or other
  misc_feature (247)..(247): n is a, c, g, or t
  modified_base (363)..(363): a, c, t, g, unknown or other
  misc_feature (363)..(363): n is a, c, g, or t
  modified_base (456)..(456): a, c, t, g, unknown or other
  misc_feature (456)..(456): n is a, c, g, or t
tcagagacgcactccacgaccggtgctcgatttagagtagtgatcagggggagctctgggagacgagcccagcactggaagtcgccggtgtttccattcggtgatcatcactgaacacagaggactcaccatggagtttgggctgagctgggttttccncgttgctcttttaagaggtgtccagtgccaggtgcagctggtggagtctggggggagcgtggcccagcctggggagtcccaggactcncctgtacagtctcgtggattcaccttaggttactatgctatgcactggggtccgccgggctccgaggccaagggggctggggagtggggtggcaggttatactcccatgatggganacgtagtaaactcctaacggcaaggacctccggtaggaacgggcccgatttcaaccctatcctccagaacgaccaaattccaaagaactacgnttagatctagacctaaatcgaacacgccttaggaacgtacgcgttaggaacggaccacgggtctaggttacggttattaccgtggttgacgggagacgtagttgaagggttcggggtacgtaagtttaaaccggg

SEQ ID NO: 230433 - DNA, 923 bp, Homo sapiens
  misc_feature: GYAE6OF01CGP1Z.3.4.A04.1.454.CMB.1.raw
  modified_base (209)..(209): a, c, t, g, unknown or other
  misc_feature (209)..(209): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcgttgggttttcctcgttgcttcttttaagaggtcgtccagtgccgaggtgcgacggcgtggnggtaggtcggtgggggagcggtcggccgacggccgtgggacggtcccaggtaacctcgtcctgtacagttctcgtggtacttcctaccgttaggttacctatgacttagtcgccgtacggtcgggtcccggaccgggtcctcggaggaccggaggggtcgtaggggtacgggttggggtcggacgttacggttaactaccgttaccccgtagttacggaacggttcggggagggtaaccttaaacggttaaaacctaccccgttaacgaccgtaacgggttaaccccgtacccgggggtaaggaacccggggttacccgtaacgtttaccctaacccgtaccgttacccctaacccggtaaacggaaaccgtaaccgttaaaaacccgtttacccggaaaaacccgaaaccgggtacccgtaaccgttttaccgggtttaaacccttcgggttaaccgtaaaaccgtaaaacggttcccggaaaaaccggtaccccggttaacgggtacggtaaacccgggtaggttaacccgggtacgggaaaaaccggggtacccggggttaacggtacccccggttttaaggttaacgggttttaaacccgtttagggttacccggttaaaggggtaacccggggtagtaaacgggttacggttacggggtaggggtttaaaccggggttaccggtaaaagggttttaaaaccccgggggg

SEQ ID NO: 230434 - DNA, 737 bp, Homo sapiens
  misc_feature: GYAE6OF01EFTZV.3.4.A04.1.454.CMB.1.raw
  modified_base (587)..(587): a, c, t, g, unknown or other
  misc_feature (587)..(587): n is a, c, g, or t
  modified_base (619)..(619): a, c, t, g, unknown or other
  misc_feature (619)..(619): n is a, c, g, or t
  modified_base (635)..(635): a, c, t, g, unknown or other
  misc_feature (635)..(635): n is a, c, g, or t
  modified_base (656)..(656): a, c, t, g, unknown or other
  misc_feature (656)..(656): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagtcgtttggggtttttcctcggtttgtctttacgtttttaaaggaggttcgtcccgagttcgccgaggtcgcacggtcgtgggtggacgttcggtggggggacgcggtcggcccgaggccggtaggggacgtacccgaggtaacctccgtccgtagtacgtgtctcgtaggtactttccgtaccgtttaggttactatgtactagtcgccgtcgtcgggtcccggccgggtcctccggagggtaccggaaggggtcgtagggtaggtggggtacgtagtaagtttacgtacctaccgtaagtggtaggtcgggaacggtacgtaacggttaaaactccgtaacgtacgaacgtaccgtccgggtaagggtaccggaccgtaacgttacccacgtaccgtcctacgaagtaacgaactaacgtaccaaacgtaaccgtacgtntacggtactacgtacgaactaaagcgaaaccnggacctaggacgtacncggtacggacgacgtacggtnttaaggttcgttaacgttaggtacggtcggaggtaaggaagttaggacggtagggtttacgggtacgtaggttaaacgggg

SEQ ID NO: 230435 - DNA, 773 bp, Homo sapiens
  misc_feature: GYAE6OF01ASO5J.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccagtggagtttgggctgaggtcgtgggtttcctcgtgcttacgttttaagaggtcgtccagtgcctaggtgcaggcgtgggtggagtcggtggggggacgcggtcggcccaggccgtggggacggtacccaggtacctcctccgtagtacagtcctcgtcggtacttccgtaccgtttaaggttactacgtcgtactagtcggtactaccggtcggggtccccggccggtacctcccgagggtccggaaggggtccgtagggacggtggggtcggtacgtaggttactacgttaccgagttagacgtcggggacgtacgtaaacgtaactccgtacggacgaacgtaccgtacggtacgggaacggtccgtacctacctaaccgtaacgtcccgtaaccgaggtaaccgtaacctaaccgttaaccgaaccgtaacctaccggtacttacgtacgtaccgtacgtaaacgtaacgttaagaacccgtacggtaccgtaggtaacgacggtacgtaccggaaacggtacccggtcggtacgttaccgggttaagttacgttacccgggttaggtacggtacggaaggtaaccggttaacggttaacgggtacggtttacgggtaacgttaacgggttaaaccgggg

SEQ ID NO: 230436 - DNA, 940 bp, Homo sapiens
  misc_feature: GYAE6OF01BF8K0.3.4.A04.1.454.CMB.1.raw
tcagagacgcactccacgaccggtgctcgatttagagtagtgatcaggggagctctgggagacgagcccagcactggaagtcgcccgtgtttccattcggtgatcatcactgaacacagaggactcaccatggagtttggctgagtcgttcgggttttcctcgttcgcttacgtttttaaggacggttgtccaggtcgccgtagggttgcgaggccgttgggtaggtacggttcgggtacggggggaggtccggttcgggaccctagggtacccgttgggggaaccggttccccgaacgggtaaccttccgttaccgttaggttaaccgtacggttccttacggttacgggtaacttttacccgtaaccgttttaacgggtttaacctaagttcggtaccgttaacgtccggtaccgttaacgggttccggggtcccggtaccgggttccgtaccggtaacgggtacggaacggggtcggtggggtacgggttggggttacggacgttaggttaactaccgtaccgagttacgacggtaacggggtacgtaacccgtaacgttaaaaccgtcccggtaacgtaccgtaaccggtaaccgttaccggttaaccgggtaaacgggtcccgttaaccgttaacccgaaccgttactacccgtaccgaacgtaaacgtaactaaaccgtaacccggaaagtaaccgtaaccggtaccgttagttaaccctacgttaaccgaagtaaaccgtaacggtaaccgaacccggttaccgtaaggtaaccggtacgtacgggtacggtaaaccgggaccgtaaccgggttcgttaagggtttaaccgttaccggtttagtaccgggttaacgacccgggttaaacggaacgttaaggggttaccgttaaaccgggtacgggtttaaacccgtaggtttaaaacccgggg

SEQ ID NO: 230437 - DNA, 929 bp, Homo sapiens
  misc_feature: GYAE6OF01CHPGC.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaaggactcaccgatggagtttgggctggagtcgttcgggtttttcctcgtttgcctttactttttaaggaggttcgtaccagttcgaccgtagggtgcacggtcgtgggtggacggttcggtaggggggaggtccggtacggcccgaggtcccggtaggggaccggttaccccgaaggtaacccttccgtaccgttacgtaaccgtacgttccctacgttcgggtaactttcctaacccgttttaaggtttacttaacgtcgtacttaacgtgtaccgtacggtttccggggtcccgtacccggggtcctaccccggtaaggggacccgggtaaaacgggggggtcgttaggggtacggggtttcgggggagggtacccgttaacgggtttaacgttaaccgtaccccggtaagttacggaacggttagggggaaccggtaacggtaaaacgtaaaccgttacccggttaacgacctaaaccgggtacccggttacccgggtacgggaaccggggtacctaccgttacccgtaaccgtacgttacccgtacccggaaagtaaccgtaaccgttaaccgtaaccgaacgtaacccgtacgtaccgttagttaacctcggttacgaaccgtaaggtaccgtaaaccggtacggtacgttaccgggaataccgggttaacggtacgggaaccgtaccgggtacggtaccgtttaggttacggtttaacggttaccggtaggttaaccgggcggtaaggtaacgggtacgtacgggttaaacggtacgggtaaggtaaccggtttaaaccgggg

SEQ ID NO: 230438 - DNA, 910 bp, Homo sapiens
  misc_feature: GYAE6OF01EU94J.3.4.A04.1.454.CMB.1.raw
  modified_base (88)..(88): a, c, t, g, unknown or other
  misc_feature (88)..(88): n is a, c, g, or t
  modified_base (179)..(179): a, c, t, g, unknown or other
  misc_feature (179)..(179): n is a, c, g, or t
tcagagacgcactccacgaccggtgctcgatttagagtagtgatcagggagctctgggagacgagcccagcactggaagtcgccggtnttccagttcgtgatcatcactagaacacagaggacctcaccagtggtaggtttggctgagtcgttcggtttcctgttgtccttagttaagnggtcgtcagtcgaccgtaggtcgactgtcgtgggtggacggtcgggtagggggcggtccggtccggacccgacggtccggttacggggaccgtacccgacggtaaccttccgtaccgtacgtaccgtgtaccgtcgttaggtactttaccgtacgtttacggttaacctagtcgtacttactacggtaccgtaccgggttccggggtcccgggtcccggtcccggtaaccggtaccgggaccgggaacggggttcgggtacgggtagggtcggggtacgtacggtaacttacgtaaccctaccgtaagtgggtaacgtacggggtacgtaacggtaaacgtaacccgtaccgtacggaaccgtaaccggttaccggtaccgggtaacgggtaaccgggttaccgtaacctaacccgtaccccttacgtaacccgttaacccggaacgtaaacccgtaaccttaaaccggtaaacccgtaaccggtaaccgttaacggttacccttaaaccgggttatacccggttaaactaacccgggttaaacgtaacccgtaaacggtacccgtacgggttaacggaacggttaaccgggaacgttaacggggccggtaaaacccggtcgggtttaccgtacgggttttaaacgtcggtttacggtaggttacccgggagttaccgaaggttacggtaacgttacgggggtacgttaaccggttaagggttaaccgggg

SEQ ID NO: 230439 - DNA, 833 bp, Homo sapiens
  misc_feature: GYAE6OF01DCYQI.3.4.A04.1.454.CMB.1.raw
  modified_base (178)..(178): a, c, t, g, unknown or other
  misc_feature (178)..(178): n is a, c, g, or t
tcagagacgcactccacgaccggtgctcgatttagagtagtgatcagggagctctgggagacgagcccagcactggaagtcgccggtgtttccattcggtgatcatcactgaacacagaggactcaccatggtagtttgggctgagtcgttgggttttcctcgttgcttcttttaagnggtacgtccagtgccgaggtgcagctggtggagtcggtgggggagcgtcggcccagccgtggacggtccaggactctactgtacagtctcgtgtacttactaccgtttaggttactagtgtaccttagtcgacgtacggtccggggtcccggccgggtaccgtccgaacgggaccggtaagggggtccgttaggggtagggttggggtcgggtacttaaggtttaacgtaaccgtaccctaggttaggtacgttacggggacggtactaaaacggttaaacccgttacccgaacgtacgaacggtcccggttaacggtacgggaaccgggtcccgtaaagtttacccaacccgttacgtttcccaaccgtaaaggtaccgtaaaacgtttaaacccgttacccgaaaacgtaacccacggtcttaaccggttacttacgtaacgtaaaccgtaaagtaaccggaacccgtaaggttcccgtaaggaaacggtccgttaaacggacggggtaaaccgtaaacccgggtcgggttaccgttagggtttaacggtttaccgttttaaggttcgggaaccgtagggttaaacggagttttaacggaaacggggttagggtttaaccggggtaaaccgtttaacgggtttaaaaccgggg

SEQ ID NO: 230440 - DNA, 750 bp, Homo sapiens
  misc_feature: GYAE6OF01C0GRV.3.4.A04.1.454.CMB.1.raw
  modified_base (129)..(129): a, c, t, g, unknown or other
  misc_feature (129)..(129): n is a, c, g, or t
  modified_base (187)..(187): a, c, t, g, unknown or other
  misc_feature (187)..(187): n is a, c, g, or t
  modified_base (519)..(519): a, c, t, g, unknown or other
  misc_feature (519)..(519): n is a, c, g, or t
  modified_base (620)..(620): a, c, t, g, unknown or other
  misc_feature (620)..(620): n is a, c, g, or t
  modified_base (698)..(698): a, c, t, g, unknown or other
  misc_feature (698)..(698): n is a, c, g, or t
  modified_base (719)..(719): a, c, t, g, unknown or other
  misc_feature (719)..(719): n is a, c, g, or t
  modified_base (735)..(735): a, c, t, g, unknown or other
  misc_feature (735)..(735): n is a, c, g, or t
tcagagacgcactccacgaccggtgctcgatttagagtagtgatcgaggggagctcgtgggagacgagcccagcactggagtcgccggtgtttccagttcggtgatcatcactgaacacgagtagactnacagtggagtttggctggagtcgtttggtttcctggttcgtcgtttaagttttaaggnggttcgtaccgtaggtcgaccgtaggtgccgaggtcgttagggtggacggtcgggtaggggggcgtcggtccggccgtacggtccggttaggggacccgttacccgaaaggttccttccgttccggtagtaaccgtgttccgttgtacggttaccttaccgttaaccggtttaggttacctagtacgtcgttacgtccgacggtccgggtccggggtcccgacccgggcgtacggagggtccgggtaagggtcgtagggtgggtacggggtacgtactaaggtttaccacgtaccgtggtacggaggttacggacgtacgtaaacgttaccncggtaacgcgtaacgtccggacgtacgggaccgtactaccgttcgaaccagttaccgaccgaagacccgtaaacaccggtaacgaaccgcgtaagcgttancgtacgaataaccgtaagctacggacgtacggtacgacgtcgtacgacggacgacgttacgtagttataccggttagnggtttacgagtcgaacgtagnggtaaagtgggtaacncggtaagttaacggg

SEQ ID NO: 230441 - DNA, 696 bp, Homo sapiens
  misc_feature: GYAE6OF01A5UQL.3.4.A04.1.454.CMB.1.raw
  modified_base (263)..(263): a, c, t, g, unknown or other
  misc_feature (263)..(263): n is a, c, g, or t
tcagagacgcactccacgaccggtgctcgatttagagtagtgatcaggggagctctgggagacgagcccagcactggaagtcgccggtgtttccagttcggtgatcatcactgaacacagaggactcaccatgggtagtttgggctgagcttgggttttcctcgttgcttcgttttaagaggtgtccagtgcaggtgcagtcgtgggtggagtcggtgggggagcgtacggcccaggccgtgggacgtccgaggactctcctntacgatctctggtacttcctacgttagttactatgacttatcgcgacggtcgggccccggccggtccgtccgagggcggaggggcgtgggaggtgggtgtcctaggttacctactcccgtagtggagtacggggacgacgtaaacgtaacctaccgtaaccgacgtaaccggtaccggttccggtaacggaacggggtacctacgttacccgaacctaccgtccgtaacgaacgtaacgtaacgtaaaccttaaccgaaacgtaacctacgtacgttacgtacgtctaacgaacgtaaacgtccgaacgtacgaccgtaggacgtacgcggtaacggacggtaccgtacgggttcgtaggttaccgttagttaccgtagggtcgaaggacgtacggtagtacggtaggtagggttaaccgtagggttaaacgg

SEQ ID NO: 230442 - DNA, 726 bp, Homo sapiens
  misc_feature: GYAE6OF01A75TT.3.4.A04.1.454.CMB.1.raw
  modified_base (282)..(282): a, c, t, g, unknown or other
  misc_feature (282)..(282): n is a, c, g, or t
tcagagacgcactccacgaccggtgctcgatttagagtagtgatcgaggggagctctgggagacgagcccagcactggaagtcgccggtgtttccattcggtgatcatcactgaacacagaggactcaccagtggagtttgggctggagtcgttgggtttttcctcggttgtcttacgttttaaggaggttgtccagtcgccgaggtgccagcgtgggtggacgttcggtgggggagcgtggccccgaggccgtgggacgtcccaggacctcgtctgtaacncgtcgtcgtagtacttccgtaaccgtttaggttactacgtgacttagtccgactaccgggtcgggtccccggaccggtccttacccggaggggtacccggaagggggtcctaggggtagggtcggggttacgacgttagttaactaccgtccgaagttcgaaggtcggtaacgattaaacggtaacctccgtacgacgacgtaccgtacggaggtaaccggtcgtacctacaccgtactccgacgtacgaacgtaacctaacgtacgaaacgtaccgtgtaccgtagtactcgtaacgaactaagtcgaaacgtccgactagacgacgtacgtacggaccgacggtacgtcgttagggttctaaaccggttgaagggtccgtaaaggtacgtaacggtcgtttaagggaaccgggtttcgaaacgggttaaccggttaaacggg

SEQ ID NO: 230443 - DNA, 778 bp, Homo sapiens
  misc_feature: GYAE6OF01EANOR.3.4.A04.1.454.CMB.1.raw
  modified_base (105)..(105): a, c, t, g, unknown or other
  misc_feature (105)..(105): n is a, c, g, or t
  modified_base (214)..(214): a, c, t, g, unknown or other
  misc_feature (214)..(214): n is a, c, g, or t
tcagagacgcactccacgaccggtgctcgatttagagtagtgatcaggggagctcgtgggagacgacgcccagcactggaagtcgccggttgtttccattcggtnatcatcactgaacacagagctcaccagtggtagtttggctgacgtcgtttgggttttccctacgtttgactttacgttttaagacggttcgtctagtccgcgagggttnaccgtagtcggttgggtaggtacggtcgggtacggggggtacggtccggtacggacccgtacggtccggtaggggaccgttacccgagtacctccgttaccgtcggtaactcgttcctcgttacggtaccttttaccgttaaccgtttacggttaacttcgtacggttctaacgttcggtaccgttccgggttcggggccccggtaccgggtcgtacccggtaggggacccgggtagggtccggtagggttacggtcggggtacgttacttaacggttacctaaccggtcgtacgtcggtaagacgggtactaactaacggtaacgtcacggtcgtaacgtccggtcgagggacgtctacgtacactctacgtacgaacgtacgaactacgtaccaacgtacgtacgtcttactacgttagtacgtacaacgtacgtaaccgtcggatacgtagcgtacggtacggtaccggacgtcggtaacgttcggttaacgttcggttataggtcggacggtagtacggtacggtacggtaaggttcggtaacggttaaggttaaccggg

SEQ ID NO: 230444 - DNA, 695 bp, Homo sapiens
  misc_feature: GYAE6OF01EBWPY.3.4.A04.1.454.CMB.1.raw
  modified_base (259)..(259): a, c, t, g, unknown or other
  misc_feature (259)..(259): n is a, c, g, or t
tcagagacgcactccacgaccggtgctcgatttagagtagtgatcaggggagctctgggagacgagcccagcactggaagtcgccggtgtttccattcggtgatcatcactgaacacagagactcaccatggagtttgggctgagcttgggttttcctcgttgcttcttttaagaggtgtccagtgccaggtgcagctggtggagtcggtgggggagcgtggcccagccgtgggacgtcccaggtactctccgtgtacngtctcgtggtattcacctttaggttactatgctatgctacgtgggtccgccgggctccgaggtacgaaggggcgtaggaggtggggtgctaggttactactaccagtacgagtaggacggactaagttaaacgtccgtacgacgaacggtaccgtaccgtacgggaacgggtccgtacttaccgaacccacttccgtaccgaagaacgtaacctaaacttaaccgaaacgaacctaccgtacttagttaccttacgtacgtaactaaacgtacgaactacggtaaccgtaggaaccggtaaggtaccgtagggtaacggaccggtaaccgggtacgttaggttaacggtttaactttaggttgggtacggtaccggtaaggtaaggtacggttaggtaacgggttagggttaccggtaaacgttttaaaccggggg

SEQ ID NO: 230445 - DNA, 963 bp, Homo sapiens
  misc_feature: GYAE6OF01B9YVZ.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccagtggtagtttgggctgagtcgttcggttttcctcgttgtcttacgttttaagaggttcgtaccgagtcgccgtaaggtgcgaggtcgtgggtaggtacggtcgggtaggggggacgtcggtccggacccgacggccggtaggggaaccggtacccgaacggtaacccttccgttaccgtacggtaaccgtacgttccgttacgttcggttaaccttttaccgtaaacccgtttttaacgggtttaaccttacgtttacggtaccttaaacgttccggacccgttaaccgggttccggggggtccccgggtcccgggtacccgtttccgggaaacgggttacccgggaaacgggggtcggtacgggggtacgggtttcgggggtacggtaacgttaaaccggtttaacgttaccgttacccgttaagggtcgtaacggggttaacgggtaacggtaaccgttaaacggttaaaccgtaccccggttaacgaccgttaaaccggtaccccggttaacccggggttaacggggaaccgggttacccgtaaccgttaccctaacccggttacctaaccccgtaccggtaacggtaaacctaacgttaaaccgttaacccgaaccggtaacgtaccgtaccgttacggttaactaccggttaagaaccgtaaacgtaacgaacgtacgtacggtacggaacgtcgaacggtacgggtaaccggtaccggtacggttaccggttaggtttaacgttcgggttaccggttaggtcggaacgggttaagaaccggtttagtagggttaaggttaccggtaggtttaacggtttaaccgggg

SEQ ID NO: 230446 - DNA, 674 bp, Homo sapiens
  misc_feature: GYAE6OF01EOV6Z.3.4.A04.1.454.CMB.1.raw
  modified_base (178)..(178): a, c, t, g, unknown or other
  misc_feature (178)..(178): n is a, c, g, or t
tcagagacgcactccacgaccggtgctcgatttagagtagtgatcagggggagctctgggagacgagcccagcactggaagtcgccggtgtttccattcggtgatcatcactgaacacagaggactcaccatggaggtttgggctgagtcttgggttttcctcgttgcttctttaagnggtgtccagtcgccgaggtgcagcgtgggtggaggtcggtggggggacgtcggtcggcccaggccgtggggacggtacccgaggtaacctcctcctagtacctcgtccttcgtggtacttacctaccgtttaggttactagtcgtctagtcgaccgtacggtcggggtcccggccgggtcctccggacgggacggaaggggcgtgggtacggtgggtgactagttatactccgagtggagtggagactaagtaactccgtacgcgtacgaccggtcgtacgggacggtcgtactaccacctcgtcctacgaaggtaacgtaacctataacccgaagaccgtacgtctagtcctacgtacaacgtaatacgaacgacgtcgtaagacgagacgtagggaccggacgtacggttcgttaggttacgttacgttcggtagggtcgaaggtacgaagttcggtaaggtaggttcgggtaaacgttagggttaaaccgggg

SEQ ID NO: 230447 - DNA, 749 bp, Homo sapiens
  misc_feature: GYAE6OF01D6TX7.3.4.A04.1.454.CMB.1.raw
  modified_base (179)..(179): a, c, t, g, unknown or other
  misc_feature (179)..(179): n is a, c, g, or t
tcagagacgcactccacgaccggtgctcgatttagagtagtgatcagggggatcaggactcctcagttcaccttctcacaatgaggctccctgctcagctccgtggggctgactaatgctcgtgggtcccaaggactcgaggtgggattgttgtgatgactgatcctccactcctcccncgcccgtctaccgtggacacgccgacctcacgtctcgtgacgtagtctaagtacaaacgtccttagtactaacgaggttagaataacggaaaactaccttaattacgttaagttcggtttacaacgtacgaacggacggaccgtaacggacctaacgtaccgtacggaacggtacgttaaccttaaaagttttacggtaaacggttacgtaaccggacgttacggttacgggaccagtacgaagtactagacggcggagtacggtacgggtacaacggtctacgtagtactttacgaaactaaacgtaaagaaagtacggaagtacgggtaagggacggtaggtacgtaggaacggtttggtttaagggttaggtttaactcgtaggtataacggagttaaacccgagtaccgtaacgtccggtccgtaaccgtccggttaaccgggtcgaaccgtaccgggtaacgtaaagggtaaacctaaaggaaaccgtaaacgggtaacgttgggtaccgtacaccgttaaacgacccgtagttaccgttacgtacctttcggaccttaacccgg

SEQ ID NO: 230448 - DNA, 750 bp, Homo sapiens
  misc_feature: GYAE6OF01A7H0T.3.4.A04.1.454.CMB.1.raw
  modified_base (162)..(162): a, c, t, g, unknown or other
  misc_feature (162)..(162): n is a, c, g, or t
  modified_base (179)..(179): a, c, t, g, unknown or other
  misc_feature (179)..(179): n is a, c, g, or t
  modified_base (418)..(418): a, c, t, g, unknown or other
  misc_feature (418)..(418): n is a, c, g, or t
  modified_base (607)..(607): a, c, t, g, unknown or other
  misc_feature (607)..(607): n is a, c, g, or t
tcagagacgcactccacgaccggtgctcgatttagagtagtgatcaggggagctctgggagacgagcccagcactggaagtcgccggtgttccattcggtgactcatcactgaacacagaggactcaccagtggtagtttgggctgagtcttgggttttccncgttgcttactttaagnggtctccagtgccgtaggtcgcagcgtggtgtaggtcgtaggggtagcggtcggcccgtaggccgtagggtcgtaccccgaaggtaaccttcgtccgttagtaccgtagttccttacgtaggtaacttacccgtaaccctttaaggtttaactacgttcgtacctacgttcgtaccgtacggttcgggtacccggtccgggtacctcccggtaagggccggaaaggggtcgtaaggggngtttcggggacggtcgttaaggttataccgtaccgtagtacggtacgtgggaacggtcaaacgttaacgtaccgttacggacgtaacggtaccgtaccggtaggtaaccggtaccgttacctacgttaccgtaacttaccccgacgtaacgtaacggtaactaacgttaccgaacgtaacaaccgggtntacgtatccgttagaactaacggtacacgtacgccgtagacgtatccgtagaacccgtggtccgtagtaggttagtccgtttagaggtcccgaggtacgtagtaaccgtacggttaaaggtcgggtaagttacggtaacgggg

SEQ ID NO: 230449 - DNA, 642 bp, Homo sapiens
  misc_feature: GYAE6OF01CBAM3.3.4.A04.1.454.CMB.1.raw
  modified_base (179)..(179): a, c, t, g, unknown or other
  misc_feature (179)..(179): n is a, c, g, or t
  modified_base (265)..(265): a, c, t, g, unknown or other
  misc_feature (265)..(265): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgctcttttaagaggtntcagtgccaggtgcagcgtgggtggagtcgtgggggagcggtcggcccagccgtaggggacgtccccaggacctcctcctgtaccngttctcgtggattcaccttaggttactatgtctatgcagtcgggtccgccgggctccgacggcgaaggggctgggtagtggggtggctagtttactactccgagtgagtggaggctaagtaaactccgtaacgctaagtaccgtccggtaggaaccgggcctacttaccacctactcctaccgacgaacgaacctaactacctaaacgaaaccacgtacttaggtactcgtagtaaccaagtcgaacgacgtaccgtaggaagtacgacgtacgacgggaacctacgggacttagggttacgtttacgttacgtggttaccggaggaacggtagtaacggttagtaagggttcgggttaagtaaggtttaaacgggg

SEQ ID NO: 230450 - DNA, 938 bp, Homo sapiens
  misc_feature: GYAE6OF01BOBV4.3.4.A04.1.454.CMB.1.raw
tcagagacgcactccacgaccggtgctcgatttagagtagtgatcgaggggagctctgggagacgagcccagcactggaagtcgccggtgtttccattcggtgatcatcactgaacacagaggactcaccagtggagtttgggctggagtcgttgggttttcctcggttgtcttacgtttttaaggaggttcgtccgaggtcgccgtaggtcgacgacggtcgttgggtagggtacggttcgggtagggggggacggtccggtccggggaccccgaggtccggttacgggggaccggtaccccgaagggtaaccttccgtaccgttacgtaaccgtacggttccttacggttacggtacctttacccgtaaccgttttaacgggttaacctagttcgtacttaacgtcggaccgttaccgggtccggggtcccggccccgggtctaccgggacgggtacggaacggggtctaggggtacgggtgggtacggtacgttaacgtttacgtaccgttccggaaagttgggaaacgtcggggaaagttacgtaaacgttaaacgtccgtaacgacgtaacggtaccgttaccgggaacgggtaccggtaccgtacgttacccgaacgttacctaccggaaacgtaagaaccgttaaaccctaacgttaaacccgaacggtaaacccgtacggttaccttacgtaaacgtaccgttaagaaaaccgttaacggtaaacgtaaacccgtaccggtacccggttaacggtaaacgggaccggtaacggttaaccggaaaaccggggtaaccgttaacccgggttacgtttaacggggtttaaccgtaagtttttaccgggaccggttaagggaaacggttaaggaaccggttaaggaaccgggtttagggtacgggttaaaccgggaacgggtttttaaaacggg

SEQ ID NO: 230451 - DNA, 711 bp, Homo sapiens
  misc_feature: GYAE6OF01AP5GR.3.4.A04.1.454.CMB.1.raw
  modified_base (177)..(177): a, c, t, g, unknown or other
  misc_feature (177)..(177): n is a, c, g, or t
  modified_base (194)..(194): a, c, t, g, unknown or other
  misc_feature (194)..(194): n is a, c, g, or t
  modified_base (555)..(555): a, c, t, g, unknown or other
  misc_feature (555)..(555): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagtcttgggttttcctcgttgcttcttttaagnggtgtccagtgcaggtncagtcgtggtggagtcgtgggggagcgtggcccagccgtgggacgtcccaaggtacctccgtcctgtacagtctcgtggtacttcgaccgtttaggttacctagtcgtactagtcgcgtacgtcggggtcccgaccgggtctccgaggacgaaggggtctagggtaggtgggtcgtacgtagtttactaccttccgagtcgagtgggaacgtacaaggttaaactccgtaacgacagtaccgtccggaggtacggacgtactccgacctactccgtaccgaagtacgtaactaacctaaccgaacgtaaacccgacgtacgttacgtacttccgtaagaaaccgttaaagtccgtaaaccncggtaaccgttagggaacgtacgtacggtaacggaaccgtaccggacggttaccgttaggttacgtttacggttacggttacggtacggaacgggtaagtaacggtacgggttaaggttaacgggtacggttaaaccgtaacggtttaaacggggg

SEQ ID NO: 230452 - DNA, 695 bp, Homo sapiens
  misc_feature: GYAE6OF01ED3RX.3.4.A04.1.454.CMB.1.raw
  modified_base (171)..(171): a, c, t, g, unknown or other
  misc_feature (171)..(171): n is a, c, g, or t
  modified_base (174)..(174): a, c, t, g, unknown or other
  misc_feature (174)..(174): n is a, c, g, or t
  modified_base (182)..(182): a, c, t, g, unknown or other
  misc_feature (182)..(182): n is a, c, g, or t
  modified_base (188)..(188): a, c, t, g, unknown or other
  misc_feature (188)..(188): n is a, c, g, or t
  modified_base (207)..(207): a, c, t, g, unknown or other
  misc_feature (207)..(207): n is a, c, g, or t
  modified_base (259)..(259): a, c, t, g, unknown or other
  misc_feature (259)..(259): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcgtggttttctcgtgctctttaagngtntcagtgcnggtgcngctggtggagtcgtggggngcgtcggcccaggcccgtgggacggtccccgaggaaccttcctcctgtaacngttctcgtggtacttctaaccgtttaggttactatgccttagtgacctcggttcggggtcccgtccggggtacctccgagggacggaaggggtcgttaggggaagggtttgggcgggtacttaacgggtttctaccgtacccgtaattggaactaggggagtaccgtaaacgtttaaacgtccgtaaacggcctaacgtaacccgtacggtacgggaacgggtccgttacttaccaacccgttgcctacccgaaggtaactaacctaaaccttacccgaaaacgtaaccgtaccgtacgttacgtactcgttaacgaacttaaacgactaacggtaccgcgttaaggccgagtccgagggacgtacgcgtcgttagttagtactttggacgttgaacgtagaagtgtacgttaggtcggtaagtggttaaaaccgg

SEQ ID NO: 230453 - DNA, 629 bp, Homo sapiens
  misc_feature: GYAE6OF01AYHR1.3.4.A04.1.454.CMB.1.raw
  modified_base (179)..(179): a, c, t, g, unknown or other
  misc_feature (179)..(179): n is a, c, g, or t
  modified_base (194)..(194): a, c, t, g, unknown or other
  misc_feature (194)..(194): n is a, c, g, or t
  modified_base (469)..(469): a, c, t, g, unknown or other
  misc_feature (469)..(469): n is a, c, g, or t
  modified_base (477)..(477): a, c, t, g, unknown or other
  misc_feature (477)..(477): n is a, c, g, or t
  modified_base (509)..(509): a, c, t, g, unknown or other
  misc_feature (509)..(509): n is a, c, g, or t
  modified_base (514)..(514): a, c, t, g, unknown or other
  misc_feature (514)..(514): n is a, c, g, or t
tcagagacgcactccacgaccggtgctcgatttagagtagtgatcaggggagctctgggagacgagcccagcactggaagtcgccggtgttccattcggtgatcatcactgaacacagaggactcaccatggagtttgggctgagcttgggttttcctcgttgcttactttaagaggtntaccagtgccaggtncagctggtggagtcgtgggggagccgtcggcccaggccgtaggggacgttacccgaggtactctccgtgtaccagtctcgtaggtacttactaccgttaggttacctagtgacttatcgactacgttcggggtaccggcccgggtctaccgagggaccgaaggggctagggaggtcggggtgcgtacggtttactacgtacccgtagtcggtagtacgggacgacgtaacgtaactccgagctacggtaccgtcgtaggacggcctatccacgtntccacganaacgtactactaaccagaactacgctagtacncgtanacaatacgacgcgcgtagagtacgcgtacgaacgtccgaggtctggttacgttacgttaccgtggtaccgacggtaagtacgtagttaggtacgtcggtagtaacgttaaacggg

SEQ ID NO: 230454 - DNA, 855 bp, Homo sapiens
  misc_feature: GYAE6OF01D4ESL.3.4.A04.1.454.CMB.1.raw
tcagagacgcactccacgaccggtgctcgatttagagtagtgatcaggggagctcgtgggagacgacgcccagcactggaagtcgccggttgtttccagttcggtgatcatcactgaacacgagaggacctcaccatggtaggtttgggctgagtcgtttgggttttcctgttgtctttacgttttaagaggtcgtcctaggtcgccgtagggtgcgacggtcgttggggtgggaacggttccgggtggggggacggccggtacgggacccccgaggtcccggtaggggaccggtacccgaaggtaaccttcctaccgtagtacgtacgttcgtcgtgtactttccgtaacctttaggttactatgtctagtgacgtacggtcggggtcccgccgggtctaccggaggtccggaaggggtcggtagggacggttgggggtacgtacgtaagtttacgtaccgtaccgtaagtggtaggtagggaacggtacgtaaacgttaaactcccgtaacggccgtaaacggtaccgttaccgggtaagggaaccgggtaaccggttaccttaacgtaaccccgtagttacccgtaaccggaacgttaaaccgtaacctaaacgttaaaccccggaaaagtaacccggtaccgttacgtttaggttaaccttaccggtaagaaaccgtaaagtaacgtaaacgtaaccggtccgttaaggaaacggtggtaaccgttaggggaacgtaccggtaacgggtacgtttagtaaccgttttaacgttaggtacggttagacgggtaaagtacggttaacggttaggtaaccgggttcgggttaaaccgtaacggtttaaacgggg

SEQ ID NO: 230455 - DNA, 809 bp, Homo sapiens
  misc_feature: GYAE6OF01E21H0.3.4.A04.1.454.CMB.1.raw
  modified_base (509)..(509): a, c, t, g, unknown or other
  misc_feature (509)..(509): n is a, c, g, or t
  modified_base (758)..(758): a, c, t, g, unknown or other
  misc_feature (758)..(758): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggtagtttgggctgagtcttgggttttcctacggttgtctttacttttaaggacggttcgtcccagtcgccgtaggtcgccgtaggcgtgggttagggaggttcggtcgggggtacggcgggttccggaccccgtaggtcccggttagggggtaccggtacccccgtaagggttaacctccgttacccgtagttaaccgtacggtttccgtcgttacggtactttacccgttaaccgtttaacggtttactacgttcgacttaagtccgaccgttacggtccggggtacccggtccgccgtaccgaggacggtacggggtcgtcgggtggtacgggtcgtacgttaacgttaactcgtaccaagttgacgtggaacgngtaacgtactccgagtacgacgtaccgtggtacggaccgtacgtactcccgtactaaccgtcgtaccagtaaccgttaactaaccgtaaccggaacctaacgaaccgtttacgtaacgttaccgtcgttaacgaacgttaacgaaccgtaacggtaaccctacgggtaggtaaccgacgggttaacgacggttaaaccggacgtccgtaccgtggttaaacgttcgttaggtacggtcggaacccgtanacgggttaaacttacgggaaggttccggttaacggttaaaggtaaccgggg

SEQ ID NO: 230456 - DNA, 895 bp, Homo sapiens
  misc_feature: GYAE6OF01EGGVZ.3.4.A04.1.454.CMB.1.raw
tcagagacgcactccacgaccggtgctcgatttagagtagtgatcagggagctctgggagacgagcccagcactggaagtcgccggtgtttccattcggtgatcatcactgaacacagaggactcaccagtggagtttggctgagtcgttcgggttttcctcgttgtcttacgttttaaggacggttgtacccgaggtcgcccgtagggtcgccgaggtcgttagggtgggaacggttcgggttgggggggacggtccgggttaccgggaccccgtagggtccccggttagggggacccggttaccccggtaaacgggtaacccttccgttacccgttaggttaaccgaaggtttccgtaccgttacgggtacttttacccgtaaccgttttaaggttaaccttagttcgtacttacgtcggtaccgttaccgggtccggggtccccggccgggtaccgtcccggtaacggggtacggtaaacgggggtccggttaggggtacgggttggggtaccgggtacttaacggtttacttaccgtaccgtagtcggaggtcgggaacggtactaaacgttaaacgtcccgaacggacgaaccgtacgtaccggtagggaacccgggtctaacgttccacctacgttaccgaccgtaacgtaaccgaacgtaacttaccgaacgtaaccgaccgtacgttacgtactacgtaactaacgtaaacgtaacgaaccgtacgtacggtaagtacggaacggtaccgtaacggaaccggtaccggtaaccggtacgttacggttacgtttaacgttaccgggttacggtccgtaagggtaacggaacggtttaacggtacgggttaagggttacggggttaaacgttaaacggttaaacggggg

SEQ ID NO: 230457 - DNA, 611 bp, Homo sapiens
  misc_feature: GYAE6OF01BV3TX.3.4.A04.1.454.CMB.1.raw
  modified_base (178)..(178): a, c, t, g, unknown or other
  misc_feature (178)..(178): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagtcgttgggttttcctcgttgcttcttttaagnggtgtccagtgccaggtgcagctgggtggagtcggtgggggagcggtcggcccagccgtggggacgtacccaggtacctctccgtgtactgtctcgtggattcaccttaggttactatgctatgcagtcgggtccgccggctccgaggcgaaggggctagggaggtgggtgctagttatactccagtgacgtggacgacgaagttaaactcctacgacacgtaccgtcgtaggaacggcctataccacctatccacgagaacgactaacgtaccaagaaacctcgacgttgacttcgtacgaactaagttccgaaatcgtacgtacggaagacacggtaggaacggaaccggtaggtccttaggttacgtacgtttaagtggtacgacgtaaggtagtacgttggaacgggttggtaacgttagttaaacggg

SEQ ID NO: 230458 - DNA, 848 bp, Homo sapiens
  misc_feature: GYAE6OF01A7IFX.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggtagtttgggctgagtcgttgggttttcctcgttgcttcgttttaagaggttcgtccgtagtgccgtaggtgcagtcggtgggtggaggtcggtgggggacgtcggtcggcccaggccgtgggacgtcccgagtacctcgtccgtgtacagtctcgtggtactttccgtaccgtttaggttactagttacgtacgtactcggaccgtaccggttccggggttcccgggcccgggtccttccggaggccggaaacgggggtcggtacgggtagggttcggggtacggtactaacgggtttactaccgtacccgtatacgggaacgtacggggacggtaactaaacgttaaccgtcccgttaacggacccgtaacggtacccgtacgggtagggaacccggggtaccttaccgttaacccgaacccgttacgtaccgttaacccggtaaccgtaaaacgtaacccgtaaaccttaaacccggaaaccgaaccgttaaccggttaccgttaccggttaccttaccggtaaacggtactaaaaccggtacgtaaaccccggacccgtaacgggtacggaaacgcggggtaacctagggaacccgggtacgttaccgggtccgttaaggttacggttaactttccgggtaggttcgggaaccgtagggtacgttaacgggtagttaaggggtaaccgggtagttaaaacgggttaacgggg

SEQ ID NO: 230459 - DNA, 796 bp, Homo sapiens
  misc_feature: GYAE6OF01CY5K2.3.4.A04.1.454.CMB.1.raw
  modified_base (121)..(121): a, c, t, g, unknown or other
  misc_feature (121)..(121): n is a, c, g, or t
  modified_base (182)..(182): a, c, t, g, unknown or other
  misc_feature (182)..(182): n is a, c, g, or t
  modified_base (699)..(699): a, c, t, g, unknown or other
  misc_feature (699)..(699): n is a, c, g, or t
tcagagacgcactccacgaccggtgctcgatttagagtagtgatcaggggagctcgtgggagacgagcccagcactggaagtcggccggttgtttccattcggtgatcaatcatagaacanagagactcacagtggtgttggctgagtcgtttggtttcctgttgtactttacgtttaaggnggttcgtccgtagtcgccggtaggtcgcgtagtcggttgggtaggtacggtggggttagggggacgtccgggtacccggacccgacgggtaccgggtacggggaccggttaaccccgaacggttaacccttccgtaccgttacgttaaccgtcgttacgttgttacggttactttaccgtttaccgttttaacggtttacttaacgtcgttacgttacgtacggtaccgttacgggttcccgggggcccggtcccgggtaccgttaccgggaacgggaacggggtacggggtacgggttaggggtagggtttggggtacgtacgttaacggttacctactaccgtagtaggtacggtacggaagtacggtaaacgttaccgtacgacgtacgacgtaccggtacggtaacggacggtacctacgtaccactaccgtaccgtacgaacgtaacaacgtaacaacgtaacgacctacgtcgtagtacgtactaagaacgaacgtacaacgtacgtcganacgcgaagtcgacgtacgagtacgttagtacgttagtatcggtaaggagtaaggagtacggttagttagggttaacgtacggtttaaggtaaacggg

SEQ ID NO: 230460 - DNA, 833 bp, Homo sapiens
  misc_feature: GYAE6OF01C8943.3.4.A04.1.454.CMB.1.raw
  modified_base (746)..(746): a, c, t, g, unknown or other
  misc_feature (746)..(746): n is a, c, g, or t
  modified_base (778)..(778): a, c, t, g, unknown or other
  misc_feature (778)..(778): n is a, c, g, or t
tcagagacgcactccacgaccggtgctcgatttagagtagtgatcagggggagctcgtgggagacgacgcccagcacgtggaacgtcgccggtgtttccagttcggtgatcaatcactgaacacaagacgactcaccagtggtagtttcgggctggacgtcgtttgggttttcctcgttgtactttacgttttaaggcggttcgtaccgtaggttcggaccgtaggggttcaccgaggtcggtggggttagggacggtaccgggtaggggggagtccggtaccggccccgtaggtcccggtagggggtaccgtacccgaagggtaaccttccgtacgtacgttacgaggtttcctcgttacggtacttaccgttaaccgtttaaggtttacaacgttcgacgttaacgtcggaccgtaaccggggttccgggtacccgggccgggtacctaccgggaagggtaacgggtcgggggttcggtaggggtaacggggttggggtctaacgttacggtttaacgtcctaccgaagtggttaacgggacgggtacgtaaaccgtaaagttaaccctcggtaaccgaggttaacgtacccggttacgggtaccggaacgggtcctaacctaccgactcgtaccaacggaatacgaactaaacgtcgaaacgacggtactgtacgttctacgaagtactaaagtaccgaactacggtcgtaagacgtacgtaagtacgggacgaacgggttcnccgtttggttaacgtaacttcggttacgggtnaaggttagtcggtaaggttcgtaaacgggttcggtaaacgttaacggttaacggg

SEQ ID NO: 230461 - DNA, 703 bp, Homo sapiens
  misc_feature: GYAE6OF01D2L4R.3.4.A04.1.454.CMB.1.raw
  modified_base (320)..(320): a, c, t, g, unknown or other
  misc_feature (320)..(320): n is a, c, g, or t
  modified_base (601)..(601): a, c, t, g, unknown or other
  misc_feature (601)..(601): n is a, c, g, or t
  modified_base (608)..(608): a, c, t, g, unknown or other
  misc_feature (608)..(608): n is a, c, g, or t
tcagagacgcactccacgaccggtgctcgatttagagtagtgatcaggggagctctgggagacgagcccagcactggaagtcgccggtgttccattcggtgatcatcactgaacacagaggactcaccatgggagtttggctgagcgttgggtttcctcgttgcttacgtttaagaggtgtccaggtcgccgaggtgctacgcgtgggtggtaggtcggtggggggtacgcggtcggcccctagtccggtgggacggtcccgaggtaaccttcacgtgtactagtctgtacggtattcctacttaggttactatgactangccacggtcgggtccggaccgggccgtcggtacggacggaacggggtccgtagggacggtgggtggtacgtagttactacgtacctagtcgtaagtagggacgtaggtaacgtaaacgtacccgtacggacgacgtacggtaccgggtacggaacggggtcccgttaaactaccgtaacccgtactacctacggaatacgtaaaacctagtaacccaaacggaactaccggtactacgtactaccgtagaacaaacgtacggaaccaggtacgtaagacgngtaacgnggaacggtaaccgtaggtaccgtgttaacggttacttaggtcgtacgggtagacggaagtacgtaggtaggtacgggtctaagggttaaaccggg

SEQ ID NO: 230462 - DNA, 496 bp, Homo sapiens
  misc_feature: GYAE6OF02ILQE9.3.4.A04.1.454.CMB.1.raw
  modified_base (402)..(402): a, c, t, g, unknown or other
  misc_feature (402)..(402): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggtttcctcgttgctcttttaagaggtgtccagtgccaggtgcagctggtggagtctgggggaggcgtggcccagcctgggaggtcccaggactctcctgtacagtctctggattcaccttaggttactatgctatgcactgggtccgccgggctccaggcaaggggctggagtgggtggcaggttatatcccatgatggaggcagtaaatcctacgcagactccgtgaagggccgattcaccatctccaganacaattccaagaacacgctgtatctgcaaatgaacagcctgagagctgagacacggctgtgtattactgtgcgagagatgatgggtcgataacg

SEQ ID NO: 230463 - DNA, 499 bp, Homo sapiens
  misc_feature: GYAE6OF02I926I.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtctgggggagcgtggcccagcctgggaggtcccaggaactctcctgtacagtctctggattcaccttaggttactatgctatgcactgggtccgccgggctccaggcaaggggctgggagtgggtggcaggttatatcccatgatggaggcagtaaatcctacgcagactcgtgaagggccgattcaccatctccagagacaattccaagaacacgctgtatctgcaaatgaacagcctgagagctgaggacacggctgtgtattactgtgcgagagatgatgggtcgataacgg

SEQ ID NO: 230464 - DNA, 508 bp, Homo sapiens
  misc_feature: GYAE6OF02H98QW.3.4.A04.1.454.CMB.1.raw
  modified_base (247)..(247): a, c, t, g, unknown or other
  misc_feature (247)..(247): n is a, c, g, or t
  modified_base (339)..(339): a, c, t, g, unknown or other
  misc_feature (339)..(339): n is a, c, g, or t
  modified_base (361)..(361): a, c, t, g, unknown or other
  misc_feature (361)..(361): n is a, c, g, or t
  modified_base (376)..(376): a, c, t, g, unknown or other
  misc_feature (376)..(376): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtctgggggaggcgtggcccagcctgggaggtcccaggaactcncctgtacagtctctggattcaccttaggttactatgctatgcactgggtccgccgggctccaggcaaggggctgggagtgggtggcagttanatcccatgatggagcagtaaancctagcagactccgngaacggccgattccacatctcagagacaatccaagaacacgctgatctgacaaaatgaaacagcctagagagcaggacgacacggctgtgtaattacgtgtgaccgagagatagagtgggtacgattaacgg

SEQ ID NO: 230465 - DNA, 555 bp, Homo sapiens
  misc_feature: GYAE6OF02IBR7N.3.4.A04.1.454.CMB.1.raw
  modified_base (175)..(175): a, c, t, g, unknown or other
  misc_feature (175)..(175): n is a, c, g, or t
  modified_base (339)..(339): a, c, t, g, unknown or other
  misc_feature (339)..(339): n is a, c, g, or t
  modified_base (360)..(360): a, c, t, g, unknown or other
  misc_feature (360)..(360): n is a, c, g, or t
  modified_base (438)..(438): a, c, t, g, unknown or other
  misc_feature (438)..(438): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcgtggtttcgcgtagctctttaagaggtntcagtgccaggtgcagctggtggagtcgtgggggagcgtgggcccaggcctggggaggtcccaggaactctcctgtacagtctctggattcaccttaggttactatgctatgcacgtcgggtccgccgggctccgaggcaaggggctggagtgggtgcagttanactccatgatggagcagtaancctagcagactcggagaacgggccattcaccatctcagagacaatccaagaacagctgtatctagactaaatgaaacncgtacgagaagacgcgtaggaacgtacgacggtacgttagttacggttaacgttacgtaggtacggacgtaaggacgtaaggttcggtaaggtttcggggtaacgtaaggttaacgg

SEQ ID NO: 230466 - DNA, 510 bp, Homo sapiens
  misc_feature: GYAE6OF02INKBQ.3.4.A04.1.454.CMB.1.raw
  modified_base (466)..(466): a, c, t, g, unknown or other
  misc_feature (466)..(466): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgcttcttttaagaggtgtccagtgccaggtgcagctggtggagtcgtgggggaggcgtggcccagcctgggaggtcccaggaactctcctgtacagtctctggattcaccttaggttactatgctatgcactggggtccgccgggctccgaggcgaaggggctgggagtggggtggcagttatatccatgatggaggcagtaaatcctagcagactcgtgaagggccattcaccatctcagacgacaattacccaagaacacgctgtatctgacaaatgaacagcctgagagctgagacacggntggtgtattactggtgcgagagagtgagtgggtacgattaacgg

SEQ ID NO: 230467 - DNA, 525 bp, Homo sapiens
  misc_feature: GYAE6OF02JZ8QK.3.4.A04.1.454.CMB.1.raw
  modified_base (339)..(339): a, c, t, g, unknown or other
  misc_feature (339)..(339): n is a, c, g, or t
  modified_base (391)..(391): a, c, t, g, unknown or other
  misc_feature (391)..(391): n is a, c, g, or t
  modified_base (433)..(433): a, c, t, g, unknown or other
  misc_feature (433)..(433): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtgggggagcgtggcccagcctgggagtcccaggactctcctgtacagtctctggattcaccttaggttacctatgctatgcactgggtccgccgggctccaggccaaggggctgggagtgggtggcagttanatccatgatggagcagtaatcctacgcagctccgtgaagggccatcacatcncagagacaactccaagacacgctgtatctgacaaatcgaacngcctaggacgacgctagaacggacacgggtctaggtcgtattaccgtggtacggagaacggagtactggagtcggggtactaagttaaccgg

SEQ ID NO: 230468 - DNA, 504 bp, Homo sapiens
  misc_feature: GYAE6OF02HKGSP.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctctttaagaggtgtccagtgccaggtgcagctggtggagtctgggggaggcgtggcccagcctggggaggtcccaggaactctcctgtacagtctctggattcaccttaggttactatgctatgcactgggtccgccgggctccaggcaaggggctggagtgggtggcaggttatatcccatgatggagcagtaaatcctacgcagactccgtgaagggccgattcaccatcctccagagacaattccaagaacacgctagtatctgcaaatgaacagcctgagagctgaggacacggctggtgtattactggtgcgagagatgagtgggtcgataacgg

SEQ ID NO: 230469 - DNA, 546 bp, Homo sapiens
  misc_feature: GYAE6OF02IJYQW.3.4.A04.1.454.CMB.1.raw
  modified_base (173)..(173): a, c, t, g, unknown or other
  misc_feature (173)..(173): n is a, c, g, or t
  modified_base (176)..(176): a, c, t, g, unknown or other
  misc_feature (176)..(176): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcggtgttcgctaggctcttaagtaggntcngtgcagtgcagctgtgatctggggagcgtggccagcctgggagtccaggactctctgtacagtctctggattcaccttaggtactatgctatgcactgggtcccgccgggctaccgaggcgaaggggcctgggagtcggggtggcaggtttaatatcccgattgatggaggcagtaaactccgtacgactaggactccggtagaagggccgtattacaccattccacgagatactaactacaacgaacgacgtactactactactacgaacgtaagtacgaacgacgacgtacgacgtagacgtacgacgacgacgtcgtgtagtagttacgtagtgtacgagtagtagtagtagtcggtacgtagtacg

SEQ ID NO: 230470 - DNA, 633 bp, Homo sapiens
  misc_feature: GYAE6OF02FZHZZ.3.4.A04.1.454.CMB.1.raw
  modified_base (173)..(173): a, c, t, g, unknown or other
  misc_feature (173)..(173): n is a, c, g, or t
  modified_base (175)..(175): a, c, t, g, unknown or other
  misc_feature (175)..(175): n is a, c, g, or t
  modified_base (177)..(177): a, c, t, g, unknown or other
  misc_feature (177)..(177): n is a, c, g, or t
  modified_base (186)..(187): a, c, t, g, unknown or other
  misc_feature (186)..(187): n is a, c, g, or t
  modified_base (189)..(189): a, c, t, g, unknown or other
  misc_feature (189)..(189): n is a, c, g, or t
  modified_base (191)..(193): a, c, t, g, unknown or other
  misc_feature (191)..(193): n is a, c, g, or t
  modified_base (197)..(197): a, c, t, g, unknown or other
  misc_feature (197)..(197): n is a, c, g, or t
  modified_base (210)..(210): a, c, t, g, unknown or other
  misc_feature (210)..(210): n is a, c, g, or t
  modified_base (226)..(226): a, c, t, g, unknown or other
  misc_feature (226)..(226): n is a, c, g, or t
  modified_base (255)..(255): a, c, t, g, unknown or other
  misc_feature (255)..(255): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcggcgttcgctaggcgtcttaataggncngncagtgcagnngngnnngggngctgccagctggngccagactctctgacngtctctggattcaccttagttactatgtntatgcgtacgtcgggtccggccggccgtccgacggacggaacgggtcggtgggtaggtgggtggtacgtagttagtacgtaccgtagtagtagtaggaggacgtaacgtaacgtaccgtacgtacgacgtaccgtacgtacggacggtaccgtacgtacctacctactacctaccgtacgaacgtaacgtaacgtaaccgaaacgaaccgtaaccgtacgtacgtactacgtacgtaacgtaaacgtaacgtaacgtacgtaccgtacggtaacgtacgtacgtacggaacggaccgaccggtacgtacggttacggttacgttacgtacggtacgtacgtaggtaggtagtaggtaggtacggtacggtagtaacgg

SEQ ID NO: 230471 - DNA, 517 bp, Homo sapiens
  misc_feature: GYAE6OF02I29XT.3.4.A04.1.454.CMB.1.raw
  modified_base (379)..(379): a, c, t, g, unknown or other
  misc_feature (379)..(379): n is a, c, g, or t
  modified_base (400)..(400): a, c, t, g, unknown or other
  misc_feature (400)..(400): n is a, c, g, or t
  modified_base (403)..(403): a, c, t, g, unknown or other
  misc_feature (403)..(403): n is a, c, g, or t
  modified_base (405)..(405): a, c, t, g, unknown or other
  misc_feature (405)..(405): n is a, c, g, or t
  modified_base (416)..(416): a, c, t, g, unknown or other
  misc_feature (416)..(416): n is a, c, g, or t
  modified_base (434)..(434): a, c, t, g, unknown or other
  misc_feature (434)..(434): n is a, c, g, or t
  modified_base (437)..(437): a, c, t, g, unknown or other
  misc_feature (437)..(437): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcggtggtttcgcgtaggcgtcttaagtaggtgtcagtgccaggtgcagctggtggagtcgtgggggaggcgtggcccagcctgggaggtcccaggaactctcctgtacagtctcgtggattcaccttaggttactatgctatgctaacgtcggggtcccgccggggctccgagggccgaagggggctgggagtggggtggcagttatatcccatgatggagcagtaatcgtancagactcgtgaaggcatcacntcncngagacatacanacgacactgtatctcganaanagacacgcgagagagacgagacgacgacgcgtagtagtagttacgtagtgtacgagagtagtgtaggtggtagtagtacg

SEQ ID NO: 230472 - DNA, 518 bp, Homo sapiens
  misc_feature: GYAE6OF02FSD8T.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtgggggaggcgtggcccagcctgggaggtcccaggactctcctgtacagtctctggattcaccttaggttactatgctatgcactgggtccgccgggctccaggcaaggggctggagtgggtggcagttatatcccatgatggagcagtaaatcctacgcagactcgtagaaggccgattcaccatctccagagacaattccaagaacacgctagtatctagacaaatgaacacgacctagacgtagctaggaacggaccacggctgtaggtattactgtcgacgagagatggagtgggtcgtattaacgg

SEQ ID NO: 230473 - DNA, 573 bp, Homo sapiens
  misc_feature: GYAE6OF02GRWMX.3.4.A04.1.454.CMB.1.raw
  modified_base (168)..(168): a, c, t, g, unknown or other
  misc_feature (168)..(168): n is a, c, g, or t
  modified_base (176)..(176): a, c, t, g, unknown or other
  misc_feature (176)..(176): n is a, c, g, or t
  modified_base (355)..(355): a, c, t, g, unknown or other
  misc_feature (355)..(355): n is a, c, g, or t
tcagagacgcactccacgaccggtgctcgatttagagtagtgatcaggggaggctcgtgggagacgagcccagcactggaagtcgccggtgtttccattcggtgatcatcactgaacacagaggactcaccatggagtttgggctgagctgggttttcctcgttgctnttttaagnggtgtccagtgccaggtgcagctggtggagtcgtgggggagcgtggcccagccgtgggacggtcccaggactctcctagtacagtcctctaggattccaccgtttaaggttactatgactatgcacgttgggtcccgccgggctccgaggcgaaggggctgggagtgggtgctagttanactccagtgagtggaggcaagtaaactcctacgcagtactcggagaacggcccgtattaccacctagtactccgaagagaacctattaaccgaagaacgacgacttagtaactcgtagacaaactacgaacacgaccgtagagagacgagagacgacgacgtgtagtaagttagtacgtaggtacgagagtagtagtaggtaggtacgtagttaacgg

SEQ ID NO: 230474 - DNA, 522 bp, Homo sapiens
  misc_feature: GYAE6OF02ITVKB.3.4.A04.1.454.CMB.1.raw
tcagagacgcactccacgaccggtgctcgatttagagtagtgatcagggggagctctgggagacgagcccagcactggaagtcgccggtgtttccattcggtgatcatcactgaacacagaggactcaccatggagtttgggctgagctgggtttcctcgttgctcttttaagaggtgtccagtgccaggtgcagctggtggagtcgtgggggaggcgtggcccagcctgggaggtcccaggactctcctgtacagtctctggattcaccttaggttactatgctatgcactggggtccgccggggctccgaggcaaggggctgggagtggggtggcagttatatcccatgatggaggcagtaaatcctacgcagactccgtggaagggccgattccaccatctcagagacaattccaagaacacgctagtatctgacaaatgaaacagacctgacgagcgtaggaacggacacggctaggtgtaattacgtgtgacgagagatgagtgggtacagtaacgg

SEQ ID NO: 230475 - DNA, 527 bp, Homo sapiens
  misc_feature: GYAE6OF02F4YCZ.3.4.A04.1.454.CMB.1.raw
  modified_base (259)..(259): a, c, t, g, unknown or other
  misc_feature (259)..(259): n is a, c, g, or t
  modified_base (342)..(342): a, c, t, g, unknown or other
  misc_feature (342)..(342): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcgtgggttttcctcgttgctcttttaagaggtgtccagtgccaggtgcagctggtggagtcgtggggggagcgtggcccagcctggggaggtcccaggaacctctcctgtacngtctctggattcaccttaggttactatgctatgcactgggtccgccgggctccgaggcaaggggctggagtgggtgcagttanatcccatgatggaggcagtaaatcctaacgcagactccgtaggaacgggccgattcaccatctcagacgacaatcccaaagaaccacgctagtatctgacaaatgaacagaccgtgagagctggaacggacacggtctggtagttattacgtgtgacgagagagtgagtgggtacgagttaacgg

SEQ ID NO: 230476 - DNA, 506 bp, Homo sapiens
  misc_feature: GYAE6OF02HKW4Q.3.4.A04.1.454.CMB.1.raw
  modified_base (374)..(374): a, c, t, g, unknown or other
  misc_feature (374)..(374): n is a, c, g, or t
  modified_base (418)..(418): a, c, t, g, unknown or other
  misc_feature (418)..(418): n is a, c, g, or t
  modified_base (423)..(423): a, c, t, g, unknown or other
  misc_feature (423)..(423): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtctgggggagcgtggcccagcctgggaggtcccaggaactctcctgtacagtctctggattcaccttaggtactatgctatgcactgggtccgccgggctccaggcaaggggctgggagtgggtggcagttatatccatgatggagcagtaaatcctacgcagactccgngaacgggccattcaccatctccagagacaattccaagaacacgntgtanctgacaaatgaacagcctgagagctaggaggacacggctggtagtattactgtagcgagagatgagtgggtacgagttaacgg

SEQ ID NO: 230477 - DNA, 511 bp, Homo sapiens
  misc_feature: GYAE6OF02F7D2S.3.4.A04.1.454.CMB.1.raw
  modified_base (253)..(253): a, c, t, g, unknown or other
  misc_feature (253)..(253): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtgggggagcgtggcccagcctgggagtcccaggactctcctgtacngtctctggattcaccttaggttactatgctatgcactgggtccgccgggctccgaggcaagggggctgggagtggggtggcagttatatcccatgatggaggcagtaatcctacgcagactcgtgaagggccgatcaccatctccagagacaattccaagaacacgctagtatctgacaaatgaacagcctgagagctggaggacacggctggtagtattacgtggtcgcgagagagtagagtgggtacgattaacgg

SEQ ID NO: 230478 - DNA, 535 bp, Homo sapiens
  misc_feature: GYAE6OF02IEGLH.3.4.A04.1.454.CMB.1.raw
  modified_base (375)..(375): a, c, t, g, unknown or other
  misc_feature (375)..(375): n is a, c, g, or t
  modified_base (469)..(469): a, c, t, g, unknown or other
  misc_feature (469)..(469): n is a, c, g, or t
  modified_base (500)..(500): a, c, t, g, unknown or other
  misc_feature (500)..(500): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctgggtggagtcgtgggggaggcgtggccccagcctggggaggtcccaggaactctcctgtacagtctctggattcaccttaggtactatgctatgcacgtgggtccgccgggctccgaggccgaaggggctgggagtggggtggcaggttaatactcccatgagtgggagcaagtaaanccgtagcagacctcgagaacgggcagttcacatcctcagagacaatccaaagaacacgactgatactgacaaatcgaaacagacctagacgagntacggaaggtacacggctgtagtaattacgngtagcgtagacgagtgtacgtggtacgattaacgg

SEQ ID NO: 230479 - DNA, 567 bp, Homo sapiens
  misc_feature: GYAE6OF02I0FJL.3.4.A04.1.454.CMB.1.raw
tcagagacgcactccacgaccggtgctcgatttagagtagtgatcagggggatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcacctaatttaggtaagtttctaaccgggactcgtggggtcccagacagattcagcggcagtgggtcaggcactgatttcacactagaaatcagcgagggtggaggcgtaggaggtagttggttagggtttattacgtgctagtgacgtaaggtacacgtactcggccctccggacgttccggaccgacgggaccaagggttagaactacgaaacggtacgtggtacggacttacgacctaaccgtacgtccgttacgtcctttaccatttaccccg

SEQ ID NO: 230480 - DNA, 515 bp, Homo sapiens
  misc_feature: GYAE6OF02I58TI.3.4.A04.1.454.CMB.1.raw
  modified_base (339)..(339): a, c, t, g, unknown or other
  misc_feature (339)..(339): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggtttcctcgttgctcttttaagaggtgtccagtgccaggtgcagctggtggagtctgggggagcgtggcccagcctgggaggtcccaggaacctctcctgtacagtctctggattcaccttaggttactatgctatgcactgggtccgccgggctccagggcaaggggctgggagtgggtggcagttanatcccatgatggagcagtaaatcctacgcagactcgtgaagggccgatcaccatctccagagacaattccaagaaccacgctagtatctgacaaatgaacacgcctagagacgctaggaggacacggctaggtgtaattacgtgtgacgagagatggagtgggtacgagttaacgg

SEQ ID NO: 230481 - DNA, 513 bp, Homo sapiens
  misc_feature: GYAE6OF02H43T0.3.4.A04.1.454.CMB.1.raw
  modified_base (415)..(415): a, c, t, g, unknown or other
  misc_feature (415)..(415): n is a, c, g, or t
  modified_base (449)..(449): a, c, t, g, unknown or other
  misc_feature (449)..(449): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtgggggagcgtggcccagcctgggaggtcccaggactctcctgtacagtctctggattcaccttaggttactatgctattgcactgggtccgccgggctccaggcaaggggctgggagtggggtggcagttatatcccatgatgggagcagtaaatcctagcagactcgagaagggccattcacatctcagagacaattccaagaacncgactgtactctagcaaatgaaacagcctagagnctgacgtacacggctgtgttaattacctgtagcgaagtacgagtgtagtgggtacgattaacgg

SEQ ID NO: 230482 - DNA, 537 bp, Homo sapiens
  misc_feature: GYAE6OF02IQWJJ.3.4.A04.1.454.CMB.1.raw
  modified_base (341)..(341): a, c, t, g, unknown or other
  misc_feature (341)..(341): n is a, c, g, or t
  modified_base (351)..(351): a, c, t, g, unknown or other
  misc_feature (351)..(351): n is a, c, g, or t
  modified_base (367)..(367): a, c, t, g, unknown or other
  misc_feature (367)..(367): n is a, c, g, or t
  modified_base (375)..(375): a, c, t, g, unknown or other
  misc_feature (375)..(375): n is a, c, g, or t
tcagagacgcactccacgaccggtgctcgatttagagtagtgatcagggggagctctgggagacgagcccagcactggaagtcgccggtgttccattcggtgatcatcactgaacacagaggactcaccatggagtttgggctgagctgggttttccttcgttgctcttttaagaggtgtccagtgccaggtgcagctggtggagtctgggggaggcgtggcccagcctgggaggtcccaggaactctcctgtacagtctctggattcaccttaggttactatgctatgcactgggtccgccgggctccaggcaaggggctggagtgggtgcaggttatanccatgatggngcagtaaatcctacgnagactcgngaagggcgattcacatctcagagacaattacccaagaacacgctgtatcctgcaaatgaacagcctgacgagtctggaacgacgacggtctggttagagttttaactggttaggaccgtaaggtaagtagttggagtacgggggttacaagtttaaaccggg

SEQ ID NO: 230483 - DNA, 575 bp, Homo sapiens
  misc_feature: GYAE6OF02H8J85.3.4.A04.1.454.CMB.1.raw
  modified_base (469)..(469): a, c, t, g, unknown or other
  misc_feature (469)..(469): n is a, c, g, or t
tcagagacgcactccacgaccggtgctcgatttagagtagtgatcagggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtgggggagcgtggcccagcctgggaggtcccaggactctcctgtacagtctctggattcaccttaggttactatgctatgcacgtggggtcccgccggggctccgagggccgaagggggctgggaggtggggtggctagttatactcccatgagtgggaggcaaggtaaaatccgtaacgcagaccgtccgtaggaacgggcccgattccaccactctccgagacgaacaacttaccaagaacacgctagtatctgacaanagaacagacctagagacgcgtaggaacgacgacggtcttggtagttaatttaccgtggtacggacgaaggaggtataggtaaggtcgggtacggtaagttaacggg

SEQ ID NO: 230484 - DNA, 543 bp, Homo sapiens
  misc_feature: GYAE6OF02H0712.3.4.A04.1.454.CMB.1.raw
  modified_base (341)..(341): a, c, t, g, unknown or other
  misc_feature (341)..(341): n is a, c, g, or t
  modified_base (402)..(402): a, c, t, g, unknown or other
  misc_feature (402)..(402): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtgggggagcgtggcccagcctgggaggtcccaggaactctcctgtacagtctctggattcaccttaggttactatgctatgcactgggtccgccgggctccgaggcaaggggctgggagtggggtggcagttanatcccatcgatgggaggcagtaactccgtacgcagactcgtagaagggccgattcacatcncagagacataccaagaacacgctgtatctcgacaaatagaacacgacctagaacgagagtaggaaggacgacggcttaggtcgtaattaccgtggttacgacgaggaacgtagtaggtagtggggtacgtaagttaaacgg

SEQ ID NO: 230485 - DNA, 500 bp, Homo sapiens
  misc_feature: GYAE6OF02GXE3U.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggtttcctcgttgctctttaagaggtgtccagtgccaggtgcagctggtggagtcgtgggggagcgtggcccagcctgggagtcccaggactctcctgtacagtctctggattcaccttaggttactatgctatgcactgggtccgccgggctccgaggcaaggggctgggagtgggtggcagttatatccatgatggagcagtaatccagcagactcgtgaagggccgattcacatctccagagacaattccaagaacacgctgtatctgacaaatgaacagcctgagagcgtgaggacacgggctggtgttatacgtgtgcgagagagtggagtgggtacgagtaacgg

SEQ ID NO: 230486 - DNA, 518 bp, Homo sapiens
  misc_feature: GYAE6OF02FQSTS.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtctgggggaggcgtggcccagcctgggaggtcccaggaactctcctgtacagtctctggattcaccttaggttactatgctatgcactggggtccgccgggctccgaggcaaggggctgggagtggggtggcaggttatatcccatgatggagcagtaactcctacgcagacctcggtgaacgggccgattcaccatctccagagacaattccaagaacacgctgtactctagacaaatcgaacagcctagagacgctaggacgacacggctggtgtattactgtgcgagagatggagtgggtacagttaacgg

SEQ ID NO: 230487 - DNA, 505 bp, Homo sapiens
  misc_feature: GYAE6OF02IRQ7Z.3.4.A04.1.454.CMB.1.raw
tcagagacgcactccacgaccggtgctcgatttagagtagtgatcagggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtggggggaggcgtggcccagcctgggaggtcccaggaactctcctgtacagtctctggattcaccttaggttactatgctatgcactgggtccgccggggctccaggcaaggggctggagtgggtggcagttatatcccatgatggaggcagtaaatcctacgcagactccgtgaaggcgattcacatctcagagacaattccaagaacaacgctgtatctgcaaatgaacagcctagagagctgaggacacggctagtgtattactggtgacgagagatgagtgggtcgataacgg

SEQ ID NO: 230488 - DNA, 540 bp, Homo sapiens
  misc_feature: GYAE6OF02H4B7T.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggttgagctgggttttcctcgttgctcttttaagaggtgtccagtgccaggtgcagctggtggagtcgtgggggaggcgtggcccaggccgtgggaggtcccaggaactctcctgtacagtctctggattcaccttaggttactatgctatgcacgtgggtcccgccgggctccgaggcaagggggctgggagtggggtggcgtagttatactcccatgatggagcagtaaactcctacgcagactccgtagaagggccgtatcaccatctccagagacaacttaccaagaacacgctgtatctagcaaatcgaacagcctagagacgcgtagaggaccgaggcctgtgttagttacgtgtcggacgagagtagtgaggttggggactagtacgttaaggg

SEQ ID NO: 230489 - DNA, 500 bp, Homo sapiens
  misc_feature: GYAE6OF02JDP9D.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggtttcctcgttgctcttttaagaggtgtccagtgccaggtgcagctggtggagtctgggggagcgtggccagcctgggaggtcccaggactctcctgtacagtctctggattcaccttaggttactatgctatgcactgggtccgcggctccaggcaggggctggagtgggtgcagttatatcccatgatgggagcagtaaatcctagcagactcgtagaagggccgattcaccatctccgagagacaattccaagaacacgctagtatctgacaaatgaacagcctgacgagctgaggacacggctgtgtattactgtgacgtagagtatgagtgggtacgtagtaacg

SEQ ID NO: 230490 - DNA, 549 bp, Homo sapiens
  misc_feature: GYAE6OF02G7F4F.3.4.A04.1.454.CMB.1.raw
  modified_base (333)..(333): a, c, t, g, unknown or other
  misc_feature (333)..(333): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttcttttaagaggtgtccagtgccaggtgcagctgggtggagtcgtgggggagcgtggcccagccgtgggacggtcccaggacctctcctgtacagtctctggattcaccttaggttactatgctatgcacgtgggtcccgccgggctccgaggcgaaggggctgggngtgggtggcagttatacgtcccatgagtggaggctaagtaactctacgacagactcggtagaacgggccgatccacactcctccagacgactaactaccaagaacacgtctagtactctagacaaatacgaacacgcctagaacgagcgtagacgacacggtctagtgtattacgtggtgacgagacgtagtagaggtagggtacgtattaacggg

SEQ ID NO: 230491 - DNA, 537 bp, Homo sapiens
  misc_feature: GYAE6OF02GK672.3.4.A04.1.454.CMB.1.raw
tcagagacgcactccacgaccggtgctcgatttagagtagtgatcagggggatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaaccgggactcgtggggtcccagacagattcagcggcagtgggtcaggcactgatttcacactagaaatcagcagggtggaggctgaggagttggttaggggtttattacgtgctagtgacaaggtacacgacgtcggcctccggacgttccggaccgacgggaaccaagggtacgaaactacgaaacggaactggtacggctagcgacatcgtagtcttcattcc

SEQ ID NO: 230492 - DNA, 528 bp, Homo sapiens
  misc_feature: GYAE6OF02I5FYB.3.4.A04.1.454.CMB.1.raw
  modified_base (260)..(260): a, c, t, g, unknown or other
  misc_feature (260)..(260): n is a, c, g, or t
tcagagacgcactccacgaccggtgctcgatttagagtagtgatcagggggagctctgggagacgagcccagcactggaagtcgccggtgtttccattcggtgatcatcactgaacacagaggactcaccatggagtttgggctgagctgggtttcctcgttgcttcttttaagaggtgtccagtgccaggtgcagctggtggagtcgtggggggagcgtggcccagccgtggggacggtcccaggaactctcctgtacngtctctggattcaccttaggtactatgctatgcactgggtccgcgggctccgaggcaaggggctggagtgggtgctagttatatcccatgatggagcagtaaatcctaacgcaagactccggtaggaacgggccattccacctatctccagacgacaattaccaaagaacacgctagtatctagacaaatgaaccagcctgagagctagaggacacgggctaggtgtacttacttggacgagagagatagagtgggtacagttaacgg

SEQ ID NO: 230493 - DNA, 570 bp, Homo sapiens
  misc_feature: GYAE6OF02HR9IL.3.4.A04.1.454.CMB.1.raw
tcagagacgcactccacgaccggtgctcgatttagagtagtgatcagggggatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacagtgataggaaacacctacttagaattggtttcagcaggacggccaggccaatcctaccgaaggccgtaccttaaatttataacggtttcctaaaccgggacttcggtcggggtacccaagacagtattcgagacggcaggtgggtacaggcagtagatttacacgaactagaaaactcgagacgagggtggaggctaggaggtagttgggtttagggtttaattacgtgctagtagactaaggtacacacgtcgcctccgacgtcgaccgacggaacgaggtacgaatacgaaacgtactggcgctacgacactagtccgtgtcttcgacttcccg

SEQ ID NO: 230494 - DNA, 631 bp, Homo sapiens
  misc_feature: GYAE6OF02JKFRG.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttcttttaagaggtgtccagtgccaggtgcagctggtggagtcgtgggggagcgtggcccagcctgggagtcccaggactctcctgtacagtctctggattcaccttaggttactatgctatgctactcggggtccgccgggtctccgaggtcgaagggggtcctggggacgtgggggtggcgtaaggttatacgtcccagtggagtgggaggctaagtaaactccgtaacgacaacgtacctccggtaggaacggggcccgtaagttaccgaccgtactcctacccgaaggtagaactaacgttcccaaagaaccacggcttaggactcgtgacgtaaatcgaaacacggtcctaggaacgagtaccgtagaacggaacaccgggtccgtaggttacggttaacgttacgtcgggtcgacggacgtacggtacgtaggtacggtggggtacctaacgttaacggg

SEQ ID NO: 230495 - DNA, 517 bp, Homo sapiens
  misc_feature: GYAE6OF02IQL5H.3.4.A04.1.454.CMB.1.raw
  modified_base (394)..(394): a, c, t, g, unknown or other
  misc_feature (394)..(394): n is a, c, g, or t
  modified_base (484)..(484): a, c, t, g, unknown or other
  misc_feature (484)..(484): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtgggggagcgtggcccagcctgggaggtcccaggactctcctgtacagtctctggattcacctttaggtactatgctatgcactgggtccgccggggctccgaggcaaggggctgggagtggggtggcagttatatcccatgatggaggcagtaaatcctagcagactcgtgaacgggccatcaccntctcagacgacaattccaagaacacgactgtatctgacaaatcgaacacgcctaggagacgcgtagacggacacggctgtgtaattacgnggtgacgagagagtgagtgggtacgattaacgg

SEQ ID NO: 230496 - DNA, 552 bp, Homo sapiens
  misc_feature: GYAE6OF02GFZTV.3.4.A04.1.454.CMB.1.raw
  modified_base (390)..(390): a, c, t, g, unknown or other
  misc_feature (390)..(390): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctgggtggagtcgtggggggaggcgtggcccagcctggggaggtcccaggacctctcctgtacagtctctggattcaccttaggttactatgctatgcactgggtccgccgggctccgaggcgaagggggctgggaggtggggtggctaggttatatcccatgagtgggaggcaagtaaatccacgcagactcgngaagggccgatcaccatcctcagagacaattaccaagaacacgctatatctagacaaatacgaaacagacctggaagacgctggaaggaccgacggcttggtagttacttaacgtggtagtaccggaggagtagttaggagtaggggttaccgagttaacgg

SEQ ID NO: 230497 - DNA, 519 bp, Homo sapiens
  misc_feature: GYAE6OF02GOH6F.3.4.A04.1.454.CMB.1.raw
tcagagacgcactccacgaccggtgctcgatttagagtagtgatcagggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtgggggaggcgtggcccagcctggggagtcccaggactctcctgtacagtctctggattcaccttaggttactatgctatgcactgggtccgccgggctccgaggcaagggggctgggagtggggtggcagttatatcccatgatgggaggcagtaatcctacgcagactccgtgaacgggccgattccaccatctccagagacaataccaagaacacgctgtatctgacaaatgaacacgctagagagctagaaggacacggctagtgtaattacgtgtgacgagagatggagtgggtacgagttaacgg

SEQ ID NO: 230498 - DNA, 516 bp, Homo sapiens
  misc_feature: GYAE6OF02IWXLQ.3.4.A04.1.454.CMB.1.raw
  modified_base (425)..(425): a, c, t, g, unknown or other
  misc_feature (425)..(425): n is a, c, g, or t
  modified_base (453)..(453): a, c, t, g, unknown or other
  misc_feature (453)..(453): n is a, c, g, or t
  modified_base (480)..(480): a, c, t, g, unknown or other
  misc_feature (480)..(480): n is a, c, g, or t
tcagagacgcactccacgaccggtgctcgatttagagtagtgatcagggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctgggtggagtcgtgggggagcgtggcccagcctgggacggtcccagggaactctcctgtacagtctctggattcaccttaggttactatgctatgcactgggtccgccgggctccgaggccaaggggctggagtggggtggcgagttatatccatgatgggaggcaagtaactcctacgcagactccggagaagggcgattcacatctcagagacatccaagacacgntgtatctgacaaatgaacagcctgagcngtagaggacacggctgtgtaatttacnggtcgacgagacgagtagagtgggtacagttaacgg

SEQ ID NO: 230499 - DNA, 627 bp, Homo sapiens
  misc_feature: GYAE6OF02GLG5O.3.4.A04.1.454.CMB.1.raw
  modified_base (216)..(216): a, c, t, g, unknown or other
  misc_feature (216)..(216): n is a, c, g, or t
  modified_base (253)..(253): a, c, t, g, unknown or other
  misc_feature (253)..(253): n is a, c, g, or t
  modified_base (491)..(491): a, c, t, g, unknown or other
  misc_feature (491)..(491): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcgtggtttcgcgtaggcgtcttaagtaggtgtcagtgccaggtgcagctggtggagtcgtggggggaggnggtgggcccagcctgggaggtcccaggaactcctccngtacagtctctggattcaccttaggttactatgctatgcacgtggggtcccgccggggctaccgacgggcaacgggggctggggaggttggggtcggcgaaggtttacattcccaagtgagtggaggcaaggtaaactccgtacgcaagccgtacggtcggaacgggtccggtacttccactactcgtaccgagaagtaacattaaccaacgaaacaccgtccgtaggttaatccgtnacgagaagtcggactagccgtagagtacggacgaacggaccgacggtcctttaattacgttaacgtcggtagaaccggtaaacgtaccggtacggtacggtaccgtaaacttaaccgggttagttacgtttaccgg

SEQ ID NO: 230500 - DNA, 515 bp, Homo sapiens
  misc_feature: GYAE6OF02JDL1U.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcgtgggtttcctcgttgctctttaagaggtgtccagtgccaggtgcagctggtggagtctggggggaggcgtggcccagcctgggaggtcccaggaactctcctgtacagtctctggattcaccttaggttactatgctatgcactgggtccgccgggctccaggcaaggggctggagtgggtggctagttatatccatgatggagcagtaaatctagcagactcgtagaacgggccgattcacatctccagagactaattccaaagaacacgctgtactcgtagacaaatgaacagcctaggagagctaggaggacacggctaggtgtaattctggtgcggagagtatggagtgggtacgattaacgg

SEQ ID NO: 230501 - DNA, 505 bp, Homo sapiens
  misc_feature: GYAE6OF02GWYZO.3.4.A04.1.454.CMB.1.raw
tcagagacgcactccacgaccggtgctcgatttagagtagtgatcagggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtgggggaggcgtggcccagcctgggagtcccaggactctcctgtacagtctctggattcaccttaggttactatgctatgcactgggtccgccgggctccaggcaaggggctgggagtggggtggcagttatatcccatgatggaggcagtaaatcctagcagactccgtgaagggccgattcaccatctccagagacaattccaagaacacgctgtatctgcaaatgaacagacctgagagctaggagacgacggctgcgtattacgtgtgcgagagatgagtggtcgattaacgg

SEQ ID NO: 230502 - DNA, 535 bp, Homo sapiens
  misc_feature: GYAE6OF02F0A9P.3.4.A04.1.454.CMB.1.raw
  modified_base (411)..(411): a, c, t, g, unknown or other
  misc_feature (411)..(411): n is a, c, g, or t
  modified_base (439)..(439): a, c, t, g, unknown or other
  misc_feature (439)..(439): n is a, c, g, or t
  modified_base (450)..(450): a, c, t, g, unknown or other
  misc_feature (450)..(450): n is a, c, g, or t
  modified_base (461)..(461): a, c, t, g, unknown or other
  misc_feature (461)..(461): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtggggggaggcgtggcccagcctgggacgtcccaggactctcctgtacagtctctggattcaccttaggttactatgctatgcactgggtccgccgggctccgaggcaagggggctgggagtggggtggctagttatatcccatgatgggagcaagtaaatcctacgcagactccggtagaacgggcgattccacatctcaganacaattaccaagaacacgctgtactctnacaaatgaacngacctggagancgtagacgacacggtctaggtgttacttacgtgtcgacggtagaggtagtggaggtacgggtacgagttaacgg

SEQ ID NO: 230503 - DNA, 530 bp, Homo sapiens
  misc_feature: GYAE6OF02FSBDX.3.4.A04.1.454.CMB.1.raw
  modified_base (343)..(343): a, c, t, g, unknown or other
  misc_feature (343)..(343): n is a, c, g, or t
  modified_base (383)..(383): a, c, t, g, unknown or other
  misc_feature (383)..(383): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtctgggggaggcgtggcccaggcctgggaggtcccaggaactctcctgtacagtctctggattcaccttaggttactatgctatgcactgggtccgccgggctccgaggcaagggggctgggagtggggtggcagttanatcccatgatgggaggcagtaaatcctacgcagactccgngaacgggccgattcaccatctccagagacaacttccaaagaacacgctagtatctgacaaatgaacacgcctagagagctggacgacgacggctggtagtaacttacgtggtcgacgagagagttaggagtgggtacgagttaacgg

SEQ ID NO: 230504 - DNA, 547 bp, Homo sapiens
  misc_feature: GYAE6OF02IVIOY.3.4.A04.1.454.CMB.1.raw
  modified_base (434)..(434): a, c, t, g, unknown or other
  misc_feature (434)..(434): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctgggtggagtcgtgggggaggcgtggcccagcctgggacggtcccaggaactctcctgtacagtctctggattcaccttaggttactatgctatgcactgggtccgccgggctccgaggcaaggggctgggagtggggtggcagttatatcccatgatgggaggcaagtaaactcctacgcagactccgtagaacgggccgattcaccatcctccagagacaattaccaagaacacgntgatctagacaaatcgaacagcctaggacgagccgtaggacgacgacggtcgtagttgttaacttacgtggtcggacgaggagtagtagtacggtgggtacgtagttaacggg

SEQ ID NO: 230505 - DNA, 687 bp, Homo sapiens
  misc_feature: GYAE6OF02H3ER1.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggacctcaccatggagtttgggctgagctgggttttcctcgttgctcgttttaagaggtgtccagtgccaggtgcagctggtggagtctggggagcgtggcccagcctggagtcccaggactctctgtacagtctctggattcaccttaggtactatgctatgctactgggtccgccggctaccaggcaaggggcctagggagtcggggtcgctaggttatacgtcccagtcgaatgggaaggcctaaggttaaaactcccgttacggacaacggaccgttccggtaggaacggggcctaatttccgaaccctagttccgtacccgaaaggtacgaaccgtaaacgttaccaaaacggaaaccctaccgtaccttagttaactccgtaggaacctaaaagtccggtaaaaccacgtacccgttaaggaacggtaacggtacccttaagggaaaccgggtaaccgtaaccgggtccgtttacggttaacggttaactttacccggttggtaccggaccgtaaggtacgtagtcggtaacggttcgggtaccgtaagtttaaacccggg

SEQ ID NO: 230506 - DNA, 622 bp, Homo sapiens
  misc_feature: GYAE6OF02JVN4Y.3.4.A04.1.454.CMB.1.raw
  modified_base (346)..(346): a, c, t, g, unknown or other
  misc_feature (346)..(346): n is a, c, g, or t
  modified_base (391)..(391): a, c, t, g, unknown or other
  misc_feature (391)..(391): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtgggggaggcgtggcccagccgtgggaggtcccaggaacctctcctgtacagtctctggattcaccttaggtactatgctatgcacgtgggtccgccgggctccgaggcgaaggggcctgggaggtgggtggcagttanactccatgatgggaggcaagtaaactccgtacgcgagacctcggngaacgggccgtattcacctatcctaccgagacaacgaacttaccgaaagacgaccgtcttacgtacgtctcgaactaaagtgaaaccacggtccaggaacgacgtacgtacggaacgggaccgaacgggtccttagggttacgtaacgtttaaccgtgggttacggtaccgggtaaggtaacggtaagttagggtaacggttcggggttaccggttaacggtttaaccggg

SEQ ID NO: 230507 - DNA, 508 bp, Homo sapiens
  misc_feature: GYAE6OF02G292V.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtgggggagcgtggcccagcctgggaggtcccaggactctcctgtacagtctctggattcaccttaggttactatgctatgcactgggtccgccgggctccgaggcaaggggctgggagtggggtggcaggttatatcccatgatggaggcagtaaatcctacgcagactccgtgaagggccgattcaccatctccagagacaattccaagaacacgctagtatctgacaaatgaacagcctgagagctgaggacacggctgtgtattactgtgcgagagagtgagtgggtacgagtaacgg

SEQ ID NO: 230508 - DNA, 555 bp, Homo sapiens
  misc_feature: GYAE6OF02GTEPG.3.4.A04.1.454.CMB.1.raw
  modified_base (413)..(413): a, c, t, g, unknown or other
  misc_feature (413)..(413): n is a, c, g, or t
  modified_base (443)..(443): a, c, t, g, unknown or other
  misc_feature (443)..(443): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtgggggagcgtggcccaggcctgggacggtcccaggaactctcctgtacagtctctggattcaccttaggttactatgctatgcactgggtccgccgggctccgaggcaaggggctgggagtgggtgcaggttatatcccatgatggaggcaagtaaatcctacgcagactccgtggaacgggccgattacactactcctccaganactaattaccaagaacacgctagtatctanacaaatcgaaacacgaccgtgaaggacgcgtaggaacgggaccacgggtctggttagtaattacgttggtggaccggtagagtagtggaagttcggggtacgtattaacggg

SEQ ID NO: 230509 - DNA, 522 bp, Homo sapiens
  misc_feature: GYAE6OF02HD9O5.3.4.A04.1.454.CMB.1.raw
  modified_base (326)..(326): a, c, t, g, unknown or other
  misc_feature (326)..(326): n is a, c, g, or t
  modified_base (391)..(391): a, c, t, g, unknown or other
  misc_feature (391)..(391): n is a, c, g, or t
  modified_base (430)..(430): a, c, t, g, unknown or other
  misc_feature (430)..(430): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtctgggggagcgtggcccagcctgggagtcccaggaactctcctgtacagtctctggattcaccttaggttactatgctatgcactgggtccgccggctccaggcaaggggctggagtgggngcagttatatccatgatggaggcagtaaatcctagcagactcgtgaaggccatcacatctcaganacaatccaagaacacgctgtatctagacaaatgaaacgngcctagagagcgtaggaagtacgacggcgttggtagttaattaccgttgtacgacgtaagagtagtagaggttacgggtacgtagttaacgg

SEQ ID NO: 230510 - DNA, 592 bp, Homo sapiens
  misc_feature: GYAE6OF02GRR53.3.4.A04.1.454.CMB.1.raw
  modified_base (258)..(258): a, c, t, g, unknown or other
  misc_feature (258)..(258): n is a, c, g, or t
tcagagacgcactccacgaccggtgctcgatttagagtagtgatcagggggagctctggggagacgagcccagcactggaagtcgccggtgtttccattcggtgatcatcactgaacacagaggactcaccatggagtttgggctgagctgggttttcctcgttgctcttttaagaggtgtccagtgccaggtgcagctgggtggagtcgtggggggagcgtggcccagcctgggaggtcccaggactctcctgtacngtctctggattcaccttaggttactatgctatgcacgtggggtccgccggggctccgagggcgaagggggctgggaggtggggtggcagttatatccctatgagtgggagacagttaaactccgtacgcagactccggtaggaacgggccgattccaccactcctacgagagtaaccaattacccaaacgaacacgtacttagtactctagactaaagtagaaaccgacgccgtaggacgaacgtcgtaggaacggaacgacggaccttggtagttaagtttacgtgtaggacgtaagtacgtagtaggtaggtcgggtacgaagttaaccggg

SEQ ID NO: 230511 - DNA, 589 bp, Homo sapiens
  misc_feature: GYAE6OF02GS5C3.3.4.A04.1.454.CMB.1.raw
tcagagacgcactccacgaccggtgctcgatttagagtagtgatcaggggaggctctgggagacgagcccagcgactggaagtcgccggtgtttccattcggtgatcatccactgaacacagaggactcaccatggagtttgggctgagctgggttttcctcgttgctctttaagaggtgtccagtgccaggtgcagctggtggagtcgtggggagcgtggcccagcctgggacgtcccaggaacctctcctgtacagtctcgtggattcaccgttaggtactatgctatgcacgtgggtccgccggtctccgaggcgaaggggctgggagtgggtgctagttatactccagtgagtggagacgtaagtaactcgacgcagacctcggtagaacgggcctattcactatcgtaccgagacaactaataccgaagaacacgtctagtactcgtagaacaaagtagaaactacgaccgttaggaacgtagtcgtaggaacggtaccgacggtacgttaggtagttaacgttacgtaggtcggacgtaaggtacggacgttaggagggtacggttacggtaagttaaccggg

SEQ ID NO: 230512 - DNA, 519 bp, Homo sapiens
  misc_feature: GYAE6OF02HEFBJ.3.4.A04.1.454.CMB.1.raw
  modified_base (422)..(422): a, c, t, g, unknown or other
  misc_feature (422)..(422): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtctgggggagcgtggcccagcctgggaggtcccaggaactctcctgtacagtctctggattcaccttaggttactatgctatgcactgggtccgccgggctccgaggcaaggggctgggagtggggtgcagttatatcccatgatggagcagtaaatcctacgcagactcgagaggcgatcacatctcagagacaatccaagaacacgctagtatctnacaaatgaacagacctagagacgcgtagaacggacgacggcttggtagttaacttacgtggtcgacggagacggatggagtgggtacgagttaacgg

SEQ ID NO: 230513 - DNA, 567 bp, Homo sapiens
  misc_feature: GYAE6OF02JJ99R.3.4.A04.1.454.CMB.1.raw
  modified_base (338)..(338): a, c, t, g, unknown or other
  misc_feature (338)..(338): n is a, c, g, or t
tcagagacgcactccacgaccggtgctcgatttagagtagtgatcagggagctctgggagacgagcccagcactggaagtcgccggtgtttccattcggtgatcatcactgaacacagaggactcaccatggagtttgggctgagcgtggtttcgtcgtgctctttaagaggtgtcagtgccaggtgcagctggtggagtctgggggagcgtggcccagcctgggacggtcccgaggaacctctcctgtacagtctctggattcacctttagtactatgctatgcacgtgggtccgccgggctccgaggccgaaggggctggagtgggtgctagttanctccatgactggagcaagtaaaactccgtaacgctaacgactccggtagaacggtcgaacttcaaccgtatcctaccagacgactaacttccgaagaacacgtccttagtacgtctacgctaaatcgaacaagtcccgtagacgagataggaacgacaccgggacttggtagtaacgtttccgtaggttacgacggagaagtgtagtaggtgggtacctaagttaacgg

SEQ ID NO: 230514 - DNA, 827 bp, Homo sapiens
  misc_feature: GYAE6OF02FWBV6.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacaggagactcaccagtggtaggtttgggctggagtcgttcgggtttttcctcggttgtccttttacgtttttaaggaggttcgtaccgtaggtcgaccgtagggtcgcagtcgtgggtggaggttcggtggggggacggtcggtcggcccaggtccgtaggggaccgtccgaggtaccttccgtccgtagtacgtagttcctcgtggtacttcctacgtttaggttactagtgcttagtgcacggtcgggtccggccgggtctccgaggacggaaggggcgtagggaggtgggtggactaggttatacgtccagtacgagtagggacgacgtaaagttaacctccgtaacgacgaacggtacccgttacggtaacggggaacgggtaccgtaaccttaccgaacccgtacttcccgtaaccgtaacggaaacgtaaaccgttaaccttaaacccgaaaacggtaaacccgtaaaccgtcgtttaacggttaaccgttaccgttacgaaaacctaaaacgttacggaaaaccgtacggtacccgttaagggaaccggtacgttaccggtaacgggtaaaccggggtaacccgtaccggggtacgttttacggggtaacgttttaaccgtttaacggttacgggttacgacgggtaaaggtacgtaggttacgggtacgggttacgggttaaccgtaagttttaaaccggggg

SEQ ID NO: 230515 - DNA, 553 bp, Homo sapiens
  misc_feature: GYAE6OF02G3CWP.3.4.A04.1.454.CMB.1.raw
  modified_base (264)..(264): a, c, t, g, unknown or other
  misc_feature (264)..(264): n is a, c, g, or t
  modified_base (351)..(351): a, c, t, g, unknown or other
  misc_feature (351)..(351): n is a, c, g, or t
  modified_base (464)..(464): a, c, t, g, unknown or other
  misc_feature (464)..(464): n is a, c, g, or t
tcagagacgcactccacgaccggtgctcgatttagagtagtgatcagggggagctctgggagacgagcccagcactggaagtcgccggtgtttccattcggtgatcatcactgaacacagaggactcaccatggagtttgggctgagcttgggttttcctcgttgcttcttttaagaggtgtccagtgccaggtgcagctggtggagtcgtggggggaggcgtggcccaggccgtggggacggtcccaggacctctcctgtacngtctctggattcaccttaggttactatgctatgcactgggtccgccgggctccgaggcgaaggggctgggagtggggtggcagttanatcccatgagtggagcagtaaactcctacgcagacctccgtagaacgggccgattccaccatcctccaagacgacaattaccaagaaccacgctagtatctgacaaatgaacngacctagagagcgtagaacggacgacggtcgtggttacgttattacgtggtcgacggtagaggtagtggaggtgggtacgagttaacgg

SEQ ID NO: 230516 - DNA, 649 bp, Homo sapiens
  misc_feature: GYAE6OF02G6UDI.3.4.A04.1.454.CMB.1.raw
  modified_base (255)..(255): a, c, t, g, unknown or other
  misc_feature (255)..(255): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgcttctttaagaggtgtccagtgccaggtgcagctggtggagtcgtgggggagcgtggcccagccgtgggacgtcccaggactctcctgtacngtctctggattcaccttagtactatgctatgcacgtcgggtccgccggctccgaggcgaaggggctgggaggtgggtggctaagtttatactacccgtatggagtgggacgtacaaggtaaaactccgtaacgacgaacgaccgtaccggtaggaaacgggtccgtaacttacccaaccctattcccgtacccgtaagaacgtaaactaaacttacccgaaaacgtaaaccgtaacgtccttagtaactcgtacgaacctaaaatcgaaacacgacccgtaggaacgagtacgtaggaaacgggaccgacgggtcttaggttagttaacttacgtggtacggaccgtaaggacgtacgtagggtaacggttacgggtacgtaacgttaaacggg

SEQ ID NO: 230517 - DNA, 538 bp, Homo sapiens
  misc_feature: GYAE6OF02ISLM4.3.4.A04.1.454.CMB.1.raw
  modified_base (174)..(174): a, c, t, g, unknown or other
  misc_feature (174)..(174): n is a, c, g, or t
  modified_base (344)..(344): a, c, t, g, unknown or other
  misc_feature (344)..(344): n is a, c, g, or t
  modified_base (444)..(444): a, c, t, g, unknown or other
  misc_feature (444)..(444): n is a, c, g, or t
  modified_base (514)..(514): a, c, t, g, unknown or other
  misc_feature (514)..(514): n is a, c, g, or t
tcagagacgcactccacgaccggtgctcgatttagagtagtgatcagggggagctctgggagacgagcccagcactggaagtcgccggtgtttccattcggtgatcatcactgaacacagaggactcaccatggagtttgggctgagctgggttttcctgttgctcttttaagnggtgtccagtgccaggtgcagctggtggagtcgtgggggagcgtggcccagcctgggaggtcccaggactctcctgtacagtctctggattcaccttaggttactatgctatgctacgtgggtccgccgggctccaggcaaggggctgggagtggggtggacaggtttanactcccatcgaagttgggagcaagtaaatcctagcaagactccggtagaacgggccgatccacatccacagagacagtaccaaagacacgacttgatctnacaaacgtgaacgagaccgtagacgagctagacggacacggactgtagtacttactggtacgcgaagagntagaggtcgggtagacgttaacgg

SEQ ID NO: 230518 - DNA, 676 bp, Homo sapiens
  misc_feature: GYAE6OF02F9LB4.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtgggggaggcgtggcccagcctgggacggtcccaggaactctcctgtacagtctctggattcaccttaggttactatgctatgcacgtcgggtcccgccgggctccgaggcgaaggggctgggaggtggggtggctagttactactcccgagtgagtgggacggtactaagttaaactcctaacgcaacggtaccgtccggaggaacgggtccctattacccaaccgtactccgtaccgaagacgaactaaactacccgaaagtaaccgacgtcttacgtacttactacgaactaaaacgtacgaaaccgacggtaccgtaggaacgaacgtaccgtaacgggaaccggtaccgtaccgggttacttagggttacggtttaacgtttaacggttagggtaacgggaacggtaaggtaggttaacggttagggtaaggtaccggggttaacgtaagggtttaaaccgggg

SEQ ID NO: 230519 - DNA, 579 bp, Homo sapiens
  misc_feature: GYAE6OF02H8Z0J.3.4.A04.1.454.CMB.1.raw
  modified_base (478)..(478): a, c, t, g, unknown or other
  misc_feature (478)..(478): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtgggggagcgtggcccagccgtgggaggtcccaggactctcctgtacagtctctggattcaccttaggttactatgctatgcactggggtcccgccgggctccgaggccaagggggctgggagtgggtgggctaggttatagtccagtcgatggaggcaagtaaaactccgtacgacagacctccgtagggaacgggccgattccaccatcctaccagaacgactaacttaccaaagaaccacgtactagtactctagacaaatcgaaacngaccctagagagccgtggaacggacgaacggcttaggtgttaacttacgtggtggacgaaggtgtaagttggtaggtttacgggtacggtaattaaccggg

SEQ ID NO: 230520 - DNA, 927 bp, Homo sapiens
  misc_feature: GYAE6OF02JQALJ.3.4.A04.1.454.CMB.1.raw
  modified_base (195)..(195): a, c, t, g, unknown or other
  misc_feature (195)..(195): n is a, c, g, or t
tcagagacgcactccacgaccggtgctcgatttagagtagtgatcaggggaggctctgggagacgagcccagcactggaagtcgccggtgtttccattcggtgatcatcactgaacacagaggactcaccatggagtttgggctgagctgggttttcctcgttgctcttttaagaggtcgtccagtgccaggtcncgcgtcgttgggtggtacgttcgggtagggggaggcggtcggacccgcgtccggtggggtaccggtccgaaggtaacctcgtccgtgtaacgtcgtctcgtgtacgttacctaccgttaggttacctagtcgtctagtcgctacgtgggtcccgccggtcctccgaggtccgggaaacggggtcgtcgggaggttcggggtcgggtaccgtaaggtttaactaccggtccccgtaagtggacgttggggaacgggtactaaacggttaaaactcccgtaacgtaccgaacggtaccgttacccgggtaagggtaaccgggggtacccgtaacgtttacccgaacccgtaaacgtttccccgtaacccggtaaaggtaaaccggtaaacccgttaaaaccgtttaaccccgggaaaaacgggtaaaacccgtaacccgggttacccgttaaccggtttaaacgttacccggtttaaccggaaacccgttaaaaaacgtttaccggaaaaaccgtaaccggttaaccccggttaagggaaaccgggttaaacgggtacccgttaaagggaaaccggggtaaccctaaccgggggtaccgtttacgggtttaacggtttaaaccggtttaacggttacgggtaccgggttaacccgggtaaggttaaacggtaaccggtttaggggtaaccgggttttaggggggttaacccgttaaagttttaaacccgggggg

SEQ ID NO: 230521 - DNA, 524 bp, Homo sapiens
  misc_feature: GYAE6OF02GQOTA.3.4.A04.1.454.CMB.1.raw
  modified_base (336)..(336): a, c, t, g, unknown or other
  misc_feature (336)..(336): n is a, c, g, or t
  modified_base (420)..(420): a, c, t, g, unknown or other
  misc_feature (420)..(420): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtctgggggagcgtggcccagcctgggaggtcccaggactctcctgtacagtctctggattcaccttaggttactatgctatgcactgggtccgcggctccaggcaaggggctggagtgggtggctagtatanccatcgatggagcaagtaatcctagcaagctaccggtgaagggccatcacatctcagagactaatccaaagacacgctagatcngacaaatcgaactagccgtagacgagcgtagaacggcgaacggtctagtacgttattaacgtggtcgacgtaggatagtggtacgtggggtacagttaaccggg

SEQ ID NO: 230522 - DNA, 560 bp, Homo sapiens
  misc_feature: GYAE6OF02IC7GK.3.4.A04.1.454.CMB.1.raw
  modified_base (336)..(336): a, c, t, g, unknown or other
  misc_feature (336)..(336): n is a, c, g, or t
  modified_base (344)..(344): a, c, t, g, unknown or other
  misc_feature (344)..(344): n is a, c, g, or t
  modified_base (448)..(448): a, c, t, g, unknown or other
  misc_feature (448)..(448): n is a, c, g, or t
  modified_base (475)..(475): a, c, t, g, unknown or other
  misc_feature (475)..(475): n is a, c, g, or t
tcagagacgcactccacgaccggtgctcgatttagagtagtgatcagggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtggggggagcgtggcccagcctggggaggtcccaggactctcctgtacagtctctggattcacctttaggtactatgctatgcactcgggtccgccgggctccgaggcgaaggggctgggagtggggngcagttanatccatgatggagcagtaaatcctacgcagacctccggtaggaacgggcctattccacctatcctaccagacgactaacttaccaaagaacacgctagtactcngacaatacgaacagcctagacgagcgnggaacggacgacggtctaggttagtaacttacgtggtacgacgtaaggaggtagtaggtaggtagggttacgtaagttaaccggg

SEQ ID NO: 230523 - DNA, 599 bp, Homo sapiens
  misc_feature: GYAE6OF02INV4A.3.4.A04.1.454.CMB.1.raw
  modified_base (262)..(262): a, c, t, g, unknown or other
  misc_feature (262)..(262): n is a, c, g, or t
  modified_base (462)..(462): a, c, t, g, unknown or other
  misc_feature (462)..(462): n is a, c, g, or t
tcagagacgcactccacgaccggtgctcgatttagagtagtgatcagggggagctctgggagacgagcccagcactggaagtcgccggtgtttccattcggtgatcatcactgaacacagaggactcaccatggagtttgggctgagcttgggttttcctcgttgcttcttttaagaggtgtccagtgccaggtgcagctggtggagtcgtgggggaggcgtggcccagccgtgggacggtcccaggaacctctcctgtacngtctctggattcacctttaggtactatgctatgcacgtgggtccgccgggctccgaggcaagggggctgggagtggggtggctaggttatatcccatgatggagcaagtaactctacgcagactcgagaacgggcgatcacatctaccagacgacaacttaccaaagaaccacgactagttatctagacaaatacgaaanacgcctagaagacgacgtggaaacggaccgtaacggcgttagttacggttaagtttaaccgtggttacggaaccggtaagggaacggtaagttacggtaaacgggttacggggttaccggtaaagtttaaaccgggg

SEQ ID NO: 230524 - DNA, 568 bp, Homo sapiens
  misc_feature: GYAE6OF02JAZ55.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtctgggggagcgtggcccagcctgggaggtcccaggaactctcctgtacagtctctggattcaccttaggttactatgctatcgctacgtgggtccgccgggctccaggcgaaggggctgggaggtcgggtggctagttatatcccatgatggaggcaagtaatcctagcagactcggtgaacgggctatcaccatcctcagagacaattaccaaagaaccacgctagtatacctcgacgaaactaggaaaccacgacctaggagaacggcctaggaacggaccgacgggcgttagaccgttagtttaccgtggttcggacgtaaggtaggtacgtaggtaggtgggttaccgagttaaccggg

SEQ ID NO: 230525 - DNA, 574 bp, Homo sapiens
  misc_feature: GYAE6OF02F18Y3.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtgggggaggcgtggcccaggcctgggaggtcccaggaactctcctgtacagtctctggattcacttagttactatgctatgcacgtcgggtccgccgggctccgaggcaagggggctgggagtggggtggctaggttatatcccagtgatgggacggacaaggtaaaactccctaacgcaagtaccgtccgtaggaacgggccgattccaacctactcctaccagacgaactaacttacccgaaagaaccacgcttagtactctagacaaatgaaacagacctggagacgctaggacggaccgacggctgtagttattacgtgtcggacgaggacgagttaggaggttacggtacgtagttaacggg

SEQ ID NO: 230526 - DNA, 547 bp, Homo sapiens
  misc_feature: GYAE6OF02H6JS9.3.4.A04.1.454.CMB.1.raw
  modified_base (397)..(397): a, c, t, g, unknown or other
  misc_feature (397)..(397): n is a, c, g, or t
  modified_base (404)..(404): a, c, t, g, unknown or other
  misc_feature (404)..(404): n is a, c, g, or t
  modified_base (430)..(430): a, c, t, g, unknown or other
  misc_feature (430)..(430): n is a, c, g, or t
  modified_base (437)..(437): a, c, t, g, unknown or other
  misc_feature (437)..(437): n is a, c, g, or t
  modified_base (443)..(443): a, c, t, g, unknown or other
  misc_feature (443)..(443): n is a, c, g, or t
tcagagacgcactccacgaccggtgctcgatttagagtagtgatcagggggagctctgggagacgagcccagcactggaagtcgccggtgtttccattcggtgatcatcactgaacacagaggactcaccatggagtttgggctgagcgtggtttctcgttgctctttaagaggtgtccagtgccaggtgcagctggtggagtcgtgggggagcgtggcccagcctggggacggtcccaggaacctctcctgtacagtctctggattcaccttaggttactatgctatgcactgggtccgccgggctccaggcaaggggctggaggtggggtgctaggttatactccatgatgggagcaagtaaatcctagctagactccgtagacggcgtatcacntctcagngacaataccaagacacgatgtatctnaactaancgaacngacctaggacgagcgtaggaacggacgacgggcttggtacgttattacgtggtagtacgaaggtacgtagtacgggtagttacggggtacctaagttaaccggg

SEQ ID NO: 230527 - DNA, 567 bp, Homo sapiens
  misc_feature: GYAE6OF02JDI7C.3.4.A04.1.454.CMB.1.raw
  modified_base (335)..(335): a, c, t, g, unknown or other
  misc_feature (335)..(335): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctctttaagaggtgtccagtgccaggtgcagctggtggagtcgtgggggaggcgtggcccagcctgggacggtcccaggaactctcctgtacagtctctggattcaccttaggttactatgctatgcacgtgggtcccgcgggcctccgaggcaaggggctgggagtggggnggcagttatatcccatgatggagcagtaaactctacgcagactccgtgaacggccattccaccatctaccagagaacaattaccaagaacacgactgtactctcgacaaatgaaacacgccgtagaacggagaccgtaggaacggacgacggccgttaggtacgttaacgttactggttacgaccggtaagacggtacgtaggtacggttaggggtaccgtagttaaacggg

SEQ ID NO: 230528 - DNA, 687 bp, Homo sapiens
  misc_feature: GYAE6OF02IH2C3.3.4.A04.1.454.CMB.1.raw
  modified_base (561)..(561): a, c, t, g, unknown or other
  misc_feature (561)..(561): n is a, c, g, or t
tcagagacgcactccacgaccggtgctcgatttagagtagtgatcagggagctctggagacgagcccagcactggaagtcgccggtgttccattcggtgatcatcactgaacacagaggacctcaccatggagtttggctgagctgggtttcctcgttgctcttttaagaggtgtccagtgccaggtgcagtctggtgagtcgtgggggagcgtggcccagccgtgggaggtcccagggtactcctctgtacgagtcctcgtggtactttcgaccgtttaggttacctagttcgccgttaatcgctaacgtgggtccgcccgggtcttaccgacggtcaaacggggcttacgggagttggggtccgcgtaggttataaccgtccctaagttcggaagtcgggaaggtcctaaaggtaacttccgaacggtcaaacgtaaccgtccgtagggacggacccgtattaccgacctatccgtactagacgtacacgttccaaagtaccaacgtcctagtaactcagaaccgaatacgtaacacgtactacggtaagtacggtccnggttaaaccggacgtaaccgggtaccgttaggtttacgttaaacgttaccgggtttacgtaacgggtccggtaaagttaccggaagttccggtaaggtttccggggacgttaaaacgttaccgggg

SEQ ID NO: 230529 - DNA, 589 bp, Homo sapiens
  misc_feature: GYAE6OF02H116H.3.4.A04.1.454.CMB.1.raw
  modified_base (175)..(175): a, c, t, g, unknown or other
  misc_feature (175)..(175): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgcttcttttaagnggtgtccagtgccaggtgcagctggtggagtcgtgggggagcgtggcccagcctgggagtcccaggactctctgtacagtctctggattcacctttaggtactatgctatgcacgtgggtccgccgggctccgaggcgaaggggctgggagtggggtgcgtagttatactccatgagtgaggcaagtaaactcctacgcgtaacgaccgttccgtagggaacgggtccgtaagttaccacctacttccgtaccgaagaacgtaacaaacttccgaaaacgaaaccacggtacttacgtacttcgtagaacctaaatacgaaccgagccgtagacgagacgtagtaaggtacgtacggtactggttacgtatttacgtggtgagagagagtgtaacggtgggtactagttaacgg

SEQ ID NO: 230530 - DNA, 508 bp, Homo sapiens
  misc_feature: GYAE6OF02F5RQ4.3.4.A04.1.454.CMB.1.raw
  modified_base (337)..(337): a, c, t, g, unknown or other
  misc_feature (337)..(337): n is a, c, g, or t
tcagagacgcactccacgaccggtgctcgatttagagtagtgatcagggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtctgggggagcgtggcccagcctgggaggtcccaggactctcctgtacagtctctggattcaccttaggttactatgctatgcactgggtccgccgggctccaggcaaggggctggagtgggtggcagttanatccatgatggaggcagtaaactcctacgcagactccgtgaacgggccgattcaccatctccagagacaattaccaagaacacgctagtatctgacaaatgaacagacctagacgagctagaggacacggctgtgtattactgtgcgagagagtgatgggtacagtaacgg

SEQ ID NO: 230531 - DNA, 596 bp, Homo sapiens
  misc_feature: GYAE6OF02IE9SM.3.4.A04.1.454.CMB.1.raw
  modified_base (333)..(333): a, c, t, g, unknown or other
  misc_feature (333)..(333): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgcttctttttaagaggtgtccagtgccaggtgcagctggtggagtcgtgggggagcgtggcccagccgtgggaggtcccaggactctcctgtacagtctctggattcacctttaggtactatgctatgcacgtgggtccgcgggctcgaggcaaggggctgggagtggggngcagttatactccatggatgggaggcaagtaaactccgtacgacagtacctccggtagggaacgggccgtagttccacctacgtcctaccaggaacgaactaaacttaccgaaacgaacctacgtctagttactcgtagaacctaaagtacgaaacgacgacctaggaacgagcgtaggacgaacgtaccggcgttggtacggttaagttaacgtggttaggacgaggtagagttaggacggttgggtacgtaagttaacggg

SEQ ID NO: 230532 - DNA, 596 bp, Homo sapiens
  misc_feature: GYAE6OF02GY5J7.3.4.A04.1.454.CMB.1.raw
tcagagacgcactccacgaccggtgctcgatttagagtagtgatcagggggatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacagtgatggaaacacctacttgaattggttcagcagaggccaggccaatcctaccaaggcgtaccttaatttactaaggtttcctaaccgggactcgtcgggtacccagacagattcgagcggcaggtgggtcaggcacgtgatttcgactactagaaactcagcgagggtggaggtcgtggaggtagttgggtttaggggttttatttcgtgtactagtgactaagtcctaacaaccgtacgtacggtaccgttaaccgtacgttttccgggaccgtaacgggggaaccaaggtcgtagggaagtacgtaaccgaaacgtaacgtggtacggacgttcgaccgaccgtacttccgtgttaccg

SEQ ID NO: 230533 - DNA, 586 bp, Homo sapiens
  misc_feature: GYAE6OF02HC3N2.3.4.A04.1.454.CMB.1.raw
  modified_base (488)..(488): a, c, t, g, unknown or other
  misc_feature (488)..(488): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtgggggagcggtggcccagccgtgggacggtcccaggaactctcctgtacagtctctggattcaccttagtactatgctatgcacgtgggtccgccggctccgaggcgagggctggaggtgggtgctagttatactccatgatgggagcaagtaactccgaacgcaacgtaccgtccggtaggaacggggccgtaagttccaaccgtacgtcctaccgaagacgtaactaacttacccgaaagaaccacgtctacgtaactctagactaaactacgaaacncgacctaggaagagcgtaagacggacacggcttggtagttctaccgtggtacgtaccggaagtacgagttaggaggtttcgggtactaagttaacggg

SEQ ID NO: 230534 - DNA, 633 bp, Homo sapiens
  misc_feature: GYAE6OF02H5G67.3.4.A04.1.454.CMB.1.raw
  modified_base (291)..(291): a, c, t, g, unknown or other
  misc_feature (291)..(291): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgcttcttttaagaggtgtccagtgccaggtgcagctggtggagtcgtgggggaggcggtggcccaggccgtggggaggtcccaggactctcctgtacagtctctggattcacctttaggtactatgctntgcacgtggggtcccgccgggctccgagggacgaaggggcgtagggaggtgggtggactaaggttactactcccatgagtggagcgtaagtaaactccgtagcagtacctcggtaggaacgggcctattccaccacttccaccgaagacaactaacttaccaaagaaccacgtctagtactacgagaactaaagtacgaaacgacgtacccgtagaacggtacgtcgtacgggaacggtaaccgtacggtacgttacggttaggttaactttaccggtggtacggacggtaaacggtagtaaggtcggttacgggttacgggtaaccggtaagtttaacggg

SEQ ID NO: 230535 - DNA, 524 bp, Homo sapiens
  misc_feature: GYAE6OF02H4RRM.3.4.A04.1.454.CMB.1.raw
  modified_base (335)..(335): a, c, t, g, unknown or other
  misc_feature (335)..(335): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgcttcttttaagaggtgtccagtgccaggtgcagctgggtggagtctggggggaggcgtggccccagcctggggaggtccccaggactctcctgtacagtctctggattcaccttaggttactatgctatgcactgggtccgcgggctccaggcaaggggctgggagtggggnggcagttatatcccatgatgggagcagtaaatcctacgcagactccgtgaacgggccgagttcacatctcagagacaattccaaagaacacgctagtactctgacaaatgaaacagcctagagacgcgtagagtacgacgcgtgtgtaattacgtgtgacgtaggagagtgagtgggtacgtataacgg

SEQ ID NO: 230536 - DNA, 546 bp, Homo sapiens
  misc_feature: GYAE6OF02HGPA4.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtctggggggaggcgtggcccagcctgggaggtcccaggaactctcctgtacagtctctggattcaccttaggttactatgctatgcatgggtccgccgggctccgaggcaaggggctgggagtggggtggcagttatatcccatgatggaggcagtaaatcctacgcagactcgtagaggccgatcacatctcagagacaattccaagaacacgctagtactctagacaatacgaacacgcctaggagacgctaggaacggacgaccggcttaggtcggttaattacgttaggtagcggtaaggaggacgttaggaggttggggtacgtagttaaaccgggg

SEQ ID NO: 230537 - DNA, 680 bp, Homo sapiens
  misc_feature: GYAE6OF02IHJF6.3.4.A04.1.454.CMB.1.raw
  modified_base (160)..(160): a, c, t, g, unknown or other
  misc_feature (160)..(160): n is a, c, g, or t
  modified_base (177)..(177): a, c, t, g, unknown or other
  misc_feature (177)..(177): n is a, c, g, or t
  modified_base (265)..(265): a, c, t, g, unknown or other
  misc_feature (265)..(265): n is a, c, g, or t
  modified_base (505)..(505): a, c, t, g, unknown or other
  misc_feature (505)..(505): n is a, c, g, or t
tcagagacgcactccacgaccggtgctcgatttagagtagtgatcaggggagctctgggagacgagcccagcactggaagtcgccggtgttccattcggtgatcatcactgaaccacagaggacctcaccatggagtttgggctgagcttgggttttccncgttgcttcttttaagnggtgtccagtgccaggtgcagctgggtgagtcgtgggggagcgtgggcccaggccgtggggacggtcccaggaactccgtctggtacngtctcgtggacttcaccgtttaggtactagtgcctatgctagtcggttccgccgggctccgaggcgaagggctgggacgtggggtcgctaggttatactccgatgagtggacggtacaggtaaactccgtacgacacggtaccgtccggtaggtacgggacccgtacttccgaccacttcgtccgaagacgtaacgtaacttcccgaaagtaaccgacgtacgttacgttaactcggtanaaccgtaagttaacgaaacgtacggtaccttagggaaccgtaggacccggttagaaccgggggtaaccaacgggtccgtttaagggtacgttaacggttaacgttcggtacggtaacggtaacgtcggtaacggtaccgtagggttaccggggttcgaacgtttttaaacccggg

SEQ ID NO: 230538 - DNA, 561 bp, Homo sapiens
  misc_feature: GYAE6OF02IBQAX.3.4.A04.1.454.CMB.1.raw
  modified_base (403)..(403): a, c, t, g, unknown or other
  misc_feature (403)..(403): n is a, c, g, or t
tcagagacgcactccacgaccggtgctcgatttagagtagtgatcagggggagctctgggagacgagcccagcactggaagtcgccggtgtttccattcggtgatcatcactgaacacagaggactcaccatggagtttgggctgagctgggtttcctcgttgctcttttaagaggtgtccagtgccaggtgcagctggtggagtcgtgggggagcgtggcccagccgtggggacggtcccaggaactctcctgtacagtctctggattcaccttaggttactatgctatgctacgtggggtccgccgggctccgaggcgaaggggctgggagtggggtggcaggttatatcccagtgatggagcagtaatccgtagcagactcgtaggaacggccatccacntctcagacacaacttaccgaagaacacgtctagtactctgaacaatgaacagcctaggacgagcgtagacggactacgggcttcggtagttaacgttacgtagtaggacggtaaggaggtacgtaggtaggtttacggggtacgtaagtttaaccggg

SEQ ID NO: 230539 - DNA, 583 bp, Homo sapiens
  misc_feature: GYAE6OF02HF2WB.3.4.A04.1.454.CMB.1.raw
  modified_base (258)..(258): a, c, t, g, unknown or other
  misc_feature (258)..(258): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtgggggaggcgtggcccagccgtgggacggtcccaggacctctcctgtacngtctctggattcaccgttagttactatgctatgcactgggccgccgggcctccgaggcgaaggggctgggagtgggtggcagttatactcccatgagtggaggacagtaaactcctacgacacgacgtccgtaggaacgggccacttccaccgtactcctaccgagaacgacgagtaccacgaaacgaaccacccttaatacctctcgaacaaactagaaaccacgaccgtagacgtaacctgggaacgaccgacggctacttaattaccgttatggtggacgagacggtagggccggtcgggaaccgagtacggccggtacggg

SEQ ID NO: 230540 - DNA, 593 bp, Homo sapiens
  misc_feature: GYAE6OF02IZ9CY.3.4.A04.1.454.CMB.1.raw
tcagagacgcactccacgaccggtgctcgatttagagtagtgatcagggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtgggggaggcgtggcccagcctggggacggtcccaggacctctcctgtacagtctctggattcaccgttaggttactatgtctatgcacgtcgggtccgccgggctccgaggcgaaggggctgggaggtggggtggcgtagttatactccatgagtgggagcaagtaactccgtacgcacgacctcggtaggacgggccgtattaccacctactcctaccagacgactaacttaccgaacgaacacgctagtactacagaacaatagaactagaccgtagaacgacggtactaggaacggacgacggtcgttaggttacgttaagttacgtggtacggacggtaagtacggtagttaggtaggttacgggtacgtagttaacggg

SEQ ID NO: 230541 - DNA, 540 bp, Homo sapiens
  misc_feature: GYAE6OF02HQ7XW.3.4.A04.1.454.CMB.1.raw
  modified_base (334)..(334): a, c, t, g, unknown or other
  misc_feature (334)..(334): n is a, c, g, or t
  modified_base (365)..(365): a, c, t, g, unknown or other
  misc_feature (365)..(365): n is a, c, g, or t
  modified_base (405)..(405): a, c, t, g, unknown or other
  misc_feature (405)..(405): n is a, c, g, or t
  modified_base (408)..(408): a, c, t, g, unknown or other
  misc_feature (408)..(408): n is a, c, g, or t
  modified_base (517)..(517): a, c, t, g, unknown or other
  misc_feature (517)..(517): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcgtggtttctcgtgctctttaagaggtgtccagtgccaggtgcagctggtggagtcgtgggggaggcgtggcccagccgtggggacggtcccgaggaactctcctgtacagtctctggattcaccttagtactatgctatgctacgtcgggtccgccgggctccgaggcgaggggctgggaggtgggngctagttatctccatgatggagcaagtaacnccgtacgcagtaccgtcgtagaacggtcatcaccatcacnganactactacaagaacacgtctagtactcgtagacaaagtgaactcgaccgtgacgagtcgaggacgacgacggcgttggtagttacttacgtggtcgacggagagtacgngtagggtggtacgtattaacggg

SEQ ID NO: 230542 - DNA, 645 bp, Homo sapiens
  misc_feature: GYAE6OF02JP196.3.4.A04.1.454.CMB.1.raw
  modified_base (259)..(259): a, c, t, g, unknown or other
  misc_feature (259)..(259): n is a, c, g, or t
  modified_base (525)..(525): a, c, t, g, unknown or other
  misc_feature (525)..(525): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgcttcttttaagaggtgtccagtgccgaggtgcagcgtggtggagtcgtgggggaggcgtggcccaggcctggggacgtcccaggactctcctgacngtctctggacttcacgtttaggttactagtgctatcgctacgtcgggtccgccggcgtccgaggcgaacggggctgggaggtgggtagcgtagttactcgtcccagtacggtagtcggacggtactaaggttaaaactccggtaacgctaacggtaccgtaccggtagggaaccgggtccgtaagttccaaccgattccgtaccgaagtacgaactaacgtaccgaaacgacacgtactagtactcgtagaacaagtacgaaaccngtaccgtagaacgacgacgtaggaaccgggaacaccggtacgttacggttagttaacttacggtaggtcggaacgtaaggacgttaacgtaggacggtttggggtacctaaggttaacgg

SEQ ID NO: 230543 - DNA, 705 bp, Homo sapiens
  misc_feature: GYAE6OF02J0QKR.3.4.A04.1.454.CMB.1.raw
  modified_base (159)..(159): a, c, t, g, unknown or other
  misc_feature (159)..(159): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagtctgggttttccncgttgctcttttaagaggtgtccagtgccaggtgcagctggtggagtcgtgggggagcgtgcccagccgtgggacgtcccaggactctcctgtacagtctctggacttcaccttaggttactatgctatcgctacgtcgggtccgccggctccgaggcgaaggggtctagggacggtgggtggacgtaggtttaactacgtcccgtagtcggtaagtcggggtaacggtacgtaacggttaaactcccgtaacggacgtaacgtacccggttaccggaacgggtaaccgggtcccgtaagtttacccgaaccgtacgttacccgtacccgaacgtaacgtaacctaaaccgttacccgaaaacggtaaccgtaccggtacttagttaccgtaccgtagaacctaaagtacgtaaacgacgtaccgtaggtacgacgtacgtacggacggaccgtacgggtactaggttacgttacgttacgacggttacggacggtaacggtagtacgtaaggtacgggttacgggtacgttacggttaaaccggg

SEQ ID NO: 230544 - DNA, 624 bp, Homo sapiens
  misc_feature: GYAE6OF02HPK6M.3.4.A04.1.454.CMB.1.raw
  modified_base (225)..(225): a, c, t, g, unknown or other
  misc_feature (225)..(225): n is a, c, g, or t
  modified_base (253)..(253): a, c, t, g, unknown or other
  misc_feature (253)..(253): n is a, c, g, or t
  modified_base (385)..(385): a, c, t, g, unknown or other
  misc_feature (385)..(385): n is a, c, g, or t
  modified_base (451)..(451): a, c, t, g, unknown or other
  misc_feature (451)..(451): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcggtggtttcgcgtaggctctttaagaggtgtcagtgcaggtgcagctgggtggaggtcgtggggggagcggtggcccngcctgggagtcccaggactctctgtacngtctctggattcaccgtttaggttactatgctatgactacgtgggtcccgccgggcctaccgagggccgaacgggggctgggaggtggggtggctaggttatactcccaatgagtcgggagacaagttaacnccgtacgcgaagtccgtaccggtagggaacgggcccgtattacccacctatccgtaccaaggtaanaacctaaacgttacccaaaggtaccacggtactagtactacgtgaactaaagtacgaacacgacccgtagaaggaccgtacgtacggaacggaccgcgggacttggttacgttaacgttcgtacggtgacggagtacggagttacggtagggtacggtacggtagttaacggg

SEQ ID NO: 230545 - DNA, 678 bp, Homo sapiens
  misc_feature: GYAE6OF02JRZQ5.3.4.A04.1.454.CMB.1.raw
  modified_base (158)..(158): a, c, t, g, unknown or other
  misc_feature (158)..(158): n is a, c, g, or t
  modified_base (175)..(175): a, c, t, g, unknown or other
  misc_feature (175)..(175): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttccncgttgcttcttttaagnggtgtccagtgccaggtgcagcgtggtggagtcgtaggggggagtcgtcgggcccaggcccgtggggacggtccccaagggaaccttcgtccctggtaccagttctcgtggattccgaaccgtttagggttaccttagtcgtaccgttaatcgacgtacgtcgggggttcccgcccgggtcctaccgaagggcccgtaaaggggggtcctagggtaagggtcggggtagggtcaaggggtttaactacgtcccaagtcggagttggacggactaaagtaacgtcctacgcagtaccgtcgaaggaacgggccgattcgactatcctccaaggtacacgtaaactaccgaaacgacgacgtacttagactactacggacaaagtaccgaagtacgcaacggtaagacgacgtagaacgtacgacgggacgtcgtaaggttactaacggttggaacgtacggtaagacgtacggtacgagggtacgggtacgtacgttaaacggg

SEQ ID NO: 230546 - DNA, 657 bp, Homo sapiens
  misc_feature: GYAE6OF02H8IO4.3.4.A04.1.454.CMB.1.raw
  modified_base (262)..(262): a, c, t, g, unknown or other
  misc_feature (262)..(262): n is a, c, g, or t
  modified_base (345)..(345): a, c, t, g, unknown or other
  misc_feature (345)..(345): n is a, c, g, or t
  modified_base (523)..(523): a, c, t, g, unknown or other
  misc_feature (523)..(523): n is a, c, g, or t
  modified_base (584)..(584): a, c, t, g, unknown or other
  misc_feature (584)..(584): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttcttttaagaggtgtccagtgccaggtgcagcgtgggtggagtcggtgggggaggcgtggcccagccgtggggacgtcccgaggactctctgtacngttctctggattcacctttaggttactatgctatcgcacgtcgggtccgccggctccgaggcgaaggggctagggagtggggngcgtagttatactccatgagtgggagacaagtaactccgtacgcaacggtacctccggtaggaacccgggccaacgtttaccaccgtaactcctaccgaagtaacgaacctaacttaccgaaaacgaaccgaacggtacttagttacttcgtaggaaacctaaagtacgtaaaaccgngtaccgtaggaacgtagtaccgtagggaacgtaaccgcggttacgttggtttaaccggttntttaaccggttggtacggtacggaaggtagtaacggttaggtaagggttcgggtaacgttagttaaaccgggg

SEQ ID NO: 230547 - DNA, 639 bp, Homo sapiens
  misc_feature: GYAE6OF02GF5YI.3.4.A04.1.454.CMB.1.raw
  modified_base (346)..(346): a, c, t, g, unknown or other
  misc_feature (346)..(346): n is a, c, g, or t
tcagagacgcactccacgaccggtgctcgatttagagtagtgatcagggggagctctgggagacgagcccagcactggaagtcgccggtgtttccattcggtgatcatcactgaacacagaggactcaccatggagtttgggctgagctgggttttcctcgttgcttcttttaagaggtgtccagtgccaggtgcagctggtggagtcgtggggggagcgtggcccagccgtggggacggtcccaggaacctctccgtgtacagtctcgtggtacttccaccgtttaggttactatgctatgcacgtcgggtccggccggctccgaggcgagggctgggagtgggngctagttatctccagtgagtggagctaagtaactcctaacgcagtaccgtacgtaggaacgggccgaagttccacctatcctacgaagacgtaacctaacgtaaccaaacgaacctacgtcttagttactactacggaactaaagtacgaaaccgtacgtaccgtaggacggacgtacggtaggaacgggaaccgtacgggtcgttacggttaggtttaacttaccggtaggtcggtacggtaaggtaagttacggttaggtacgggtacgggttacggtaagtttaaccggg

SEQ ID NO: 230548 - DNA, 786 bp, Homo sapiens
  misc_feature: GYAE6OF02HPO8Y.3.4.A04.1.454.CMB.1.raw
  modified_base (248)..(248): a, c, t, g, unknown or other
  misc_feature (248)..(248): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttcttttaagagtgtccagtgtcaggtgcagcgtgggtagagtcgtgggggagcgtggcccagccgtggacgtccaggactcnctgacagtctcgtgactcacgtttagtactagtgctacgtgctacgtcgggtcccgccggtaccaccgacggtaccgaacggggtcttaggggacggtggggtcggacctaggtttaactacgttacccgaattcgggaagtggggaacggtacgtaaacgttaaaaacgtcccgttacggaccgtaacggtaaccgtccggttaacggggaacgggtacccgtaacgtttacccgaaccgtaacgttacccgtacccgaacgaacgtaaaccgtaaacgttaaccgaaaacgaaacgtaacggtaccgtaaggttacctacgttacgtaaaccgaaaacgttaacgtaaaaccgaaccgtaacccttagggtaacgacgtaccgttaaggaaacccgggtaacgtacggtacccggttaaggtttacggtttaacggttaccgtttacgggttaacggaaccgggttaacgggtaaaccggttaggttaacgggtacggggtttacgggttaaccggttaaggtttaaaacccgggg

SEQ ID NO: 230549 - DNA, 632 bp, Homo sapiens
  misc_feature: GYAE6OF02GLYLS.3.4.A04.1.454.CMB.1.raw
tcagagacgcactccacgaccggtgctcgatttagagtagtgatcagggggagctctgggagacgagcccagcactggaagtcgccggtgtttccattcggtgatcatcactgaacacagaggactcaccatggagtttgggctgagcttgggttttcctcgttgcttcttttaagaggtgtccagtgccaggtgcagctgggtggagtcgtgggggagcgtggcccagccgtggggacggtcccaggacctctcctgtacagtctctggattcaccttaggttactatgctatgctacgtgggtccgccgggctccgaggcgaaggggctgggagtggggtggctagttatactccgatgagtgggagcaagtaactccgtagcagaccgtcggtaggaacgggccgattaccacctactcctaccaagagaactaactaccaaacgaacaccgcttagtactctacgaactaaacgtcgaaactcggaccgttaggaacgtacgcgtaaggaaccgggtacgtaaccgggtacgttacggtacggtttaactttaaccgttgggtacggaaccggtaggtaacgtacggttaggtaacgggttacggggttacgtaagtttaaaccgggg

SEQ ID NO: 230550 - DNA, 563 bp, Homo sapiens
  misc_feature: GYAE6OF02HVB3P.3.4.A04.1.454.CMB.1.raw
  modified_base (175)..(175): a, c, t, g, unknown or other
  misc_feature (175)..(175): n is a, c, g, or t
  modified_base (192)..(192): a, c, t, g, unknown or other
  misc_feature (192)..(192): n is a, c, g, or t
  modified_base (377)..(377): a, c, t, g, unknown or other
  misc_feature (377)..(377): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttggctgagcttgggttttcctcgttgcttcttttaagnggtgtcagtgccaggtncagctggtgagtcgtgggggagcgtggcccagcctgggaggtcccaggactctccgtgtacagtctctggacttcacctttaggttactatgctatgcactcgggtccgccgggctccgaggcgaaggggctagggaggtggggtggcgtagttatactcccagtgagtggaggcaaggtaaacnccgtacgacacggacctcccggtagggaacgggccgtattccaccatacctccagacacaataccaagaaccacgctagtatcagacaaatacggaacaggaccctaggacgacgcgtaggacggacgacgacgttgtagtacttacgtgtgacgagtacgtgtagagttgggtactagttaacgg

SEQ ID NO: 230551 - DNA, 624 bp, Homo sapiens
  misc_feature: GYAE6OF02GKVBG.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtgggggagcgtggcccagcctgggacggtcccaggaacctctcctgtacagtctctggattcaccttaggttactatgctatgcacgtgggtccgccgggctccgaggcgaaggggctgggaggtgggtggctaggttatacgtcccagtgagtgggaggacaaggtaaaactccgtaacgcgaacgtaccgtaccggtagggaaacgggtccgtatttaccacctacgtcctacccgagacgaactaaacttacccaaagaaccaaccgtacttaggtactcgtagactaaaagtacgaaaccgacgtcgtaggaagacgcgtaggacggaaccgtacgggcttaggtacgttaattaccgtaggttacgacggaagaacgtagtaggtaacggtcgggtacgtaagttaaaccgg

SEQ ID NO: 230552 - DNA, 674 bp, Homo sapiens
  misc_feature: GYAE6OF02JBI75.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggtttcctcgttgctcttttaagaggtgtccagtgccaggtgcagcgtggtggagtcgtgggggagcggtggcccagccgtgggacggtcccaggaacctctcctgtacagtctctggattcaccttaggttactatgctatgcactcgggtccgccggctcgaggcgaaggggctgggagtgggtggctagttatatcccgatggattagggacggactaagtaaacgttacctacgacgaacgaccgttaccggtagggtaacgggcccgaactttccgaaccctagttacccgtaccgacggaacgtaaactaaacctttaacccgaaacgtaacgaacgtaccttaggttactacgtacgacctaaaacgtacggaaaccgtacgaccgtagaaccggacgtacgtacggaaccggaacgtaccgggtacgttacggtagtttaacgttaccgttaggtaccgacggtaaggacgtacgttaggtacggttacggggtaccgtaaggtttaaacccgggg

SEQ ID NO: 230553 - DNA, 599 bp, Homo sapiens
  misc_feature: GYAE6OF02F6ZGD.3.4.A04.1.454.CMB.1.raw
  modified_base (174)..(174): a, c, t, g, unknown or other
  misc_feature (174)..(174): n is a, c, g, or t
  modified_base (257)..(257): a, c, t, g, unknown or other
  misc_feature (257)..(257): n is a, c, g, or t
  modified_base (475)..(475): a, c, t, g, unknown or other
  misc_feature (475)..(475): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagnggtgtccagtgccaggtgcagctgggtggagtcgtgggggaggcgtggcccagcctgggacgtcccaggacctctcctgtacngtctctggattccaccttaggttactatgctatgcacgtgggtccgccgggctccgaggcgaaggggctggagtggggtgctagttatactccagtgagtgggaggcaagtaaactccgtacgctacgactccggtaggaacgggtccgtattaccactactccgtaccaagaacgaactaaacttacccaaagaacctacgcgtagttactccgtanaacgtaaactagaaacacgtcctaggaacgtagtcgtaggaacggacgaccgggtctaggtacgttaagttacgtggtagtacggagacgtagtacggtaggtcggggtacgtaagttaacggg

SEQ ID NO: 230554 - DNA, 566 bp, Homo sapiens
  misc_feature: GYAE6OF02HVXFL.3.4.A04.1.454.CMB.1.raw
  modified_base (251)..(251): a, c, t, g, unknown or other
  misc_feature (251)..(251): n is a, c, g, or t
  modified_base (336)..(336): a, c, t, g, unknown or other
  misc_feature (336)..(336): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgcttcttttaagaggtgtccagtgccaggtgcagcgtggtggagtcgtgggggaggcgtggcccagccgtggggacgtcccaggactcncctgtacagtctctggattcacctttaggtactatgctatgcactcgggtccgccgggctccgaggcgaaggggctggagtgggngcagttagtatccatcgatgggagcgaagttaaactcctacgcaacgacctcgtaggaacgggtccgattaccaccagtctaccgtagacgaacaacttaccgaagaacacgctagtatctgaactaacgtagaaacagacccgtaggacgagcgtaggaggacgacggtcgtaggttaggttagtacgttggtgacgtagagtagtggtagtgggtacgtagttaacgg

SEQ ID NO: 230555 - DNA, 728 bp, Homo sapiens
  misc_feature: GYAE6OF02IZ5RK.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttccctcgttgcttcttttaagaggtgtccagtgccaggtgcagctgggtggagtcgtgggggaggcgtggcccaggcctggggacggtcccaggaacctctcctgtacagtctctggattccacctttaggttactatgctatgcacgtgggtccgccggctccgaggcgaaggggctggacggtggggtcggcgtagttatacgttcccagtcggataggggacggacgtaacgttaaactcccgtaacgtacgaacgtaccgttacccggtaagggaaccggggtcccggtaactttcccgaaccctaacgttccccgttaacccgaaggtaacgtaaaccgtaaactttaacccgaaaacgtaaacccgaaccggtacgttacggttaaccttacgttacggtaaactaaaacgtacgtaaaacccgtaacgtacccggttaaggaaccggtaagtaccggtaggtaacgggaaccgaccggtcgttaggttacgttaacgtttacgttaggtacggtaccggaaggacggttagtaggttacggtaacgggttacgtacgttaaacggg

SEQ ID NO: 230556 - DNA, 627 bp, Homo sapiens
  misc_feature: GYAE6OF02HDPEW.3.4.A04.1.454.CMB.1.raw
tcagagacgcactccacgaccggtgctcgatttagagtagtgatcagggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtgggggagcgtggcccagcctgggacgtcccaggaacctctcctgtacagtctctggacttccacctttaggttactatgcttatgctacgtcggggtccccggccgggtcctccggaggccgaaggggctggggaggtgggggtgcgtaggttatacgtcccagtggagtgggagctaagtaactccgacgcagaccgtcggtaggacgggcctattccacctactcctacacgacgaactaacttaccgaaagtaaccgacgtctacgtactctagacaatacgaaactacgtaccgtagaacgacgtcgtaaggaacgtaacggtaccgtacgttaggttagtttaacgttacgttggtcggtacggtaaggacgttaaggtggtaaggtttacgggttacgtaacggttaacggg

SEQ ID NO: 230557 - DNA, 640 bp, Homo sapiens
  misc_feature: GYAE6OF02F784J.3.4.A04.1.454.CMB.1.raw
  modified_base (194)..(194): a, c, t, g, unknown or other
  misc_feature (194)..(194): n is a, c, g, or t
  modified_base (257)..(257): a, c, t, g, unknown or other
  misc_feature (257)..(257): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttcttttaagaggtgtccagtgccaggtncagctggtggagtcgtggggggagcgtggcccagcctgggacgtcccaggactctcctgtacngtctctggattcacttaggttactatgctatgtcacgtgggtccgccggctccgaggcgaaggggctgggagtgggtgctagttatactccatgagtggagacagttaaactccgtaacgctacgtaccgtccggtaggaacgggtccgtattacgacctactcctaccgagtaacgaactaacttaccgaaagaacctaacgtacttacgtaacttccgtagactaaagtacgaacgtacgtaccgtagacgtacgtcgtaggtaacgggaccgtacgggacgtttacggtacgttaacgtttaccgttagggtaccggtacggtaaggtaggtaacgttagggtaacgggttcggggttaaccgtaacgtttaaaccgggg

SEQ ID NO: 230558 - DNA, 613 bp, Homo sapiens
  misc_feature: GYAE6OF02IREQT.3.4.A04.1.454.CMB.1.raw
  modified_base (264)..(264): a, c, t, g, unknown or other
  misc_feature (264)..(264): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgctcttttaagaggtgtccagtgccaggtgcagctgggtggagtcgtgggggagcgtcggccccaggccgtggggacggtcccaggacctcgtcctgtacngtctctggattcaccttaggtactatgctatgcacgtgggtccggccgggctccgagggcgaaggggcgtgggaggtggggtggcgtagttactatcccagtgagtagggacggcgtaagtaaactccctacgcaacgtacctcggtacggacggtccgacttacaccactcctaccagtaacgaactaacttaccgaaagaaccgtaacgtctacgttaacgtcctagaacctaaatacggaacacgtaccgtacgagacgtacgtaggaaccggacgtacggtcgtaggttacgttagttacgtggtggacgtaaggagtagtgtacgtgggtacgtagttaacggg

SEQ ID NO: 230559 - DNA, 709 bp, Homo sapiens
  misc_feature: GYAE6OF02H7LIB.3.4.A04.1.454.CMB.1.raw
  modified_base (176)..(176): a, c, t, g, unknown or other
  misc_feature (176)..(176): n is a, c, g, or t
  modified_base (401)..(401): a, c, t, g, unknown or other
  misc_feature (401)..(401): n is a, c, g, or t
  modified_base (538)..(538): a, c, t, g, unknown or other
  misc_feature (538)..(538): n is a, c, g, or t
  modified_base (600)..(600): a, c, t, g, unknown or other
  misc_feature (600)..(600): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttggctgagcgttgggttttcctcgttgcttcttttaagnggtgtccagtcgccgaggtgcagcgtgggtggagtcggtggggggaggcgtcggcccagccgtggggacggtcccgaggaacctcctcctgtacagtctctggattctaccgtttaggtacttatgtactagtcgaccacgtcgggggtccccgcccggggtcctaccgacgggcgggtaaacgggggcttgggggacgggttggggtacggactaaggtttaanaccgtcccgaagttcgaggttagggacggtactaaacggttaaaactcccgtacgaaccaacggtccgtaccgggtagggaaacggggtcctaagttccaacctatcctacgaagacaactaactaccgaaagaacnccgtactcgtaactcgtagaactaaagtacgaacgtacgtaccgtaggaagtacgtaacggnggaaacgggaccgtcgggttacttggttaacgttacggttcgttaggtacgggtaacggaggtaaggtacgttagggtacgggtttacgggtaccgttaagtaccgggg

SEQ ID NO: 230560 - DNA, 596 bp, Homo sapiens
  misc_feature: GYAE6OF02G28TH.3.4.A04.1.454.CMB.1.raw
  modified_base (263)..(263): a, c, t, g, unknown or other
  misc_feature (263)..(263): n is a, c, g, or t
  modified_base (492)..(492): a, c, t, g, unknown or other
  misc_feature (492)..(492): n is a, c, g, or t
tcagagacgcactccacgaccggtgctcgatttagagtagtgatcgaaggggagctctgggacgacgagcccagcactggaagtcgccggtgtttccattcggtgattcatcactgaacacagaggactcaccatggagtttgggctgagtcttgggttttcctcgttgctcttttaagaggtgtccagtgccaggtgcagcgtgggtggagtcgtgggggagcgtggcccagccgtgggacgtcccaggactctcctgtacngtctcgtggattcaccttagttactatgctatgcacgtcgggtccgccggtctccgaggcgaagggctgggagtgggtgctagttacactcccgagtcgagtggagactaagtaaactcctacgcaagactccggtagaacgggtccgtagttaccaccgaagtccgtaccgaagtacgaactaattaccaaagaacacgtactagtactcgtagactaaagtcgaacncgtaccgagacgacgtacgtaggaacggaccgacggtcgtagtaccgttaacttaccgtgtacgacgaagacgtagtagtacggtcggtacgtacgttaacggg

SEQ ID NO: 230561 - DNA, 539 bp, Homo sapiens
  misc_feature: GYAE6OF02HFTK1.3.4.A04.1.454.CMB.1.raw
  modified_base (445)..(445): a, c, t, g, unknown or other
  misc_feature (445)..(445): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctgggtggagtcgtgggggagcgtggcccagcctgggaggtcccaggaactctcctgtacagtctctggattcaccttaggttactatgctatgctacgtggggtccgccgggctccgaggcgaaggggctgggagtgggtggcgtagttatatccatgagtggaggcagtaaatcctacgcagactacgtgacgggcgatcacatctaccagacgacaattaccaagaaccacgctagtactcgggtanacaaatgaacacgcctagagagcgtagacgacgacgcgtgttgttattacgtggtgacgtaggacgtagtaggaggtcggtacgtagttaacgg

SEQ ID NO: 230562 - DNA, 552 bp, Homo sapiens
  misc_feature: GYAE6OF02HI2L8.3.4.A04.1.454.CMB.1.raw
  modified_base (344)..(344): a, c, t, g, unknown or other
  misc_feature (344)..(344): n is a, c, g, or t
  modified_base (357)..(357): a, c, t, g, unknown or other
  misc_feature (357)..(357): n is a, c, g, or t
  modified_base (396)..(396): a, c, t, g, unknown or other
  misc_feature (396)..(396): n is a, c, g, or t
  modified_base (401)..(401): a, c, t, g, unknown or other
  misc_feature (401)..(401): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtctgggggaggcgtggcccagcctggggaggtcccaggaactctcctgtacagtctctggacttcaccttaggttactatgctatgcactggggtcccgccgggctccgaggcgaaggggctgggagtgggtgcagttantccatgatggagntaagtaaactcctagcagctcgtgaaggccatcacatcncaganacaattccaagaacacgctagtactactagacctaaatcaaacgacgcctaggactaagctaggaagggaccacgggcttaggttacgttaacgttactggtcggacgtaagacggtagtagtaggttacggggtacctaagttaaccggg

SEQ ID NO: 230563 - DNA, 701 bp, Homo sapiens
  misc_feature: GYAE6OF02G358A.3.4.A04.1.454.CMB.1.raw
  modified_base (258)..(258): a, c, t, g, unknown or other
  misc_feature (258)..(258): n is a, c, g, or t
  modified_base (312)..(312): a, c, t, g, unknown or other
  misc_feature (312)..(312): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggtttcctcgttgctcttttaagaggtgtccagtgccaggtgcagctggtggagtcgtgggggagcgtggcccaggccgtggggacggtcccaggaactctcctgtacngtctctggattcaccttaggtactatgctatgcacgtgggtccgccggctccgnggcgaacggggctgggaggtgggtggctaggttatactccgatgacgtgggaggcaaggtaaactccgtaacgcaacgacctccggtaggaacgggccgtaacgttaccaacccgtaacttccgtaccgaacgaacgtaaacctaaacgtttaacccgaaaacgtaaaccgtaaccgtacgttaacgttacttaccgttacgaacctaaaacgtacgaaacctacggtacccgtaggaacggacgtaccgtaaggaacgggaacccgtaccgggtcgttaggtaccggtttaagtttaaccggttcggtaggtaacccgggtaagggtaacggtaacggtttacgggtaacgggtttcgggggttaccgtaaaggtttaaacccggggg

SEQ ID NO: 230564 - DNA, 551 bp, Homo sapiens
  misc_feature: GYAE6OF02JC9YC.3.4.A04.1.454.CMB.1.raw
  modified_base (255)..(255): a, c, t, g, unknown or other
  misc_feature (255)..(255): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtgggggagcgtggcccagccgtgggacgtcccaggactctcctgtacngtctctggattcacttaggtactatgctatgcactggtccgcgggctccaggcaaggggctggagtgggtgctaggttatatcccatgatgggaggcagtaaatccgtacgcagactccgtaggaacgggccgattcaccatcctcagagactaattccaagaacacgctagtactctagactaaatacgaacacgcctagacgagcgtacggaaggacgaacggcgtacggtggttaacttacgtggtacggtacggagacggagttaggagtacgggttacgagttaaaccggg

SEQ ID NO: 230565 - DNA, 706 bp, Homo sapiens
  misc_feature: GYAE6OF02FGQGE.3.4.A04.1.454.CMB.1.raw
  modified_base (158)..(158): a, c, t, g, unknown or other
  misc_feature (158)..(158): n is a, c, g, or t
  modified_base (386)..(386): a, c, t, g, unknown or other
  misc_feature (386)..(386): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttccncgttgctcttttaagaggtgtccagtgccaggtgcagctgggtggagtcgtgggggagcggtggcccagccgtggggacgtcccaggaactctcccgtgtaccagtcctcgtaggtacttaccgtaacgttaggtttaacctaatcggaccttaatcggcctaccggttcggggtcccgccgggtctccgaggtcgaaggggtctagggaggtggggtgctaggttanacgtcccagtagagtagggacgtacaacgtaaactccgaacgcgaacgtaccgtccggtaggaaccggtccgtacttaccacctactcctaccgaagaacgtaacctaaacgtaacccgaaacgtaaccgtaccgtacgttagtaccgtacgtaacgaacctaaacgtacgaaaccgtacggacccgttaaggaacggtacgaccgtaagggacgtaaccggtacggttcgttagtacgttaacgttaccggtcggtaaggtaccggaaggtacggtacgttacgggtacggttacgggtacgttaacggttaaacgggg

SEQ ID NO: 230566 - DNA, 682 bp, Homo sapiens
  misc_feature: GYAE6OF02ILUKX.3.4.A04.1.454.CMB.1.raw
  modified_base (179)..(179): a, c, t, g, unknown or other
  misc_feature (179)..(179): n is a, c, g, or t
  modified_base (262)..(262): a, c, t, g, unknown or other
  misc_feature (262)..(262): n is a, c, g, or t
tcagagacgcactccacgaccggtgctcgatttagagtagtgatcgaggggagctcgtgggagacgaggcccagcactggaagtcgccggtgtttccattcggtgatcatcactgaacacagaggactcaccatggagtttgggctgagcttgggttttcctcgttgcttcttttaagnggtgtccagtgccaggtgcagctgggtggagtcgtgggggagcgtggcccagccgtgggacgtcccgaggactctctcgtacngtctcgtggacttcacctttaggttactagtgctatcgacctcgtcggggtcccgccgggacctccggaggtccggaaggggtcctggggacggttggggtggactaaggtttataacgtccagtagagtggagccaagttaactccgtagacacgacgttccggaaggacgggtcctaacgttccaacccgtattcccgacctaaagggaactaactaaacttacccgaaaagtaaccaccggtacttacgtactacgtacggaacttaaaacgacgtaacctacgacccgtaggaacgttcgacggttaggaccggtaaccgaaccgggtcgtacgttaccggttaaacgtttccggttacggacggtacggagtacgtaccgtggtaaccgggtggttaacccgtaagttaacgggg

SEQ ID NO: 230567 - DNA, 732 bp, Homo sapiens
  misc_feature: GYAE6OF02GW50U.3.4.A04.1.454.CMB.1.raw
  modified_base (175)..(175): a, c, t, g, unknown or other
  misc_feature (175)..(175): n is a, c, g, or t
  modified_base (205)..(205): a, c, t, g, unknown or other
  misc_feature (205)..(205): n is a, c, g, or t
  modified_base (266)..(266): a, c, t, g, unknown or other
  misc_feature (266)..(266): n is a, c, g, or t
  modified_base (270)..(270): a, c, t, g, unknown or other
  misc_feature (270)..(270): n is a, c, g, or t
  modified_base (294)..(294): a, c, t, g, unknown or other
  misc_feature (294)..(294): n is a, c, g, or t
  modified_base (299)..(299): a, c, t, g, unknown or other
  misc_feature (299)..(299): n is a, c, g, or t
  modified_base (364)..(364): a, c, t, g, unknown or other
  misc_feature (364)..(364): n is a, c, g, or t
  modified_base (482)..(482): a, c, t, g, unknown or other
  misc_feature (482)..(482): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgcttcttttaagngtgtccagtgccaggtgcagcgtggtaggnggtcgtgggggaggcgtggcccagccgtgggacggtcccaggactcgtcctgtacagtctntggnttcactttaggttactgtgactangtacnccgttgggccgccggcctccgaggcgaacggggtcgtgggaggtcggggtggacgtaaggtttanacgtacccgtaagttcggaaggttagggaacggtaccgtaaaaggtaaaactcccgtaacggtacgaaacggtccgttaccgggtaggaaacgggtcccggtaatttccgaaaccctnttacccgtaccgtaagaacgtaaactaaccgttaaaccgaaaacgtaaccgaccgtaacgttaactagttaaccgtaacgtaaccaaaagttcgtaaactaacgtacccggtagaaacggacggacccttaaggggaaccggttaaccgaacggggtttactacgggtttaagttaaaccgttgttacggtacgggtagaaacggttagtaacgttagggtagtacggggtagtaaaccgtttaacgggg

SEQ ID NO: 230568 - DNA, 675 bp, Homo sapiens
  misc_feature: GYAE6OF02G49H9.3.4.A04.1.454.CMB.1.raw
  modified_base (174)..(174): a, c, t, g, unknown or other
  misc_feature (174)..(174): n is a, c, g, or t
tcagagacgcactccacgaccggtgctcgatttagagtagtgatcaggggagctctgggagacgagcccagcactggaagtcgccggtgttccattcggtgatcatcactgaacacagaggactcaccatggagtttgggctgagcttgggttttcctcgttgcttctttaagnggtgtccagtgccaggtgcagctggtggagtcgtgggggagcgtggcccagccgtgggacggtcccaggacctcgtcctgtacagtctcgtggattcacttagtactatgactatgacagtcgggtccgccgggctaccgaggcgaaggggctggggaggtggggtggacgtaggttacgtactcccgagtcgagtgggaggtacgtaagtaaacgtccgtaacgcaacggtaccgttaccggtacggaaacgggtccgtacgttaccgtaacctacgttaccctaccgtagaacgtaacctaacgttacccgaaaacgaaccgaaccgtaccgttagtaacgtcgtagaacctaaagacgtaaaccgcgtacctacgggaagacgtacgtacggaacggaccgtaacgggtcttacggtacgtttaacgttacgttggtaacggtacggtaaggtaacggtaacttaggacgggttacgggtacgttaagttaaaccggg

SEQ ID NO: 230569 - DNA, 667 bp, Homo sapiens
  misc_feature: GYAE6OF02IO0VM.3.4.A04.1.454.CMB.1.raw
  modified_base (175)..(175): a, c, t, g, unknown or other
  misc_feature (175)..(175): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgcttcttttaagnggttgtccagtgccaggtgcagctggtggagtcgtgggggagcgtggcccagccgtgggagtcccaggactctctgtacagtctcgtggtacttcaccgtttaggttactatgtactatcgactacgtcgggtcccggccgggtctccgaggacgaaggggtctgggtaggtggggtgcgtagttaactacgtcctagtggagtgggagactaagtaaactccgtaacgcgtaacgtactcccggtagggaacgggccgtacgttacaaccgtactaccgtaccgaagtaccgtaaacgtaacgttacccgaaacgtaaccgaccgtaccttacgttaacgtcgtagaacctaaagtacgaaacctacgtaccgtaggaacgtacgtacggaggtaaccgggtaccgacggtcgttggttacgtacgttaaccgtggttacggacggtaaggtacggtagtggttaacgggtggtaccgtaagttaaccggg

SEQ ID NO: 230570 - DNA, 603 bp, Homo sapiens
  misc_feature: GYAE6OF02GHPDH.3.4.A04.1.454.CMB.1.raw
tcagagacgcactccacgaccggtgctcgatttagagtagtgatcaggggagctctggggagacgagcccagcactggaagtcgccggtgtttccattcggtgatcatcactgaacacagaggactcaccatggagtttgggctgagctgggttttcctcgttgctcttttaagaggtgtccagtgccaggtgcaggctggtggagtcgtggggggagcggtggccccagcctggggacggtcccaggaactctcctgtacagtctcgtggattccacgttaggttactatgctatgctacgtgggtcccgccgggtctccgaggccgaagggggctgggaggtggggtggctagttatactcccgatgagtgggagcaagtaaactcctacgcagacctcggtaggaacggcgatcaccatccacgagacaactaactaccgaaacgaacacgactacgtatcgtagacctaaatacggaaccaggacctaggaacgtagcgtaggaacgaccgtaccggtcgtaggttacgttaacgtttacgtaggtcgtacggtaaggagtaggttcggaacggttacgggtacgtaagttaaccgggg

SEQ ID NO: 230571 - DNA, 580 bp, Homo sapiens
  misc_feature: GYAE6OF02G62IB.3.4.A04.1.454.CMB.1.raw
  modified_base (377)..(377): a, c, t, g, unknown or other
  misc_feature (377)..(377): n is a, c, g, or t
  modified_base (453)..(453): a, c, t, g, unknown or other
  misc_feature (453)..(453): n is a, c, g, or t
  modified_base (456)..(456): a, c, t, g, unknown or other
  misc_feature (456)..(456): n is a, c, g, or t
  modified_base (461)..(461): a, c, t, g, unknown or other
  misc_feature (461)..(461): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttcttttaagaggtgtccagtgccaggtgcagctggtggagtcgtgggggaggcgtggcccagccgtggggggtccctggagacctctccgtgtgcacgtcctctggattccaccttttaagtagtccttcttcggattgaacgttcgggtccgccaggtcctccggaggggaacggggcgtgggagtgggtggcctaagttgaagccaagngtagggaagtacgaagaaatactagtgtgactcgtggtaggaggggacagtcactacttcagtagacaacgacaanacnctatntatctgacaagtcgacagtcgagacgaccgagacacggcttgtttacttcgtggtcgcggtccgtggacgtagttaacggaaacgttggaccgggccgaacggggtaccctggtacccg

SEQ ID NO: 230572 - DNA, 599 bp, Homo sapiens
  misc_feature: GYAE6OF02H0ILD.3.4.A04.1.454.CMB.1.raw
  modified_base (258)..(258): a, c, t, g, unknown or other
  misc_feature (258)..(258): n is a, c, g, or t
  modified_base (303)..(303): a, c, t, g, unknown or other
  misc_feature (303)..(303): n is a, c, g, or t
  modified_base (345)..(345): a, c, t, g, unknown or other
  misc_feature (345)..(345): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttcttttaagaggtgtccagtgccaggtgcagctggtggagtcgtgggggagcgtggcccaggccgtgggacggtcccaggactctctgtacngtctctggattcaccttaggtactatgctatgcacgtcgggtccncgggctccgaggcaaggggctgggagtggggtgcaggtttanactcccatgatgggagcaagtaaactccgtacgcagtactccggtagaacgggccgtatcaccatcctaccaagacaactaattaccaaagaaccacggcttagtactactgactaaagtcgaaacacgacctaggaacgacgtcgtaggaacggtaccgcgggacttcggttaggttaacttaccggtggtaacgacgggtaacggtaggacggttaaggtagggttacggggtaccggtaagtttaaccggg

SEQ ID NO: 230573 - DNA, 731 bp, Homo sapiens
  misc_feature: GYAE6OF02IDY28.3.4.A04.1.454.CMB.1.raw
  modified_base (349)..(349): a, c, t, g, unknown or other
  misc_feature (349)..(349): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttctttttaagaggtgtccaggtgccaggtgcagctgggtggagtcggtgggggagcgtgggcccagccgtggggacgtcccaggactctcctgtacagtctctggacttcacgttaggttactatgctagtgctagtcgggtcccggccgggctaccgaggcgaaggggctggggagtggggngcgtagttatactcccgaagtcgagttaggggaggactaaaggttaaaacctcccgtaacggtaccaacggtacccgttaccgggtaggggaacccggggtaccgtaactttacccggaaccctaaccgttccgtaacccgaaaggaacgtaaacctaaacgttaacccgaaaacggtaaaccctaacggtacccgttaagttaccgttaccgtaacggaaacaaaacgttacggaaaacctcggaacccgttaaggaacggaacgtaccgtacgggaacgggaaccgtacggtacgttggtttacgtaacgtttacgtacgggtacgtacggaagaacggtaggttacgggtaaggttacggggtactaaggttaaccggg

SEQ ID NO: 230574 - DNA, 571 bp, Homo sapiens
  misc_feature: GYAE6OF02HE7XW.3.4.A04.1.454.CMB.1.raw
  modified_base (176)..(176): a, c, t, g, unknown or other
  misc_feature (176)..(176): n is a, c, g, or t
  modified_base (257)..(257): a, c, t, g, unknown or other
  misc_feature (257)..(257): n is a, c, g, or t
  modified_base (417)..(417): a, c, t, g, unknown or other
  misc_feature (417)..(417): n is a, c, g, or t
  modified_base (466)..(466): a, c, t, g, unknown or other
  misc_feature (466)..(466): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttcttttaagnggtgtccagtgccaggtgcagctggtggagtcgtgggggaggcgtggcccagcctgggaggtcccaggactctcctgtacngtctctggattcaccttaggttactatgctatgcactgggtcccgccggctccgaggcaaggggctggaggtggggtggcagttatctccatggatgggagcaagtaaactcctacgcaagacgtccgtaggaagggccctatccaccatcctaccaganaccaataccaaagaacacgtactagtactcgtagacaaagtacgaaacncgtacctaggacgtacgcgtaggaacggaccgaacgggctagttacgtaagtttaccgtggtagtacggaagtacgtagtaggacgttggggtacaggttaacgg

SEQ ID NO: 230575 - DNA, 608 bp, Homo sapiens
  misc_feature: GYAE6OF02HI2EY.3.4.A04.1.454.CMB.1.raw
  modified_base (175)..(175): a, c, t, g, unknown or other
  misc_feature (175)..(175): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgctcttttaagnggtgtccagtgccaggtgcagctggtggagtcgtgggggagcgtggcccagcctgggacgtcccaggactctctgtacagtctctggattcaccttaggtactatgctatgcacgtgggtccgccgggctccgaggcaaggggctgggagtgggtggctagttatactccatgatgggagcaagtaactccgtagcagtacctccggtaggaacgggccgtattaccaccatcctacgaacgagaacctaattaccgaaagaaccacgacttaggttactcgtacgaccgtaaatacggaaacctacggtacccgtaggacgtaccggctaggaacgggtaccacggggtcttgggttacgttaacttaccggtggtacggtaccgtaaggtacggtaagtgggtaacgttcggggttacgtaagttaacggg

SEQ ID NO: 230576 - DNA, 593 bp, Homo sapiens
  misc_feature: GYAE6OF02G0KI5.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctggggttttcctcgttgctcttttaagaggtgtcagtgccaggtgcagctggtggagtcgtggggggaggcgtggcccagcctgggaggtcccaggactctcctgtacagtctctggattcaccttaggttactatgctatgcactgggtccgccgggctccgaggcgaaggggctgggaggtgggtggcaggttatactcccatcgatgggaggcagtaaactcctacgcagactccgtggaacgggcgatcaccatctaccagagacaataccaacgaacacgactagtactctgactaaatacgaacacgaccgtagaacgacgtacgtacggaacgggacgtaaccgggacgttgttacggttaacgtttacgttggttaacggtcggaaggtaacggtacgttagggaggttacgggggttaccgtaaggtttaaacgggg

SEQ ID NO: 230577 - DNA, 667 bp, Homo sapiens
  misc_feature: GYAE6OF02JFR1P.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgcttcttttaagaggtgtccagtgccaggtgcagctgggtggagtcgtgggggacgcgtggcccagccgtgggacgtccaggactctcctgtacagtctctggacttcactttaggtactatcgctatcgctacgtgggtccgcgggtctccgaggacgaggggctgggagtggggtgcgtagttactacgtcctagtggacgtagggacgtacctaagtaaacgtcctacgcgaacgtacgtacccgggtaggaaaccggggtcctacttaccgaaccgtacttcccgtaccgaagtaacgtaacgtaaccttaacccgaaacgtaaacgaccggtccgttacgtaacttacgtacgaaccgtaaactaacggtaaccaacggtccctaaggacgacggtcgtaaggaaccgggacgtaccggtacgttaggttacgtagtaaccgtgggtcggaaccggtaagaggttacgtaggtaacggtcgggttacgtaagttaacggg

SEQ ID NO: 230578 - DNA, 608 bp, Homo sapiens
  misc_feature: GYAE6OF02HV459.3.4.A04.1.454.CMB.1.raw
  modified_base (175)..(175): a, c, t, g, unknown or other
  misc_feature (175)..(175): n is a, c, g, or t
  modified_base (193)..(193): a, c, t, g, unknown or other
  misc_feature (193)..(193): n is a, c, g, or t
  modified_base (255)..(255): a, c, t, g, unknown or other
  misc_feature (255)..(255): n is a, c, g, or t
  modified_base (416)..(416): a, c, t, g, unknown or other
  misc_feature (416)..(416): n is a, c, g, or t
  modified_base (430)..(430): a, c, t, g, unknown or other
  misc_feature (430)..(430): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgcttcttttaagnggtgtccagtgccaggtncagctggtggagtcgtgggggagcgtggcccagcctggggagtcccaggactctcctgtacngtctctggattcacctttaggttactatgctatgcacgtcgggccgccgggctccgaggcgaaggggctgggagtgggtggcgagttatactccagtcgagtggagtcaagtaactcctagcagacgtcgagaacgggccattccacactcctaccagaanacaacttaccaaanaaccaacgtctacgtactactagaactaaatcgaaacgtacgaccctaggaacgcgtaccgtagaaaccgggaccgaaccgggtcgttaaggtagttaacgtttacgttacgggtacggtacgggaacggtaaggtaggttaggtaggttacggggttacggtaacgttaaaccgggg

SEQ ID NO: 230579 - DNA, 752 bp, Homo sapiens
  misc_feature: GYAE6OF02H3KVN.3.4.A04.1.454.CMB.1.raw
tcagagacgcactccacgaccggtgctcgatttagagtagtgatcaggggtgatcaggactcctcagttcaccttctcacaatgaggctccctgctcagctccgtgggctgctaatgctcgtgggtcccaggactccgaggtggggatgttgtgatgactcagtcctccactcctcccgtcgcccgtcctaccgttggacacggcccgcctaccactcctctcgcgtacggttactagtaacaacgtccttacgtaatacgagtagtaacgtacggaaaacctccttacgttagtaagttttcggttacagtacgtacggacggccgtaagaccactaccgtaccgtaacggtacctaacctttaaagttttacgtaacggtttacccggtaaacggtcgtcggttaccgggtacccagacgtagtacgttcgaagggtcgacgtagggtcgtacgagcgtagtcgtacttaccgaatacgtaaagaacgtcgaacggcggtagggtacggaggtacgtaagggtaggttaggttaggtttacgggttaacttacggagttaccggtaatcggtaaaccgtaaacggttaaccacggttaccggtaccgtccccgttaccgggtaaccggttcccgggaacggaaacccggggtacgaaacgggttacggaaacgtaacccggtaaacgggttaccggtaggtaccgacgttacggaccctaacggtccttacgtcgttacctgttaccccg

SEQ ID NO: 230580 - DNA, 531 bp, Homo sapiens
  misc_feature: GYAE6OF02FSH5X.3.4.A04.1.454.CMB.1.raw
  modified_base (192)..(192): a, c, t, g, unknown or other
  misc_feature (192)..(192): n is a, c, g, or t
  modified_base (337)..(337): a, c, t, g, unknown or other
  misc_feature (337)..(337): n is a, c, g, or t
  modified_base (394)..(394): a, c, t, g, unknown or other
  misc_feature (394)..(394): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtncagctggtggagtctgggggagcgtggcccagcctgggagtcccaggactctcctgtacagtctctggattcaccttaggttactatgctatgcacgtgggtccgccgggctccgaggcaaggggctgggagtgggtgcagttanatcccatgatggaggcagtaaactcctacgcagctcgtagaacgggccatcacatcncagacacaacttaccaagaacacgcttagtactctgacaaatagaacacgcctagagagctagacgacgacggctaggtgttaacttacgtggtacgacgtaaggagtagtaggagtcggggtacgtagttaacggg

SEQ ID NO: 230581 - DNA, 587 bp, Homo sapiens
  misc_feature: GYAE6OF02GFGWK.3.4.A04.1.454.CMB.1.raw
  modified_base (255)..(255): a, c, t, g, unknown or other
  misc_feature (255)..(255): n is a, c, g, or t
  modified_base (383)..(383): a, c, t, g, unknown or other
  misc_feature (383)..(383): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgcttcttttaagaggtgtccagtgccaggtgcagctggtggagtcgtgggggagcgtggcccagcctgggacgtcccaggactctcctgtacngtctctggattcaccttaggttactatgctatgcactgggtccgccgggctccgaggcgaaggggctgggagtggggtggctagttatatcccagtgatggagcagtaactcctacgcagaccgtcgngaacgggccgtatcaccatcctaccagacgactaacttaccgaaagtaaccgacgtactagtactcgtagacaaagtacgaacacgtaccgtgacgtacgcgtacggaacgggacacgggtcgtaggtacgttaacgttacgtggtacggaccggtaaggtacggtagtacggtaggttcggggttacgaacgtttaaccgggg

SEQ ID NO: 230582 - DNA, 685 bp, Homo sapiens
  misc_feature: GYAE6OF02GXANK.3.4.A04.1.454.CMB.1.raw
  modified_base (261)..(261): a, c, t, g, unknown or other
  misc_feature (261)..(261): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgctcttttaagaggtgtccagtgccaggtgcagctgggtggagtcgtgggggaggcgtggcccaggccgtgggacggtcccaggacctctcctgtacngtctctggacttcacttaggttactatgctatgctacgtcgggcccggccgggctaccggaggacgaagggggtcgtagggaggtggggtcgctaagttatactccagtgagtggaggactaagtaaactccgtaacgcgaacgtaccgtcggtagggaaacgggtccgtacttaccaacctactaccgtaccgaaggtaaaccgtaaacgtaaaccgttaacccgaaaaccgtaaaccggtaacgtaccgtttacgtaacttacgtaacggaactaaacgttaacgaacgacgtaccgtaggaacggacgtacggtacggaaacggtacgacggtcgttacggtacggttaacgttagtcggtagggaacgtaagtaacggtacggttaggtaggtacgggttaacgtaacggttaaacgggg

SEQ ID NO: 230583 - DNA, 648 bp, Homo sapiens
  misc_feature: GYAE6OF02GIWPG.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtggggggaggcggtggccccaggccgtggggacggtcccaggaacctctcctgtacagtctctggattcacttaggttactatgctatgcacgtgggtccgccgggctccaggcgaaggggctgggagtggggtggcagttatacgtcccagtcgagtagggacggactaaggtaactccgtaacgcacggacctccggtagaacggggtcccgtagttccaacccgtactacctaccgaggtaacgaacctaaacttacccgaaacgaaaccaccggtaccttagttaactcgtacgaacaaagtacgaacctagacccgttaggacgagtaccgtaggaacggaccgacgggtcgtaggttacgttaacgttaacggttggtacggtacggaagtaaggtaggtacggtaaggtacggggttacgtaagtttaaccggg

SEQ ID NO: 230584 - DNA, 621 bp, Homo sapiens
  misc_feature: GYAE6OF02H1JWE.3.4.A04.1.454.CMB.1.raw
  modified_base (263)..(263): a, c, t, g, unknown or other
  misc_feature (263)..(263): n is a, c, g, or t
  modified_base (347)..(347): a, c, t, g, unknown or other
  misc_feature (347)..(347): n is a, c, g, or t
  modified_base (356)..(356): a, c, t, g, unknown or other
  misc_feature (356)..(356): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcacatggagtttgggctgagcgttgggttttcctcgttgcttcttttaaggaggtgtccagtgccgaggtgcagcgtgggtggagtcgtgggggagcgtgggcccagtccgtggggacgtcccaggactctctgtacngtctcgtggacttcacgtttaggtactagtcgactatgactacggtcgggtcccgcggctccgaggcgagggctgggagtgggngctagttanactccagtgaagtcgggagtacctaaagtaaactccgtagacacgtaccgtcggtaggaacggccgtatccacactcctacgagaacgaactaactacgaaagaactacgtactgtacgtacacgtaacaatacgaaacctgaccgtaggaatgtaccgtaggaaacgtaccgacggtacgttaggtacgttaacgttacgttacggtagtaaccggagtaacgtaagtaggttaacgggttacgggtacgtaacgttaaacggg

SEQ ID NO: 230585 - DNA, 704 bp, Homo sapiens
  misc_feature: GYAE6OF02H4HE1.3.4.A04.1.454.CMB.1.raw
tcagagacgcactccacgaccggtgctcgatttagagtagtgatcagggggagctctgggagacgagcccagcactggaagtcgccggtgtttccattcggtgatcatcactgaacacagaggactcaccatggagtttgggctgagctgggtttttcctcgttgcttcttttaaggaggtgtccagtgccaggtgcagcgtggtggagtcgtgggggaggcgtggcccagccgtggggacggtcccaggaactctaccgtgtacagttctcgtggaacttcctaaccgtttaaggttactagtgctatgacactcggggtccgccgggctaccgagggccgaaggggctaggggacggttggggtgctaaggtttatacgtacccattaggagtgggaacggctaaacggttaaactccgaacggacaacgaaccgttccgaaggggaacgggtcccgtaatttccaaaccctattccgtacccaaaggaacgaaacttaacttaaacccgaaagtaaaccgaccgtacgttagtaaccttcgagaacctaaaagtcgaaacgtacgccgttaaggaacgactcggaaagaaccgggaacgtccgggtacttacgggttacttaaacggttctacggggtaacgacgggtaaggagtaacgttaagggaaccgggttacgggttaacgaatttaaaccggggg

SEQ ID NO: 230586 - DNA, 821 bp, Homo sapiens
  misc_feature: GYAE6OF02GRKM1.3.4.A04.1.454.CMB.1.raw
  modified_base (813)..(813): a, c, t, g, unknown or other
  misc_feature (813)..(813): n is a, c, g, or t
tcagagacgcactccacgaccggtgctcgatttagagtagtgatcagggggatcaggactcctcagttcaccttctcacaatgaggctccctgctcagctcctggggctgctaatgctctgggtcccaggatccaggtggggatgttgtgatgactcagtcctccacctcctccctcgccccgtcctacccgttggacgacgcccggccctcctatcctcccgttgccgacggttccgtagtaccaaaacggtcccttcggttacggtaaccgggtagtaacgtaacgggaaaacctaacccgtttaacgttaggtaagtttacgggtaacttacgaacggacgaacgggaacggcccgaacgggacccctaaacttacccgtaacccggaaacggtaccccgtaaccttaaacttaccgttaaacggtttaaaccgggttttaacccgttaaacccgggggtaaccggtccgggttaccgggggtacccctaaaggaaccgtaggtaaccttacggaacggccgggtaccgtaacgggttcgggacggtaacggccgttaacgtacgttacttaccgacctaacgtacggtaagtaacgtttacggacgggtaaggggtacgggacggtacgggtaggtaaggttgggtttacgggttagggttttaactttacggtttgtacggtacgtagtcgtaagacgtaacgtaccacgtacgtccgttactaccgtttacggttacggaccgggacggtacgaaggtcgacggaacgtaacaaccgtaaggtcgtggtacacggtacgaccacgtnttaaccgg

SEQ ID NO: 230587 - DNA, 756 bp, Homo sapiens
  misc_feature: GYAE6OF02HT9XQ.3.4.A04.1.454.CMB.1.raw
  modified_base (603)..(603): a, c, t, g, unknown or other
  misc_feature (603)..(603): n is a, c, g, or t
  modified_base (625)..(625): a, c, t, g, unknown or other
  misc_feature (625)..(625): n is a, c, g, or t
  modified_base (631)..(631): a, c, t, g, unknown or other
  misc_feature (631)..(631): n is a, c, g, or t
  modified_base (640)..(640): a, c, t, g, unknown or other
  misc_feature (640)..(640): n is a, c, g, or t
  modified_base (724)..(724): a, c, t, g, unknown or other
  misc_feature (724)..(724): n is a, c, g, or t
tcagagacgcactccacgaccggtgctcgatttagagtagtgatcgaggggagctcgtgggagacgagcccagcactggagtcgccggtgtttccattcggtgatcatcactgaacacagaggactcactagtggtacgtttgggctgacgtcgttcgggttttcctcgttcgtcttacgtttttaaaggaggttcgtccgtaggttcgaccgaggtcgcaggtcgtgggtggaggtcggtgggggacgcggtacggcccgaggtccgtaggggaccgtcccgaaggtaccttccgtaccgtagtaacgcgttcctacgttaggtactttaccgtacgttttaacggttacctagttcgacttagtcgtaccgtaccgggttccgggtccccggcccgggtacctaccgaggtacggaacgggtcgtagggtaggtggggtagtcgtaaggtttaacgaccgtaccgaagtcggaaggtcgggaggtaaactaacggtaaaccgttccgtaacggagtaaccggtaaccggtcggtaagggaaccggtctaactacccgacgtactcccgtaacgaagtaaccgtaactaaccgttacgaaanaacctacggtactacgttaacncgttanaacgttaanacggacgacggtacaggaagtaccgtgaaacgaacgtccgtacgtaggttcgtacgttgtaaccgtggcgaacgtaggtaacgngttacggagggtttcgaacgttaagtaacggg

SEQ ID NO: 230588 - DNA, 577 bp, Homo sapiens
  misc_feature: GYAE6OF02HHTJR.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtgggggagcgtggcccagccgtggggacgtcccaggagctctcctgtacagtctctggattccaccttaggttactatgctatgcacgtgggtccgccgggctccgaggcgaaggggctgggaggtgggtggctagttatactcccgagtgagtggaggcgaagtaaatcctaagcaagaccgtcgtaggaacgggccgtattccaccatcctaccagacgaactaacttaccaaagaacacgtctacgtactctcgactaaatacgaacacgtcctaggacgacgcgtaggacgaccgacggtcgtaggttacggttattacgtggtacggacgtaggacgtagttaggacggttcgggtacgtaacgg

SEQ ID NO: 230589 - DNA, 612 bp, Homo sapiens
  misc_feature: GYAE6OF02JI0XD.3.4.A04.1.454.CMB.1.raw
  modified_base (175)..(175): a, c, t, g, unknown or other
  misc_feature (175)..(175): n is a, c, g, or t
  modified_base (192)..(192): a, c, t, g, unknown or other
  misc_feature (192)..(192): n is a, c, g, or t
  modified_base (260)..(260): a, c, t, g, unknown or other
  misc_feature (260)..(260): n is a, c, g, or t
  modified_base (382)..(382): a, c, t, g, unknown or other
  misc_feature (382)..(382): n is a, c, g, or t
  modified_base (542)..(542): a, c, t, g, unknown or other
  misc_feature (542)..(542): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgcttcttttaagngtgtccagtgccaggtncagctggtggagtcgtgggggaggtcgtggcccaggccgtgggacggtcccaggaactctcctgtacngtctctggtattcaccgtttaggtactatgtctatgctacgtggtccgccggctcgagcgaagggctggagtgggtaggcgtaggttactactccgagtgacgttggacgacaagttaaacncgtaacgactacggtaccttcggtagaaccgggtactaacgtccgaacctacgtaccgtacgaagtaacgtaacaacgttaccaaagaaaccacgtacgtagtactactacggactaaagtacacgtacaccgtgaacgagcgtaggaacgtacacggtntacgtagttaacttagtaggtcgacggtagtaacggtacgttggaacgggtcgttaacgaggttaaacgg

SEQ ID NO: 230590 - DNA, 647 bp, Homo sapiens
  misc_feature: GYAE6OF02GFFTD.3.4.A04.1.454.CMB.1.raw
  modified_base (572)..(572): a, c, t, g, unknown or other
  misc_feature (572)..(572): n is a, c, g, or t
  modified_base (594)..(594): a, c, t, g, unknown or other
  misc_feature (594)..(594): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtggggggagcgtggcccaggccgtggggacggtcccagggaacctcgtccctgtacaggtctcgtggattccaaccgtttaggttactatcgcttaatcgctacgtggggtccgccgggctccgaggcaaggggctgggagtgggtgctaggttatactccgatgacgtgggacggactaaggtaaactcctaacgctaacggtacctccggtaggaaacgggccctaagttccaacccgtatcccgtacaggaacaacctaattacccaaagaaccgtacgtccttaggtactcgtagaacctaaacgcgaaaaccttcgaccgttaggaacgtagtccctagggaacgaacccgaggttacgnggttaagttaaccgttaaccgnggtaaccgcggtaaagacgtaagttacgaggttcggggtacaagttaaacggg

SEQ ID NO: 230591 - DNA, 833 bp, Homo sapiens
  misc_feature: GYAE6OF02GI9WU.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtcgcagtctggtggagtcgtgggggagcgtggcccagccgtgggacgtcccgaggactctccgtgtacagtctctggtattcaccttaggttactatgctatgcacgtgggtccgccgggctccgaggcgaaggggctgggagtggggtcggctagttatactcccagtcgatgggacgtcgtaaggttaaactcccgtaacgcgaagtacccgttaccggtagggtaaacgggcccgtaacgtttcccgaacccgtacgttacccgtacccgtaaacggtaaacggtaaaccctaaaacgtttaaccccgaaaaacggtaaaccgtaaccggggtacccttttaacggttaacccggtttacccgttacgggtaaaacccttaaaaacggttaaccgggtaaaacccgtaaacggtaacccccgttaagggtaaacgggttaaccgggttaccggttaaaccggggaaaccggggtaaccccgggttaaccggggttacccggtttaccggggtttaaagggttttaacggtttaaccccggtttagggttaacgggtaacccggtaaaggttaaaccgggtaaggtttaccgggtaaacggggtttcggggttaacccgttaacggttttaaaaccggggg

SEQ ID NO: 230592 - DNA, 536 bp, Homo sapiens
  misc_feature: GYAE6OF02GYW4D.3.4.A04.1.454.CMB.1.raw
  modified_base (156)..(156): a, c, t, g, unknown or other
  misc_feature (156)..(156): n is a, c, g, or t
  modified_base (343)..(343): a, c, t, g, unknown or other
  misc_feature (343)..(343): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcgtggtttcncgtgctcttttaagaggtgtcagtgccaggtgcagctggtggagtcgtggggggagcggtggcccagccgtggggacggtcccaggactctcctgtacagtctctggattcaccttaggttactatgctatgcacgtgggtccgccgggctccgaggcgaaggggctgggagtggggtggcagttanatcccatgagtgggaggcaagtaaactccgtacgcagactccggtagaacgggccgtattccactatctcagagacaactccaagaacacgctgtactctgacaatagaacacgtcctagagacgcgtaggacgacgacgcgtagtgttattacctggtgcgaggacgagtggagtcgggtagtagttaacgg

SEQ ID NO: 230593 - DNA, 589 bp, Homo sapiens
  misc_feature: GYAE6OF02IC3T2.3.4.A04.1.454.CMB.1.raw
  modified_base (262)..(262): a, c, t, g, unknown or other
  misc_feature (262)..(262): n is a, c, g, or t
  modified_base (353)..(353): a, c, t, g, unknown or other
  misc_feature (353)..(353): n is a, c, g, or t
  modified_base (362)..(362): a, c, t, g, unknown or other
  misc_feature (362)..(362): n is a, c, g, or t
  modified_base (377)..(377): a, c, t, g, unknown or other
  misc_feature (377)..(377): n is a, c, g, or t
  modified_base (418)..(418): a, c, t, g, unknown or other
  misc_feature (418)..(418): n is a, c, g, or t
  modified_base (425)..(425): a, c, t, g, unknown or other
  misc_feature (425)..(425): n is a, c, g, or t
  modified_base (452)..(452): a, c, t, g, unknown or other
  misc_feature (452)..(452): n is a, c, g, or t
  modified_base (528)..(528): a, c, t, g, unknown or other
  misc_feature (528)..(528): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgcttcttttaagaggtgtccagtgccaggtgcagctgggtggagtcgtggggggagcgtggccccaggccgtggggacgtcccgaaggactctcctgacngtctctggattcaccgtttaggttactatgactatgactacgtcggggtcccggccgggtcctccggaggcgaaggggctgggagtggggngctagttanatcccatgatagggngacagtaatcctagcagacctcgaggaacggcatcacatcncagacanaactacaagaacgctctagtatacgtnaactaagtacgaaactcgtccgtagaagacgtacgtaggaacgaccgtaggccttaggttacgttacgttaaccgngggttacgaacggtacgtaggtaaggtaggttaggtacgggtaccgtagtttaaaccgggg

SEQ ID NO: 230594 - DNA, 678 bp, Homo sapiens
  misc_feature: GYAE6OF02I1XWI.3.4.A04.1.454.CMB.1.raw
  modified_base (125)..(125): a, c, t, g, unknown or other
  misc_feature (125)..(125): n is a, c, g, or t
  modified_base (335)..(335): a, c, t, g, unknown or other
  misc_feature (335)..(335): n is a, c, g, or t
tcagagacgcactccacgaccggtgctcgatttagagtagtgatcaggggagctctgggagacgagcccagcactggaagtcgccggtgtttccattcggtgatcatcactgaacacagaggacncaccatggagtttgggctgagctgggttttcctcgttgctcttttaagaggtgtccagtgccaggtgcagctggtggagtcgtgggggagcgtggcccaggcctggggacgtcccaggacctctccgtgtacagtctctggattcaccgtttaggtactatgctatcgcacgttcgggtccgccgggctccgaggcgaaggggctagggngtggggtgctagttatactccatggagtgggagactaagtaaactccgtaacgcaacggtaccgttacgggtaggaacgggtcccgtaagttcccgaccctaacgttccgtaccaggtaaaccgtactaaaccgttaccgaaacgaaccgtaacgtccgttagttacctacgtagtaacctaaagtaccggaaacacgtacccgtagaacggtacgtccgtaggaacggtaaccgacgggtacgttacggtttaggttaaccgtttacgtacgggtacgtaccggtaaggtacgtaggttacgggtacgggttacggggttaccgtaaggtttaaacccgggg

SEQ ID NO: 230595 - DNA, 713 bp, Homo sapiens
  misc_feature: GYAE6OF02JHAT0.3.4.A04.1.454.CMB.1.raw
  modified_base (174)..(174): a, c, t, g, unknown or other
  misc_feature (174)..(174): n is a, c, g, or t
  modified_base (307)..(307): a, c, t, g, unknown or other
  misc_feature (307)..(307): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagnggtgtccagtgccaggtgcagctggtggagtcgtggggggagcgtggcccagcctggggacgtcccaggacctctccgtgtacagtctctggacttccaccttaggttactatgctatgcacgtcggggtccnccgggctccgaggccgaaggggctgggacggtggggtggctagttatactcccgatcggagtgggagcaagtaaacgtcctacgcgacgacgtccgtagggaacgggccgtaattcccgaacctactcccgtaccgaagtacggaacttaacgttacccgaaaaggtaacctaccggtaccttaggttaactccgttaacgaaccgtaaaacgttggaaacccgtacggtacccgttaaggggaaccggtaacggtaccgtaacgggaacgggtaacccgaccggggttactttacggggtaacgtttttaacgtttaaccggttggggtacggttaacccgggtaaaggaggttaacggtcggttaagggtttacccgggtacggttaaaccggtttaaacgggg

SEQ ID NO: 230596 - DNA, 600 bp, Homo sapiens
  misc_feature: GYAE6OF02H7F5G.3.4.A04.1.454.CMB.1.raw
  modified_base (175)..(175): a, c, t, g, unknown or other
  misc_feature (175)..(175): n is a, c, g, or t
  modified_base (257)..(257): a, c, t, g, unknown or other
  misc_feature (257)..(257): n is a, c, g, or t
tcagagacgcactccacgaccggtgctcgatttagagtagtgatcagggagctctgggagacgagcccagcactggaagtcgccggtgtttccattcggtgatcatcactgaacacagaggactcaccatggagtttgggctgagcttgggttttcctcgttgcttcttttaagnggtgtccagtgccaggtgcagctggtggagtcgtgggggagcgtggcccagccgtgggacgtccaggaactctccgtgtacngtctctggacttcacttaggttactagtgtctatgactacgtcgggtcccgccgggtctccgaggtcgaggggctgggagtggggtgacgtagttactacgtccagtgtagtggaggtcaagttaactccgtcgacaggaccgttcggagtaacgggcctattacccaccgtactaccctccgaagtacgaactaacttacgaaacgaactacgtctagtacgtctagacctaaagttacgaaccacgtaccgagacgagccgtagacgacgacggctacggtagtcgttaacgtcggacgtaacgtagacgtagtggtacggtcgggtacgtagttaacggg

SEQ ID NO: 230597 - DNA, 545 bp, Homo sapiens
  misc_feature: GYAE6OF02IKJIA.3.4.A04.1.454.CMB.1.raw
tcagagacgcactccacgaccggtgctcgatttagagtagtgatcagggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtgagtcgtgggggagcgtggcccagcctgggaggtcccaggaactctctgtacagtctctggattcaccttaggttactatgctatgcactgggtccgccgggctccaggcaaggggctgggagtggggtggcaggtttatactcccatgatggaggcaagtaaatcctacgcaagactcgtagacgggccattcaccatcctccagacgacaacttccaagaaccacgctagtactctagacaaatgaaacacgccgtagagacgcgtagaggaccaggctaggtagtacttacgtgttcgacggtaagagaagttggtaagtacgggttcgtaagttaacggg

SEQ ID NO: 230598 - DNA, 647 bp, Homo sapiens
  misc_feature: GYAE6OF02FOG0P.3.4.A04.1.454.CMB.1.raw
  modified_base (373)..(373): a, c, t, g, unknown or other
  misc_feature (373)..(373): n is a, c, g, or t
  modified_base (390)..(390): a, c, t, g, unknown or other
  misc_feature (390)..(390): n is a, c, g, or t
tcagagacgcactccacgaccggtgctcgatttagagtagtgatcagggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtggggggaggcgtggcccaggcctgggacggtcccaggaactctcctgtacagtctctggattcaccttaggttactatgctatgcactgggtccgccggctccgaggcaaggggctgggagtggggtggctaggttatactcccatgagtggaggcagtaaacncctacgcagacctccgnggaacgggccgattcacctatcctaccgaagagaactaaacttaccaaagaaccaccgacttacgtacttctacgtactaaaatacgaaacgacgacccttagggaacgtacggactaggaacgggaaccgtaccgggtacgtagggtttaaggtttaaccgtttaacggtttacgggtacgggtaacggtaacgggtaagtaacggttagggtaagggtttaccgggggttaaccggtaaggtttaaaacccgggg

SEQ ID NO: 230599 - DNA, 663 bp, Homo sapiens
  misc_feature: GYAE6OF02JL8D9.3.4.A04.1.454.CMB.1.raw
  modified_base (254)..(254): a, c, t, g, unknown or other
  misc_feature (254)..(254): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgcttcttttaagaggtgtccagtgccaggtgcagctggtggagtcgtgggggagcgtggcccagcctgggacgtcccaggactctctgtacngtctctggattcaccttaggtactatgctatgctacgtggggtccgccgggtctccgaggcgaaggggtctggaggtgggtggccgtaagttactactacccgagttcggaagttggggagactaaggttaaaactcccgtaacggccgaagtacccgtcggtacggaacgggtcccgtaagtttcccaacctattacccgtacccaaggacgaacctaagttaacccaaaggaaacctacggtaccgttagtaacttcgtagacctaaacgaggaacacgtacccgtagaagtcgtactcgggaacgaccgtaacgggtccttaaggacgttttaacgttacgttgggttacgttacgggaagtaaggtagtacggtaacggtttgggtaccgtaagtttaaccgggg

SEQ ID NO: 230600 - DNA, 583 bp, Homo sapiens
  misc_feature: GYAE6OF02G5XNY.3.4.A04.1.454.CMB.1.raw
  modified_base (429)..(429): a, c, t, g, unknown or other
  misc_feature (429)..(429): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtggggggaggcggtggcccagcctggggaggtcccaggaactctcctgtacagtctctggattcaccttaggtactatgctatgcacgtgggtcccgcggggcctccgaggcgaaggggctgggagtggggtggcagttatatcccatgatgggaggcaaggtaaaactccgtaacgcagactccggtagaacgggccgagttccaccgatcgtccgacganaacaacttaccaaacgaacgacgctagtactctgacaatgaaacagacctgagtacgcgtaggaaggtacgacgggtcgtaggttacggtaactttaacgttggtagtacggtaggaagtaggttagaaggtttaggggtcgtaagttaacggg

SEQ ID NO: 230601 - DNA, 584 bp, Homo sapiens
  misc_feature: GYAE6OF02FPAH2.3.4.A04.1.454.CMB.1.raw
  modified_base (157)..(157): a, c, t, g, unknown or other
  misc_feature (157)..(157): n is a, c, g, or t
  modified_base (193)..(193): a, c, t, g, unknown or other
  misc_feature (193)..(193): n is a, c, g, or t
  modified_base (308)..(308): a, c, t, g, unknown or other
  misc_feature (308)..(308): n is a, c, g, or t
  modified_base (338)..(338): a, c, t, g, unknown or other
  misc_feature (338)..(338): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggactttgggctgagctgggtttccngttgctcttttaagaggtgtccagtcgcccagggtncagctggtggagtcgtgggggagcgtggcccagtccgtggggacggtcccagggaacctcgtcctgtacagtctctggattcaccttaggttactgtgctatgcacgtgggtccncgggctccgaggcgaagggctggagtgggngctagttatcgtccatgatgggacgtcagttaaactccgacgcagtactccggtagaacgggcctattcacctatcctacgagaacgtacctaagttccaaagaacctacgctagtactcgtagacaaatcgaaacacggtcctaaggacgacgccgtagaacggacctacgggactggtacgttaacgttactaggtacgtacgtaagtacgagttcggtaggtacgggttacgtagttaaccgg

SEQ ID NO: 230602 - DNA, 582 bp, Homo sapiens
  misc_feature: GYAE6OF02FWQ8L.3.4.A04.1.454.CMB.1.raw
  modified_base (256)..(256): a, c, t, g, unknown or other
  misc_feature (256)..(256): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttcttttaagaggtgtccagtgccaggtgcagctggtggagtcgtgggggagcgtggcccagcctgggacgtcccaggactctcctgtacngtctctggattcaccttaggttactatgctatgctacgtgggtcccgccgggctccgaggcgaaggggctgggaggtgggtggctagttatactccagtgagtgggagacaagtaaactcctacgcagcctacgtaggaacggcgtactacacctactcctacagaacgaactaacttacccaaagtaaccacgtcttagtactcgtacgaactaaatagaaaccgacgtaccgtagaagacgacgtaggacggaacaccggacttaggtagttaacttacgtggtacgacggtagagtagtaggagttcgggtactagttaacgg

SEQ ID NO: 230603 - DNA, 784 bp, Homo sapiens
  misc_feature: GYAE6OF02JUM8W.3.4.A04.1.454.CMB.1.raw
  modified_base (192)..(192): a, c, t, g, unknown or other
  misc_feature (192)..(192): n is a, c, g, or t
  modified_base (653)..(653): a, c, t, g, unknown or other
  misc_feature (653)..(653): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtncaggctggtggagtcgtgggggagcgtggcccagcctggggacgtccaggactctcgtgtacagtctcgtggattcgtaaccgtttaggttactattcgtaccttatcgtacctacgttcggggttcccgcccggggtcttaccggaggtccgtaagggggctcgggaggtggggtacggcgtaaggtttactacgtcccgagtacgtaggtcgggaggtaccaagttaaaaccgtcccgtaaggaccgtaacggaacccgttcccgggtaagggaaaccgggtcccgtaacgttacccgtaacctacgtaccccgttaacgtaaccggaaacgtaaaccgtaaactttaacccggaaaacgtaacccgtaacggttaccgttacgtaacttacggtaaccggtaacctaaaaggttaccgtaaacccgagttaaccccgtaagggtaaccgggtaaaacnccggttaaagggaaccggaacccgtaaccgggtccggttttacggtacgtttaaaccgtaaccgtttcggtaacggtaccgtaagacgttaggtaccgggtaaggtccggggttaccaaacggtttaacgg

SEQ ID NO: 230604 - DNA, 793 bp, Homo sapiens
  misc_feature: GYAE6OF02HAE9P.3.4.A04.1.454.CMB.1.raw
  modified_base (377)..(377): a, c, t, g, unknown or other
  misc_feature (377)..(377): n is a, c, g, or t
tcagagacgcactccacgaccggtgctcgatttagagtagtgatcaggggagctctgggagacgagcccagcactggaagtcgcggtgtttccattcggtgatcatcactgaacacagaggactcaccatggagtttgggctgagcgttgggttttcctcgttgcttcttttaagaggttgtccgagtgccgaggtgcagctggtggagtcgtgggggaggcgtggcccagccgtggggacggtccaggactcgtcctgtacagtctctggtacttctaccttaggttactatgcttagtgcctacggtcgggtccgcccgggctccgaggaccggaacggggtctggggacgggttggggcggacgtaggtttaanacgtcccgtaagtggtaaagtggggtaacggacggtaaactttaaaaacggtcccttaaggtaaccgaccgtaacggtttacccggtagggggtaaacgggggacccgttaacgttaccgtaaacccgtaccttccgttaaccccgtaagaaccggtaacctaaacggttaacccaaaagaaccgaaaccgtacgtttaacgtaactttaccggtactaacccggtaaaattaacccgggaaactaccgggtaacccttaagggaaccggaaggtacccggtaaggtaaccggaaccgggttacccggacggttttacggttacgttaaacggtttacccgtagggttacggacgttaacggaaggttacggtaaggttacggtacgggggttaacccgtaaggtttaaaccgggg

SEQ ID NO: 230605 - DNA, 559 bp, Homo sapiens
  misc_feature: GYAE6OF02H7PL7.3.4.A04.1.454.CMB.1.raw
  modified_base (174)..(174): a, c, t, g, unknown or other
  misc_feature (174)..(174): n is a, c, g, or t
  modified_base (358)..(358): a, c, t, g, unknown or other
  misc_feature (358)..(358): n is a, c, g, or t
  modified_base (384)..(384): a, c, t, g, unknown or other
  misc_feature (384)..(384): n is a, c, g, or t
  modified_base (464)..(464): a, c, t, g, unknown or other
  misc_feature (464)..(464): n is a, c, g, or t
  modified_base (528)..(528): a, c, t, g, unknown or other
  misc_feature (528)..(528): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagnggtgtccagtgccaggtgcagcgtgggtggagtcgtggggggagcgtgggcccaggccgtggggacggtcccagggaacctctcctgtacagtctctggattcaccttggttacctatcgctatgcacgtgggtcccgcgggtctccaggtcaacggggctgggaggtggggtgactaggttanatcccagtcgatgggagcaagtaacncctcgcaacgctccggtaggacgggtccgagtcaccactctacagtagactaacttaccaacgaacaccgatacgatacnctacgaatagaacagcctagagagctaggagtacgacgcgtgtagtaacttcgtagtcgtacgnggtagactgacgggtggtacgtagttaacgg

SEQ ID NO: 230606 - DNA, 727 bp, Homo sapiens
  misc_feature: GYAE6OF02HNJ59.3.4.A04.1.454.CMB.1.raw
  modified_base (158)..(158): a, c, t, g, unknown or other
  misc_feature (158)..(158): n is a, c, g, or t
  modified_base (175)..(175): a, c, t, g, unknown or other
  misc_feature (175)..(175): n is a, c, g, or t
  modified_base (255)..(255): a, c, t, g, unknown or other
  misc_feature (255)..(255): n is a, c, g, or t
tcagagacgcactccacgaccggtgctcgatttagagtagtgatcaggggagcctctgggagacgagcccagcactggaagtcgccggtgtttccattcggtgatcatcactgaacacagaggactcaccatggagtttggctgagctgggttttccncgttgcttcttttaagnggtgtccagtgccaggtgcagctggtgagtcgtgggggagcgtggcccagcctgggacgtcccaggtaactctctgtacngtctctggattcacttagtactatgctatgctacgtgggtccgccggctccgaggcaaggggctgggacgtgggcggctaggttatacgtccccgagtcggagttacgggacggtctaaacggttaaaacgtccctaacggtacctaacggtaaacccgttccccggtaaggtaaccgggggtacccgtaacgtttaacccgacccgtaaacgttacccgtaacccgtaacggtaaccgggtaaaccttaaaccgtttaacccgaaaacggaaacccgtaaccggttaccgtacgttaacgtcgttacggtaacctaaaacgttacggaaaccgtacggtaacccgtaggtaacgtacggtaccttaacgggacggtaacgtaccggtcgtacgggtttacggttaacttacggtggttacggtacggtaagtaaggtagtacggtacggtgggtacgtagttaaaccgggg

SEQ ID NO: 230607 - DNA, 662 bp, Homo sapiens
  misc_feature: GYAE6OF02FVFZJ.3.4.A04.1.454.CMB.1.raw
  modified_base (226)..(226): a, c, t, g, unknown or other
  misc_feature (226)..(226): n is a, c, g, or t
  modified_base (247)..(247): a, c, t, g, unknown or other
  misc_feature (247)..(247): n is a, c, g, or t
  modified_base (395)..(395): a, c, t, g, unknown or other
  misc_feature (395)..(395): n is a, c, g, or t
  modified_base (580)..(580): a, c, t, g, unknown or other
  misc_feature (580)..(580): n is a, c, g, or t
tcagagacgcactccacgaccggtgctcgatttagagtagtgatcagggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtgggggaggcgtggcccngccgtgggagtccaggactcncctgtacagtctctggtattctaccttaggttactatcgtctatcgctacgtcggggtcccgccgggcctccgaggcgaaggggcgtgggaggtggggtggctaggttatactccatgagtggacggcgtaagtaaactccgtaacgnaacggtacctccggtacgggaacgggtcccgtaattacccgaccgtactcccgtaccgaacgtaacgaacctaacgttacccaaaggaaacctaccggacttacgttactcgtaacgacctaaagttaacgaaactacgtaccgtaaggacggaagtccgtagggaacggaccgaagggttccgngtttacggtgtttaaccggttggtaccggacggtaaggtacgtaacggttaggtagggtcgggtaaccgtaggttaaacggg

SEQ ID NO: 230608 - DNA, 520 bp, Homo sapiens
  misc_feature: GYAE6OF02FO77Q.3.4.A04.1.454.CMB.1.raw
tcagagacgcactccacgaccggtgctcgatttagagtagtgatcagggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtctgggggaggcgtggcccagcctgggaggtcccaggaactctcctgtacagtctctggattcaccttaggttactatgctatgcactgggtccgccgggctccaggcgaaggggctgggagtggggtggcagttatatcccatgatggaggcagtaaatcctaacgcagactccgtgaacgggccgattcaccatctccagagacaattccaagaacacgctgtatctgacaaatgaacagcctgagagcgtagacggacacggctaggtagtattactgtcgacgagacgataggagtaggtcgtattaacgg

SEQ ID NO: 230609 - DNA, 695 bp, Homo sapiens
  misc_feature: GYAE6OF02HVGRM.3.4.A04.1.454.CMB.1.raw
  modified_base (175)..(175): a, c, t, g, unknown or other
  misc_feature (175)..(175): n is a, c, g, or t
  modified_base (265)..(265): a, c, t, g, unknown or other
  misc_feature (265)..(265): n is a, c, g, or t
  modified_base (298)..(298): a, c, t, g, unknown or other
  misc_feature (298)..(298): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgcttcttttaagnggtgtccagtgccaggtgcagcgtgggtggagtcgtggggggaggcggtggccccagccgtggggacgtcccgaaggactctcctgtacngtctctggattcacttaggtactatgctatgcncgtgggtccgccgggtctccgaggcgaagggagtgggaggtgggggtggctagttatactacccgtagtcgagtgggacgcgtaaacgtaaaactccgtaacgccgaagtaccgttacccgtagggtaacgggcccgtaacttccaacctactcttacccgagtaaacgaacctaaacgtttacccgaaaacgtaaaccgtacgtaccgttacggttactacgtacggtaacaaaacgttgaaaaccagtacccgtaaggacgaaagtcgtacggaacgggaaccgtacgggtcttagggttaacgtttacgtttaacggttcgggtggtaaccgggtaaggaacggtacggttagggaaggtttacgggggttaacgtaacgtttaaacccggggg

SEQ ID NO: 230610 - DNA, 782 bp, Homo sapiens
  misc_feature: GYAE6OF02I5K8P.3.4.A04.1.454.CMB.1.raw
  modified_base (530)..(530): a, c, t, g, unknown or other
  misc_feature (530)..(530): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttcttttaagaggtgtcagtgccaggtgcagctgggtggagtcgtgggggagcggtcggcccaggtccgtggggacgtcccgaggtacctctaccgtgtactggtcctcgtggtacttaccgtaccgtttaggttacctagtggtaccttagtcgctacgtcggggtcccggccggtcctaccgaggaccgaagggtcgtacggtagggtgggtgacgtagtatacgtccgagtgacgtggagacgtaaacttacgccgtaaggcctaacggtaccgtccggaagacgggtacctacttaccgactcgtccgtacgaggtacaactaacgtaccaaacggacttacgacttagacgttaccgtanaacggtaaactcggtaaaccgtacgtacccgtaaggtaaccgggtaccgtacgggtaaacggtaacccggttaacccggtacgggtaccgttttacgggtttaaaccggggtttaaccttaaccggggtttaccgggtaacggggtaaaccccggttaaagggtaacccgggttaaacgggtttaccggggttaaagggggtttaaccccccggggtttaaaaggtaaccggtttttaaaaaccccgggggg

SEQ ID NO: 230611 - DNA, 862 bp, Homo sapiens
  misc_feature: GYAE6OF02HZUL7.3.4.A04.1.454.CMB.1.raw
tcagagacgcactccacgaccggtgctcgatttagagtagtgatcagggggatcaggactcctcagttcaccttctcacaatgaggcctccctgctcagctccgtggggctgctaatcgctctgggtcccaggatccgaggtggggatgttgtgatgactcagtctccactcctcctcgcccgtcacccttgacagccgcctccatctcctgcaggtctagtcaaagcctacgtatacgagtgatacggaaacctacctacgttagtaagttggtttacagtacgaaggacggccgaacggacctaaacgtccgtaaccgaacgggtccgtaaccgtttaaagttttaaacgtttaaacgggttttacccggtaaaacccggggttaccgttaccgggttaccgggggttaccccaaacggtaaccgtaacggtaacgtttacccggacgggtaccggggtacgtacgggttacggggtacgaacgggtaccgtaacggttacgttaactttaccgaaaccgtaacgtaacgtaaaacgtccgaacggacgggtaacgggggtacgggtaacggtacggttaagggtaagggttaaggtttaggggttttaacggggttttaacttaaccggtggaacttaaggtacgggtaaaccgtaaacgggttaccgaaccgtaccggtaccgggtaccccgttaaccgggtaccggttaccgggtaacccggaaaccggggtaaacccggtaagggtaaacggaaaccgttaaaccggaaaaccggtacggttacggtaccggtaccgtaacgtaccgtaccgtaacgttccgttaacggtttcccttaccgtacccgttaccccgg

SEQ ID NO: 230612 - DNA, 589 bp, Homo sapiens
  misc_feature: GYAE6OF02GO5EP.3.4.A04.1.454.CMB.1.raw
  modified_base (258)..(258): a, c, t, g, unknown or other
  misc_feature (258)..(258): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctctttaagaggtgtccagtgccaggtgcagctggtggagtcgtggggggagcgtggcccagccgtggggacggtcccaggaactctcctgtacngtctctggattcacttaggtactatgctatgcacgtgggtccgccgggctccgaggcgaaggggctgggaggtggggtgcaggttatacgtcccagtgatgggaggctaagtaaactccgtagcagcgtccggtaggacggccgtattccgacctatccgtcagacacaattacccgaaagaacacgacttagtactcacgacaaacgtcgaactacgtcccgtagaggtacgacgtaggaacggacgacgggtcgtaggtaggttacgttacgtcggtacgacggtaagtacggtagtcggtaggttacggggttactaggttaaacggg

SEQ ID NO: 230613 - DNA, 620 bp, Homo sapiens
  misc_feature: GYAE6OF02FOTJS.3.4.A04.1.454.CMB.1.raw
  modified_base (257)..(257): a, c, t, g, unknown or other
  misc_feature (257)..(257): n is a, c, g, or t
tcagagacgcactccacgaccggtgctcgatttagagtagtgatcagggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtgggggaggcgtggcccagcctgggacggtcccaggactctcctgtacngtctctggattcaccttaggttactatgctatgcacgtgggtccgccgggctccgaggcgaaggggcgtgggaggtgggtggctaagtatactccatgagtgggagcaaggtaaatcctacgcaggtactccggtaggaacgggcgtattccaacctactcctaccgagaacgtaactaacttaccgaaagaaccacgacttagtaactctaggactaaagtacgaaactacgacgtaggaacggacgtacgtaggaacggaaccgtacggtcgttaggttaggttaacgtttaacggtcggttacgggacggtaaggtaggtaacgtagggtacggttacgggtacggtaacgtttaacggg

SEQ ID NO: 230614 - DNA, 538 bp, Homo sapiens
  misc_feature: GYAE6OF02FZPFH.3.4.A04.1.454.CMB.1.raw
  modified_base (346)..(346): a, c, t, g, unknown or other
  misc_feature (346)..(346): n is a, c, g, or t
tcagagacgcactccacgaccggtgctcgatttagagtagtgatcagggggagctctgggagacgagcccagcactggaagtccgccggtgtttccattcggtgatcatcactgaacacagaggactcaccatgggagtttggggctgagtctgggttttcctcgttgctcttttaagaggtgtccagtgccaggtgcagctggtggagtctggggggagcgtggcccagcctggggagtcccaggactctcctgtacagtctctggattcaccttaggttactatgctatgcactggggtcccgccgggctccgaggcaagggggctgggagtgggtgcagttanatccatgatggagcagtaaatcctacgcagactccgtagaacgggccgattcaccatctaccagagacaacttccaaagaaccacgctagtactctagcaaatgaacacgcctagagagcgtaggacggacacgggctggtagttaatacgtggtgacggaagaggatggacgtgggtacgtagttaacggg

SEQ ID NO: 230615 - DNA, 678 bp, Homo sapiens
  misc_feature: GYAE6OF02FVCL4.3.4.A04.1.454.CMB.1.raw
  modified_base (262)..(262): a, c, t, g, unknown or other
  misc_feature (262)..(262): n is a, c, g, or t
tcagagacgcactccacgaccggtgctcgatttagagtagtgatcagggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtgggggaggcgtggcccagccgtggggacggtcccaggaacctctccgtgtacngtctctggattcaccttaggttactatgctatgcacgtgggtcccggccgggctccgaggcgaagggggctgggaggtggggtggcgtagttatactccatgatgggagacagtaaactccgtacgcagcctccggtagaacgggccgtacgttaccgacctactcctaccgagacgaaccgtaacttacccgaaagtaaccacgacttagtactacgtacgactaaacgtacgaaaccacgtacccgttaggaacggtacgtacggtacggtaacgggaaccgtacggggtaccgttaggttaacggtttaacgtttaaccggtttacgggtacggttaccggggaaggtacgggttaaggttaacgggtaagggtttacgggggttaaccggttaacggttttaaaaccggggg

SEQ ID NO: 230616 - DNA, 649 bp, Homo sapiens
  misc_feature: GYAE6OF02JRQ3X.3.4.A04.1.454.CMB.1.raw
  modified_base (159)..(159): a, c, t, g, unknown or other
  misc_feature (159)..(159): n is a, c, g, or t
  modified_base (177)..(177): a, c, t, g, unknown or other
  misc_feature (177)..(177): n is a, c, g, or t
  modified_base (182)..(182): a, c, t, g, unknown or other
  misc_feature (182)..(182): n is a, c, g, or t
  modified_base (271)..(271): a, c, t, g, unknown or other
  misc_feature (271)..(271): n is a, c, g, or t
  modified_base (414)..(414): a, c, t, g, unknown or other
  misc_feature (414)..(414): n is a, c, g, or t
  modified_base (522)..(522): a, c, t, g, unknown or other
  misc_feature (522)..(522): n is a, c, g, or t
  modified_base (590)..(590): a, c, t, g, unknown or other
  misc_feature (590)..(590): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttccncggttgcttactttaagnggttntccagtgccagggtgcagtcgtggtggagtcggtggggggacgcgtcgcccagccgtggggaacgtcccaggtaccttctccgtgtacngtctcgtggtattccgaaccgtttaggttaactacgtgaccttagtcgactacggttcgggtacccggccgggtcctaccggaagggccgaaagggggtcctaggggtaggttcgggtcgtacgtagtttactactccagtgngtaggctacgtataactccagacgataccggtcggagaccgggactattaccactcgtcgtacgaagtacgaaacctactaccgaaagttaccacgtacgtacgtacncgtaagtagaaaactcggaatcgacgtagaacgatacgacgaacgacgtacgtactggtaaccggttntacgtcggtagaacggtagaacggtcttaggaacggtttcggaactagttaaaccgggg

SEQ ID NO: 230617 - DNA, 601 bp, Homo sapiens
  misc_feature: GYAE6OF02GCO8S.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtcagtgccaggtgcagctggtggagtcgtggggggagcgtggcccagcctggggacgtcccaggactctcctgtacagtctctggattcaccgttaggttactatgctatgcacgtcgggtcccgccgggctccgaggcgaggggctgggaggtggggtgctagttactactcccagtcggagtgggacggacaaggtaaaactcccgtaacggcacgaccgttccggtagggaacgggtcccgtattaccgacctatccaccaagacgaactaacgtacccaaagaaccgtacgtcttacgtatactacgactaacgtagaacctcgccgtagagagctaggacggaacgcggtacgtagtacgttaattcgtaggacgtacggaggagtagtaggaggttacgggtacgtaagttaacggg

SEQ ID NO: 230618 - DNA, 762 bp, Homo sapiens
  misc_feature: GYAE6OF02HJZ3O.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccagtggtagtttgggctggagtcgtttcgggttttcctcggttgtcttacgttttaaggtaggttcgtccgtaggtcgccgtaggtcgcgaggcgtgggtggtaggtcggtgggggacggtcggtcggacccgaggccggttggggacggtcccgaaggtaacctccgtaccgtcgtacgtacggtcttccgtaggtacttaccgtaaccgtttaggttactagtcgcttagtcgacctacggtcgggtccggccgggtctccgaacggcggaagggtcgtagggtacgggtgggtacggacgttaaggttactaccgtccgtagtggtacggtagggaacggtacgtaaacggtaaccgtaccgtacgaccgtaacggtaaccgttccgggtaagggaaccgggtacctacgttaacccgaacgtacctaccgtaaccggaacgaacgtaactaacgtaaccgaaacgaccgtaacgtctagtactgacgaataaacgtcgaacgccgtaccagggactacggacgtagaacggtaccgacggtcgttacggttagttaacttcggtcggtacggtaaccggaagtaccggtagtacgggtacggttacgggttaacgtacggtttaaacggg

SEQ ID NO: 230619 - DNA, 757 bp, Homo sapiens
  misc_feature: GYAE6OF02JOWJF.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttacttttaagaggtgtccagtcgccaggtgcagctggtggagtcgtgggggagcggtggcccaggcctggggacgtcccaaggactctccgtagtaccagtctcgtggattccaccgtttaggttactgtgctatcgctacgtcgggtccggaccgggtcctaccggagggtaccggaacgggggtccgtaggggtacgggttgggggtcgggtaccgttaaagggtttaacttaccggttaccccgaaggttcggtacggtaggggaacggtaaccgtaaaggttaaaaccttccgtaaccggaccgtaacgggtaacccgttaccggtaggggaacccggggtaccgttaacgtttacccgaacccggtaacttccccgtaaccggaacggtaaaccggtaaacctaaccgttaaccgtaaacgaaccgtaccgtacttacgttaacgtctacgaactaaacgtacaaacgtacgtaccgtaaggaacgtacgtacgtacggaacggtacgtacggtacgttaggttacgtaagttaccgtaggtcgacggtaagcggtagtacgtagggtacgtacggtaagttacgg

SEQ ID NO: 230620 - DNA, 614 bp, Homo sapiens
  misc_feature: GYAE6OF02GUU9Q.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcgtgggtttcctcgttgctctttaagaggtgtccagtgccaggtgcagctggtggagtcgtggggggagcgtggcccagccctggggacggtccccaggaacctcgtccgtgtacagtctcgtggattccacctttaggttactatgtctatgctacgttcggggcccgccgggtctccgagggcgaagggggctggggaggtggggtgcgtagttatactccgagtgagtggacggctaagtaactccgtacgcacgacctccggtaggaacgggcctactaccacctactcctaccgagaacgaactaactaccaaagaacctacgactagtactcgtagacaaacgtagaaacgcgtaccgtagagacgtctaggaacggacgacggtagttacggtgttaacgttacgtcggtaggacgtaggaacgtaggtaggtacggtagggtaccgtaaggttaaccggg

SEQ ID NO: 230621 - DNA, 646 bp, Homo sapiens
  misc_feature: GYAE6OF02H8FCW.3.4.A04.1.454.CMB.1.raw
  modified_base (348)..(348): a, c, t, g, unknown or other
  misc_feature (348)..(348): n is a, c, g, or t
  modified_base (503)..(503): a, c, t, g, unknown or other
  misc_feature (503)..(503): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgctcttttaagaggtgtccagtgccagggtgcagcgtgggtggagtcgtgggggagcgtggcccagccgtggggaggtcccaggactctcctgtacacgtctctggattcaccttaggttactatgctatgcacgtgggtccgccgggtctccgaggcaaggggctgggagtgggtgctagttanctccgatgagtgggagcaaggtaaactccgtacgactaacgccgtccggaggaacgggccgtacttccgaaccctaattcctaccgtaaagagaacctaacgttaccaaagaaaccgacgtacttagtacttcgtacgaactaaatcggaaaacncgtaccgtaggaacgtacgcggtacggaacgggaccgtaccgggtcgttacggttagttaacgtttaccgttggtaccggtacgtaagggtacgtaggttagggtaacggtttcggggttaaccggtaagtttaaacccgggg

SEQ ID NO: 230622 - DNA, 699 bp, Homo sapiens
  misc_feature: GYAE6OF02HE4DN.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgcttcttttaagaggtgtccagtgccaggtgcagctggtggagtcgtgggggaggcgtggccccaggccgtggggacggtccccgaggtaaccttcctcccgtgtaccgacgtcctcgttggtacttacctaccgtttaggttactatgtctagtgcacgtcgggtcccggccgggtccgtcccgaggacggaacgggggtccgtaggggaggtggggtcggacgtaggttatactccgagtgagtgggacggactaaggtaactccgtacgacgacgaccgtccggtaggaacgggaccgtacgttacctaccgacgttcctaccgaagacgaacctaactaacccgaaacgaacccgtaaccgtcgttacgttacgtacgtagaaccgtaaactacgaaacgcgtaccgagtaacgacgtacgtaacggacggtaaccgacggtcgttaggtacggtttattaaccggttaggtaccggtaacggtaggtacggtagtacggttacgggttacgggtacgttaagttaaacgggg

SEQ ID NO: 230623 - DNA, 715 bp, Homo sapiens
  misc_feature: GYAE6OF02J0FWP.3.4.A04.1.454.CMB.1.raw
  modified_base (634)..(634): a, c, t, g, unknown or other
  misc_feature (634)..(634): n is a, c, g, or t
  modified_base (685)..(685): a, c, t, g, unknown or other
  misc_feature (685)..(685): n is a, c, g, or t
tcagagacgcactccacgaccggtgctcgatttagagtagtgatcagggagctctggagacgagcccagcactggaagtcgccggtgttccattcggtgatcatcactgaacacagaggactcaccatggagtttggctgagctggtttcctcgttgctctttaagagtgtccagtgccaggtgcagctggtggagtctgggggagcgtggctcgacgccgtaggggacgtccccagggaacctcgtcctaggtacagtcgtcgtgggtacttccgtaacccgtttaggttaccgtaattcgggaccttaaagtgtacctaccggttcggggttaccccgtcccggggtcttcccggaagggaccgaaagggggttcctaggggtagtcgggggtcgtactacggtttaatccgtacccctaaggtcgtaagtcggagggtaacctaaggtaaacgtcccgtaagcctaaacggccgttaccgggtaggaacgggtacccggtatttaccgaaccgacttccgtacccgaagaacgtaactaacgttacccgaaagaaaccgtacgtactcggtaacgtctacggacaaaagttcaaacgacgtccgtaagaacgtacgccgtaaggaaccggntacccggtgttggttacggttaacttacggtcggttaccgacggtaacggngaaacgttcgaagggttcggtactaacggg

SEQ ID NO: 230624 - DNA, 629 bp, Homo sapiens
  misc_feature: GYAE6OF02F3NLJ.3.4.A04.1.454.CMB.1.raw
  modified_base (158)..(158): a, c, t, g, unknown or other
  misc_feature (158)..(158): n is a, c, g, or t
  modified_base (262)..(262): a, c, t, g, unknown or other
  misc_feature (262)..(262): n is a, c, g, or t
  modified_base (438)..(438): a, c, t, g, unknown or other
  misc_feature (438)..(438): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttccncgttgctcttttaagaggtgtccagtgccaggtgcagctggtggagtcgtggggggagcggtggcccagccgtggggacgtcccaggaacctcgtcctgtaccngttctctggattcaccttaggttactatcgctatgcacgtgggtccgccggctccgaggcaaggggcgtgggaggtggggtggcgtagttactactcccagtgagtgggacgactaaggttaaactcccgtaacgcaacgtaccgtacgtaggaacgggccgtacttccaaccgtntaccgtaccaggacgaactaacgtacccaaaggaacctacgacgttacgtacgtactacgacaaatagaacacgtacctagacgagtacgtaggaacgtaccgacgggtacttaggtacgtttaacttacgtggtacggcggtaaggaagttcggttaggtacggttacgggtacgtaaggttaaaccggg

SEQ ID NO: 230625 - DNA, 1065 bp, Homo sapiens
  misc_feature: GYAE6OF02GD3GK.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggacctcaccagtgggtaggtttgggctaggagtcgtttcgggtttttcctcgttagtcctttacgttttaaggaggttcgtccgtagtcgccgaggtcgacgagtcgtgggtggtacggttcgggtggggggacggtccgggttacggccccgaggtcccggttagggggaccggttaccccgaagggtaacccttccgttaccgtagtaaccgtacgttcctacgtacgggtacttaccgtaaccgtttagggtttaacctaagttcgtacttagtcggtacctacggttccgggggtcccggtcccggggtacctacccgggaacgggtccgggtaaacgggggtccgtagggggtacgggttgggggtcggtaccgttaaggtttactaccgtacccgtaagttacggtacgtaggggtaacggtaccgtaaacggttaaaccgttaccccgtaacggaccgtaaaccggttaaccccggttaccgggttaacggggaaaccggggtaccccggtttaacgttaacccgtaaccccgtaacgtttacccccggtaacccggtaaacggtaaaccgttaaaacccgttaaacccgtttaaaccccgaaaaacgggtaaacccccgtaccggtttaaccccgtttaggttaaacccttacccggttaacgttaaacccggtaaaacggtttaaccgggaaaacccgttaccgggtaacccggtaaacggggtaacggttaaacccggggtccgggttaaaaccgggtaaacccggggtaacccgggtaacccggggttaccctttaaggggttttaaccgggttttaaacgtttacccgggttttaacgggaacccggttaggaaacgggttaacggttaacggttagggttaacccgggggttaccggggttaaccgttaaccgttttaaaacccggggggg

SEQ ID NO: 230626 - DNA, 847 bp, Homo sapiens
  misc_feature: GYAE6OF02H084D.3.4.A04.1.454.CMB.1.raw
  modified_base (793)..(793): a, c, t, g, unknown or other
  misc_feature (793)..(793): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgcttcttttaagaggtgtccagtgccaggtgcagctggtggagtcgtgggggagcggtggcccagccgtgggaggtccccgaggactccgtacctgtacagttcctcgtggtacttacctaccgttttagggttaacctagttcggtacttagtcggtccgtaaccggtcggggttacccccggcccgggggtccttacccggaggggtaccggaaaggggggtcccgttaggggtaggtttccggggggtgggtactaacgggttttaattaccgtacccccgtaagtttcgggaacgttcggggaacggtaccgtaaaacggtaaaacgttcccgtaacggaccgtaacggtacccggttacccggtaagggaaaccgggggtccccgttaacgttacccgtaaacccgtaaccgtttacccgtaacccggacggtaaaacgtaaccccgtaaagtttaacccccgaaaaaggttaaaaccccgaacccggttaacgtttaccggttaaaccgtttaccgtaccgtaaaaccgttaaaacgtaaccggaaaccgtacggtacccgtaggaacgtaacggtcggtaacggtaacggaacgtaccgggtcgtaggttacgtacgtttacgnggtacggtaacgaggacgtagtacggtaggtttcgggtacgtaggtttaaccgg

SEQ ID NO: 230627 - DNA, 685 bp, Homo sapiens
  misc_feature: GYAE6OF02GW0RB.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgcttcttttaagaggtgtccagtcgccaggtgcagctgggtggagtcgtgggggagcgtcggcccagccgtggggacgtccaggacctctcctgtacagtctctggacttcgacctttaggttacagtgactatcgctacggtcgggtccggccggctccggagggaccggaaggggtcctggggacggtcggggtacggactaggtttaacacgtacccgagtcgacggttggggaacggtaccgtaaagttaaaccttccctaacggacctacggtaccgtccgggtacgggaaaccgggccgttacgtacccaaaccgtccgtcctaccgaagtaacgtaaactaaccgttaaccaaacgtaaccgacgtacgtacgtaacgtctacgtaacaaagtacgaaaccgtacgacctggaacgcgactacggaccggacgacggtcttaggttacgttaacgttacgtcgggtacgtacggtagtacgtaggtaggtaggtacgggttaacgtagttaacggg

SEQ ID NO: 230628 - DNA, 850 bp, Homo sapiens
  misc_feature: GYAE6OF02GRDZZ.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttcttttaagaggtgtccagtgccaggtgcagtcgtgggtggagtcgtggggggagcggtcggcccaggccgtggggacggtcccgaaggtaacctcctccgtagtacagttctcgtggactttctaaccgttttaaggtttactagttcgacttatcgtacctaacggttccgggggtccccggccccggggtccttaccccggaggggacccggaaaggggggtccgtagggggtacggggttggggggtagggtccgttaaagggttttaataccgttaccccgtaagtagggtaacggttagggggaacggtaccgttaaagggttaaaaccgtcccgttaaaccggacgtaaaccggggtacccttaccggggtaagggaaacccgggggtcccgtaacgtttacccgaacccttacgttaccccgtaccgaaacgtaaccgtaaacttaaaccgttaaccccgaaaacgtaaacccgtaccgtacgtttacgtaacttccgtagtaacctaaacgaacgtaaaccgacgtaccgtggaacgtagtccggtaaggaaccgggtacgaccgggttagttacggttacggtttaacgttaccggttaggtccgggttaacggagggtaacggttagttaacgggtagggtttacgggtaaccggttaacggtttaaacgggg

SEQ ID NO: 230629 - DNA, 578 bp, Homo sapiens
  misc_feature: GYAE6OF02I9XPT.3.4.A04.1.454.CMB.1.raw
  modified_base (553)..(553): a, c, t, g, unknown or other
  misc_feature (553)..(553): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggtttcctcgttgctcttttaagaggtgtccagtgccaggtgcagctggtggagtcgtgggggagcgtggcccagccgtgggacggtcccaggactcgtcctgtacagtctctggattcacctttaggtactatgctatgcacgtggggtcccgccgggctccgagggcaagggggctagggaggtggggtggctaggttatacgtcccagtgagtggacggtcaagtaactccgtaacgacagtacctcggtagaacgggccgtactacaccatcctacgagacgaactaacttaccgaaagaacgacgtactgttactctagacctaaagtacgaaccgagtacctaggaacgagtcgacggaacgacgacggacttggtagttacttacgtgtacgcgagngtagtgaggtcggtatagttaacgg

SEQ ID NO: 230630 - DNA, 674 bp, Homo sapiens
  misc_feature: GYAE6OF02HRYJX.3.4.A04.1.454.CMB.1.raw
  modified_base (265)..(265): a, c, t, g, unknown or other
  misc_feature (265)..(265): n is a, c, g, or t
  modified_base (458)..(458): a, c, t, g, unknown or other
  misc_feature (458)..(458): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcgtggttttccgtcgttgcttcttttaagaggtgtcagtgccaggtgcagcgtggtggagtcgtgggggagcggtggcccagccgtgggacgtcccgaggaacctctcctgacagtctntggacttctaccttagtactatgctatgcacgtcgggtccggccggccgccgaggaccgaagggggtcgtgggagggtgggtcggcgtagtttatactcccgatggagtggaggactaagtaaactccgtacgctacgtaccgtccggtaggaacgggaccgtacttacccaccgtactccgtaaaaaaccgnggaaactaaccgtaaactttaacccaaacggtaaaccgtaaccgtacgttacgttacgttacgtaacgtaaaccaaacttaccgaaaactccggaaccgtagggacgacgtacgtacggaacggaccgtaccggtagttagtacgtttacttaccgttggaacggaacggtagtaaggacgttaggtgggttaacgggttagtaacgtttaaacgg

SEQ ID NO: 230631 - DNA, 674 bp, Homo sapiens
  misc_feature: GYAE6OF02G4ZBT.3.4.A04.1.454.CMB.1.raw
  modified_base (269)..(269): a, c, t, g, unknown or other
  misc_feature (269)..(269): n is a, c, g, or t
tcagagacgcactccacgaccggtgctcgatttagagtagtgatcagggagctctggagacgagcccagcactggaagtcgccggtgtttccattcggtgatcatcactgaacacagaggactcaccatggagtttgggctgagtctgggttttcctcgttgcttcttttaagaggtgtccagtgccaggtgcagtcgtggtggagtcggtgggggagccggtcggcccagccgtggggacggtcccagggaacctcgtcctgtaaccngttcctctggtattcctaccgttaggttactatgtctatgcgtacctggggtcccgcccgggtccgtcccgaacggcggaacggggtccgtggggaacggttggggtgggtccgtaaggttaactacgttacccctaagtgtaggtggaacggtacgtaaacgttaaaactacccgtaacgctaacgtaacctccggtagaacggggtaccgtactacctaccgtactccgtacgacggaaacacgtaactaaccgaaacgaactacgacttagtatccagactaaatacgaacacgcctagacgagcgtagaacggacacggtacgtagttacgttaattacgttacggtacggacgaaagggtacaacgttggtaacggtacgggttacggattaaaccgggg

SEQ ID NO: 230632 - DNA, 692 bp, Homo sapiens
  misc_feature: GYAE6OF02H79H3.3.4.A04.1.454.CMB.1.raw
  modified_base (177)..(177): a, c, t, g, unknown or other
  misc_feature (177)..(177): n is a, c, g, or t
  modified_base (196)..(196): a, c, t, g, unknown or other
  misc_feature (196)..(196): n is a, c, g, or t
  modified_base (663)..(663): a, c, t, g, unknown or other
  misc_feature (663)..(663): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttacttttaagnggtgtccagtgccgaggtncagtcgtgggtggagtcggtgggggacgcgtggcccaggcctggggacgtccgaaggtactccgtctgtacagtctcgtggtacttaccgaccgtttaggttactagtgactagtcgacgacgttccggggtacccgcccggggtctaccggacgggtccgaaacgggggtcttagggggaggttcgggggacgtcgtaagttacgtacctacccgtaagtcggaagtgggacggtactaaagttaaacctccgtacgacgtaacgtacccgtacgggtaacggtaacgggtaccgtacgttaccgaaccctacttaccgtaccgaagtaacgaacgtaacgttaccgaaacgaaccgtacgtactacgtacttacgagtaacgaaagtacgaaacgacgtacgtagaacgtacgacgtaggaacgacgacgtacgttagtacgtattaccgtagtacgacgtaggntaggtggtacgtagggtacgagttaacgg

SEQ ID NO: 230633 - DNA, 704 bp, Homo sapiens
  misc_feature: GYAE6OF02F3IBL.3.4.A04.1.454.CMB.1.raw
  modified_base (198)..(198): a, c, t, g, unknown or other
  misc_feature (198)..(198): n is a, c, g, or t
  modified_base (271)..(271): a, c, t, g, unknown or other
  misc_feature (271)..(271): n is a, c, g, or t
tcagagacgcactccacgaccggtgctcgatttagagtagtgatcagggggagctctgggagacgagcccagcactggaagtcgccggtgtttccattcggtgatcatcactgaacacagagactcaccatggagtttgggctgagcttgggttttcctcgttgcttcttttaaggaggttgtccaggtgccagggtncagctgggtggagtcggtggggggagcgtggcccagccgtggggacgtcccaggaactctcctgtacagtctntggtattcacgtttaggttactagtgtctatcgactacgtcggggcccgccgggtctccggaggcgaaggggtctgggaggtgggtgactagttactacgtaccagtggagtgggagtacgtaagtaaacctccgtaacgcgtaacgtaccgttccggtaagggaaccgggtccgtaacctttaccgaaccctacgttcccgtaaccgaagggaactaaacctaaacgttacccgaaaagtaaccctacgtacgttagtaactcgtacgtaaacctaaacgtagaaaccgtcggtaccttaggaacggtactaccggtaaggaaccggtaaccggtacggttcgttaagggtacgttttaacggtaaccgttggtacggaacggtaaggtaacgtggttaggaacgggttcgggtaacgtagttaaaccgggg

SEQ ID NO: 230634 - DNA, 676 bp, Homo sapiens
  misc_feature: GYAE6OF02HI76A.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggtttttcctcgttgcttacttttaaggaggtgtccaggtgccagggtgcaggcgttgggtggacgttcggtggggggagtcgggtcggccccaggccgtggggacgtaccccgaggaaccttcctcctgtacagtctcgtggacttcgacctttaggttactatgactatgctacgtcgggtccggccgggtctaccgacggacgaggggtctgggacggtggggtcgacgtagttactactacccatggatagggagacgtaagtaactccgtacggacacgtaccgtccggtaggaacgggaccgtacttaccacctacttaccaccgagtacgaaactaacttaccaaagacctaacgtcgtagttactctacgactaaagtacgaacacgacctaggaacgtacgacgtaggaacggacgtaccggtcgttaggttacgtttaacgttcgttaggtacgggacgtaaaggacggttacgtagggtacggtttaacgggtccggttaagtttaaacccgggg

SEQ ID NO: 230635 - DNA, 739 bp, Homo sapiens
  misc_feature: GYAE6OF02G08RN.3.4.A04.1.454.CMB.1.raw
tcagagacgcactccacgaccggtgctcgatttagagtagtgatcagggggagctctgggagacgagcccagcaccggaagtcgccggtgtttccattcggtgatcatcactgaacacagaggactcaccatggagtttgggctgagcttgggttttcctcgttgctcttttaagaggtgtccagtgccaggtgcagctggtggagtcgtgggggagcgtggcccagccgtgggacggtcccaggaactctcctgtacagtctcgtggattcaccttaggttactatgctatgcacgtcgggtccgcccggggctccgagggtcgaacgggggtctaggggaggttggggtacgggctaggtttataaccgtccctagtcggtagtacggggaggcgtaaagttaaaacgtcccgtaacgacgacgtacgttccggtaaggaacggggtaccgacgttaccgaaccctacgtccttacccgaaggtaacgtaaacctaagttaacccgaaacggtaacctaaacggttccttaacgttacgttaccgtaacgtacctaaaacgtacggtaaaccacgggacccttagggaaacggtacgggtacgttacgggaacgtaaaccggacggtacgttacgttacggtttaacgtttacggttcgtacgggtaccggtaagtaggttaggtaacgggtaggttaacggggtttcgtaacggtttaaccggtttaaacgggggg

SEQ ID NO: 230636 - DNA, 603 bp, Homo sapiens
  misc_feature: GYAE6OF02I64SE.3.4.A04.1.454.CMB.1.raw
  modified_base (261)..(261): a, c, t, g, unknown or other
  misc_feature (261)..(261): n is a, c, g, or t
  modified_base (289)..(289): a, c, t, g, unknown or other
  misc_feature (289)..(289): n is a, c, g, or t
  modified_base (383)..(383): a, c, t, g, unknown or other
  misc_feature (383)..(383): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtgggggaggcgtggcccagccgtggggacggtcccagggaacctctcctgtacngtctctggattcaccttggttactatgntatgcacgtgggtccgccgggctccgaggcaaggggctggagtgggtggcagttatactcccatgagtgggacgcgaagtaaatccgacgacanaacctcggtagaacgggtccattaccaactatcctaccaagtaacgaacaacttacccgaaagaaacctacgtaccgtagttaactaccgtacgaactaaatacgaaacctacggaccgtaggaagacgtacgtaggaacggacgaccggtacgtgttagtaactttaacgtggtacgacggtaggtacgtagtacggagttagggtacgagtttaacgg

SEQ ID NO: 230637 - DNA, 727 bp, Homo sapiens
  misc_feature: GYAE6OF02F5681.3.4.A04.1.454.CMB.1.raw
  modified_base (276)..(276): a, c, t, g, unknown or other
  misc_feature (276)..(276): n is a, c, g, or t
tcagagacgcactccacgaccggtgctcgatttagagtagtgatcagggggagctctgggagacgagcccagcactggaagtcgccggtgtttccattcggtgatcatcactgaacacagaggactcaccagtggagtttgggctgagcttgggttttcctcgttgcttacttttaagaggtgtccagtgccaggtgcgagcgtggtggagtcggtgggggagcggtcggcccaggccgtggggacggtcccgaggtaacctccgtccgtgtaccngtctcgtggactttccgtaccgtttaggttactagttcgtactatcgctacgttcggggtcccggcccgggtcctccggacgggacgaagggggtcgtggggagggttggggtcggtacgtaggtttactaacgtaccccgtagttacggaggttaggggaccggtaactaacgttaaaaccgttacccgtacggaccgtaacgtacccgttaccgggtaggaaccggggccgtacgttaccgacctaacgtcctaccgaagacgtaactaaccgttaaccgaacgtaaaccgacgtcgtaacgtctacgtacgtaacaacgtaacgaacgacgtaccgtaaggagtacgacgtaggaacggaccgtaggtacgtgttacgttacgttacgtgggtacgtacggaacggtaagtaggtacggttagggtcgggttacgtacgttaaacggg

SEQ ID NO: 230638 - DNA, 673 bp, Homo sapiens
  misc_feature: GYAE6OF02HUNXX.3.4.A04.1.454.CMB.1.raw
  modified_base (350)..(350): a, c, t, g, unknown or other
  misc_feature (350)..(350): n is a, c, g, or t
  modified_base (616)..(616): a, c, t, g, unknown or other
  misc_feature (616)..(616): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttcttttaagaggtgtccagtgccaggtgcagctgggtggagtcggtgggggagcgtggcccagccgtgggacggtcccaggtacctctcctgtacagtctcgtggtattaccaccgtttagttacttatgctatgcacgttcgggtcccggcgggtctaccggaggacgaacggggcgtagggnggttggggtcgacgtagttacgactcccagtggagtgggagacgtaagtaactccgaacgcgaacgtaccgtaccggtagggaacggtaccgtacttacccgacctactaccgtacgaaagacgtaacctaacttaaccgaaataaccgtacgtagtacttacgttacgtacgtaaacctaaagtaccgtaaaccgtaccgacttaggaacgtacggttagaacggaacggtaccgaccggttatacggttacgtaacgtttacgnggtacggtacggaagtacggtagtaggttaagggtaccggtacggtaagttaaccgg

SEQ ID NO: 230639 - DNA, 666 bp, Homo sapiens
  misc_feature: GYAE6OF02FZ08L.3.4.A04.1.454.CMB.1.raw
  modified_base (175)..(175): a, c, t, g, unknown or other
  misc_feature (175)..(175): n is a, c, g, or t
  modified_base (258)..(258): a, c, t, g, unknown or other
  misc_feature (258)..(258): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgcttcttttaagnggtgtccagtgccaggtgcagctggtggagtcgtgggggagcgtggcccagccgtgggacggtcccaggacctctcctgtacngtctctggattcaccttaggttactatgctatgcacgtcgggtccgccgggctccgacggcgaagggggctgggaggtggggtgggctaggttactactcccatcgagtgggaggtctaagtaaactcctaacgcacgtaccgtccgtagggaacgggcccgtaacttaccaacctactcctaccgaacgacgtaacctaaacgttaccaaacgtaaaccgacgtaccgttagtaactacgtacgaactaaagtacgaaactacgtaccgtacgaagtacgacgtacggaacggtaaccgaccgggttacgttaggtaacggtttaaccgtttacggtaggtacggaacggtaagggtaacggtacgttaggtaaccggtttggggttacgtaaggtttaaaccgggg

SEQ ID NO: 230640 - DNA, 838 bp, Homo sapiens
  misc_feature: GYAE6OF02HEWMS.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcgttggttttcctcgttgcttcttttaagaggtgtccagtgccgaggtgcagcgtgggtggagtcggtgggggaggtcgtcgggccccgaggccgtggggacgtacccgaggtaacctcctccgtgtaacgacgtcttcgtggtacttccgtaaccgtttaggttacctagtgtaccttagtcgtaccgtaaccggttccgggggtacccccggtccccggggtccctacccggaacgggggtaccggtaaacggggggtccgttagggggtacgggttcggggggttacggtaccgttaaggttttaacgtaaccgttccccgaaggttacggaaggtacggggtaacggtaccgtaaaacggttaaaaccgtccgtaaccggacgttaacggaccgttacccgggtaagggaccggggtaccgtaactttccgaacccgtacgttaccctaccggaaacggaacgtaacgtaaaaccgttaacccggaaaacgaaacccgttaaccggtacgttacgttaacgttactaaggaaccgtaaagtaccggtaaacgcgtaccgtaagacggacgtaacgacgggtaaccgaacggtaccgtgttacggtagttaacgttaccgttaggtaacgtaccggaaggtacggttacggtacggtagggtttacgggtaccgtaagtttaaccgggg

SEQ ID NO: 230641 - DNA, 614 bp, Homo sapiens
  misc_feature: GYAE6OF02FM4YN.3.4.A04.1.454.CMB.1.raw
tcagagacgcactccacgaccggtgctcgatttagagtagtgatcaggggagctcgtgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtgggggagcgtggcccagcctgggacgtcccaggactctcctgtacagtctctggattccacttaggttactatgctatgcacgtgggtccgccgggctccgaggcgaaggggctggaggtgggtgctaagttatactccagtgagtgggagactaagtaaactcctacgacacgtacctccggaggaacgggccgtacttcaccactaccgtacaagacgaactaacttaccgaaagaaccgacgtacttagttactacgtcgaacaaacgttacgaacgtacgaccgtagaacgtacgtcgtaaggacgggaccgtacgggtactaggttacgttaacgttacggttcggtacggacgtaaggtagtacggtaggtaacggtcgggttacgtaagttaaccggg

SEQ ID NO: 230642 - DNA, 622 bp, Homo sapiens
  misc_feature: GYAE6OF02G5KY0.3.4.A04.1.454.CMB.1.raw
  modified_base (157)..(157): a, c, t, g, unknown or other
  misc_feature (157)..(157): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcgtggtttccncgttgctctttaagaggtgtccagtgccaggtgcagctggtggagtcgtgggggagcgtggcccagccgtgggacgtcccaggactcgtcctgtacagtctctggtattcaccttaggtactatgctatgcacgtgggtccgccgggctccgaggcgaacggggctgggacgtggggtggctaggttatactcccagttacgagtgggaggacgtaagttaaactccgttagccgtaagaccgtcggtaggaacgggccgtacttaccgacacgtctacgacgagaactaacttaccgaaacgaacgactacgtagtactcgtagacgtaaatacgaacacgtaccgaggagtacggcgtaggaacggtacgtaccggcgttacggtagttaacgttacggtaggtacggtacggtaaagtacggtagtaggtaggtttaccgggtaggttaacggttaaacggg

SEQ ID NO: 230643 - DNA, 601 bp, Homo sapiens
  misc_feature: GYAE6OF02JPDIP.3.4.A04.1.454.CMB.1.raw
  modified_base (274)..(274): a, c, t, g, unknown or other
  misc_feature (274)..(274): n is a, c, g, or t
  modified_base (459)..(459): a, c, t, g, unknown or other
  misc_feature (459)..(459): n is a, c, g, or t
  modified_base (465)..(465): a, c, t, g, unknown or other
  misc_feature (465)..(465): n is a, c, g, or t
  modified_base (476)..(476): a, c, t, g, unknown or other
  misc_feature (476)..(476): n is a, c, g, or t
  modified_base (502)..(502): a, c, t, g, unknown or other
  misc_feature (502)..(502): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggtagtttgggctgagtcttgggttttcctcgttgacttcttttaagaggtgtccgagttgccaggtgcagcgtgggtggtagtcgtgggggagcgtcggcccagccgtggggacggtcccaggaactccgtccgtggtaacngttcgtctggtattcaacgtttagttacctatggctatgactacggttcggggcccgtccgggctaccggaggtacgaacgggggtcttgggaggtcgggtggactagtttatactccgagttgacgtggacggctaagtaactccgtagacgactcgtacgaggaacggtccgagtcactatcncgaganactaactacanaacacgcgtagtactcgtagactaanagaacacgacgtagacgagagtacgagacacggtcttagtacgtagttacgtggacgacggtagacgtaggtagtaggtacggtacgtaaggttaacgg

SEQ ID NO: 230644 - DNA, 679 bp, Homo sapiens
  misc_feature: GYAE6OF02ICDR6.3.4.A04.1.454.CMB.1.raw
  modified_base (79)..(79): a, c, t, g, unknown or other
  misc_feature (79)..(79): n is a, c, g, or t
  modified_base (219)..(219): a, c, t, g, unknown or other
  misc_feature (219)..(219): n is a, c, g, or t
  modified_base (401)..(401): a, c, t, g, unknown or other
  misc_feature (401)..(401): n is a, c, g, or t
  modified_base (481)..(481): a, c, t, g, unknown or other
  misc_feature (481)..(481): n is a, c, g, or t
tcagagacgcactccacgaccggtgctcgatttagagtagtgatcagggggatcaggactcctcagttcaccttctcanaatgaggctccctgctcagctccgtggggctgctaatgctctgggtcccaggatccgaggtggggatgttgtagtatgactcagtcctccacctcctccctcgcccgtccaccgttggacacgccggcctccatcctccngctaggtctagtacaagcctacgtatacgagtcgagtacggtaactaccttacgttaggtaatttggttacagtacaaggtacgccgaggaccctaatcccgacgtaacggtcgtaaccttaagttttagtaccgtttacgaaccgggtactcggtacgggtacccagtaccagtactccgnggtcgagaggtcgtacacggtactctaagtctttaccgactacgtaagtaaacgtgacggtacgtaggggtaggaacggnggttaagaggggtttacgttgggggtttttaacggttacttacggtagtacgtacgtaagggccgtaaagtacccgtacgtacggtcgccccggttaacgtccggtacccggccggtaaacggacgtaaggctaacgaccgtaagtcggtagtacggccttacgaccaacgttctgttccgtactccgacttacccgg

SEQ ID NO: 230645 - DNA, 686 bp, Homo sapiens
  misc_feature: GYAE6OF02JLLSI.3.4.A04.1.454.CMB.1.raw
  modified_base (295)..(295): a, c, t, g, unknown or other
  misc_feature (295)..(295): n is a, c, g, or t
  modified_base (582)..(582): a, c, t, g, unknown or other
  misc_feature (582)..(582): n is a, c, g, or t
tcagagacgcactccacgaccggtgctcgatttagagtagtgatcaggggagctctgggagacgagtccagcactggaagtcgccggtgtttccattcggtgatcatcactgaacacagaggactcaccatggagtttgggctgagctgggttttcctcgttgctcttttaagaggtgtccagtgccaggtgcagcgtggtggagtcgtgggggaggcgtcgggcccagccgtgggacggtcccaggaactctcctgtacagtctcgtcggattcaccttaggttactatgctangcacgtgggtccgccggcgtccgacggcgaaggggctgggaggttggggtggcctaggtttactacgtcccaagtcgtagtgggaggctaacgttaaagtcccgtaacgccgaaggtacctccgggttaggaacgggtcccggaacgttacccacctacgttccctacccgaaacgacgaactaaacgttcccgaaaacgaccgaaccggtacttacggttactctagacaaacgtacgaaccctagccttacggacgtaagcgtacggaacgggacaaccggggtnttaacgggtacgtttaaacgtttacgtgggttaaccggtcgggtaaacggtaggtaacttagggttaacggttcggggtaaccggttaaccgtttaaaccgggg

SEQ ID NO: 230646 - DNA, 723 bp, Homo sapiens
  misc_feature: GYAE6OF02HIEU8.3.4.A04.1.454.CMB.1.raw
  modified_base (144)..(144): a, c, t, g, unknown or other
  misc_feature (144)..(144): n is a, c, g, or t
  modified_base (659)..(659): a, c, t, g, unknown or other
  misc_feature (659)..(659): n is a, c, g, or t
tcagagacgcactccacgaccggtgctcgatttagagtagtgatcagggagctctgggagacgagcccagcactggaagtcgccggtgtttccattcggtgatcatcactgaacacagagactcaccatggagttgggctgagnttgggtttcctcgttgctcttttaagaggtgtccagtcgccaggtgcagctggtaggagtcgtgggggacgcgtcggcccaggccgtgggacggtccgacggtaactctccgtgtaactcgtctcgtggtacttacaccgtttaggttactatcgtctagtacgcgtacgtcggtcccgcccggtctaccgaggacggtaacgggtccgtagggtaggttggggtacgggacttaacgtttaataccgtacccgtaagtacggtaaggcgggaacggacgttaaacggtaaaactcccgtaaacggcttaaggtaaccgttccggtaacgggtaaaccgggtacccgttactaaccgtacccgtaacttcccgtaacagaaacgaactaaaccgttaccgaaacgtaaaccaaccggttactaaggttactacgttacaacgaaacgtaacgaaacacgtcgtaacggtagaaccgtgacgggaaccgaccgtacgaccttggtaacgttttaanaccggttgtaacggtaaccggataaggtacgtagggtagttacggggagttaaacttaacgggg

SEQ ID NO: 230647 - DNA, 692 bp, Homo sapiens
  misc_feature: GYAE6OF02F6NNU.3.4.A04.1.454.CMB.1.raw
  modified_base (177)..(177): a, c, t, g, unknown or other
  misc_feature (177)..(177): n is a, c, g, or t
  modified_base (187)..(187): a, c, t, g, unknown or other
  misc_feature (187)..(187): n is a, c, g, or t
  modified_base (441)..(441): a, c, t, g, unknown or other
  misc_feature (441)..(441): n is a, c, g, or t
  modified_base (474)..(474): a, c, t, g, unknown or other
  misc_feature (474)..(474): n is a, c, g, or t
  modified_base (552)..(552): a, c, t, g, unknown or other
  misc_feature (552)..(552): n is a, c, g, or t
  modified_base (569)..(569): a, c, t, g, unknown or other
  misc_feature (569)..(569): n is a, c, g, or t
tcagagacgcactccacgaccggtgctcgatttagagtagtgatcagggagctctgggagacgagcccagcactggaagtcgccggtgtttccattcggtgatcatcactgaacacagaggactcgaccatggagtttggctgagctggtttctcgttgctatttagagtgtcagtntccgaggtcngagtcgtgggtagacggtggttgggggaacgtcggtcggcccgtaggccgttagggggaccgtccgaaggtaacccgttcgtacccgtagtaacgcggttcccttcgttacggtacttaccgtaaccggttttaacggttacttagtcggtaactagttcgcgtaccgtgggttacccgccgggttctacccggaggtacggaacgggtcgaggtacggtgggtgcgtaagttagtaccgtccgagtagtacgnggtaggtacctaaagtaacggtcctaacgaccncgtaaccggtccgtaggaacgtccggtactaccgactactaccgtcgtagacgtaacgaactacgaaacgtaacaacncgttagctacgcttaanaaacgtacgaactacgcgttaagacgaagcgtaaacggtcgaacgtaccggtatacggttattaaccgttgtacgtcggtaagtagggaattacggagttacggtgggtaccgagttaaacgg

SEQ ID NO: 230648 - DNA, 636 bp, Homo sapiens
  misc_feature: GYAE6OF02F8AIF.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtgggggaggcgtggcccagccgtgggaggtcccaggactctcctgtacagtctcgtggattcaccttaggttactagtgctatgcacgtcgggtccggccgggctccgaggcgaaggggctgggagtggggtggcagttatactcccagtgtacgtgggaggacaagttaaatccgtacgacacgtactccgtaggaacgggtccgtacttccaccgtactcctaccgaggacgtaacctaacttaacccaaacgaaaccaccgtcgttacgtacgtccgtacgtaacctaaacgtacgaaaccgtacggaccgtaggaacgacgtacgtacggttaacggaccgacgggtacgtaggttaggttaacttacggtacggtcggacggtaagtacgtagtaggtaggttcgggtacgtagttaaccgggg

SEQ ID NO: 230649 - DNA, 646 bp, Homo sapiens
  misc_feature: GYAE6OF02HN549.3.4.A04.1.454.CMB.1.raw
  modified_base (263)..(263): a, c, t, g, unknown or other
  misc_feature (263)..(263): n is a, c, g, or t
  modified_base (363)..(363): a, c, t, g, unknown or other
  misc_feature (363)..(363): n is a, c, g, or t
tcagagacgcactccacgaccggtgctcgatttagagtagtgatcagggggagctctgggagacgagcccagcactggaagtcgccggtgtttccattcggtgatcatcactgaacacagaggactcaccatggagtttgggctgagcttgggttttcctcgttgcttcttttaagaggttgtccaggtgccaggtgcgagcgtgggtggagtcgtggggggagcgtggcccagccgtgggacgtcccaggactctctgtacngtctctggacttccaccgtttaggttactagtcgctatcgctacgtcgggtccgccgggtctccgaggcgaaggggctagggaggtggggtgctagttanctccaagtgatgggacgctaagtaaactccgtacgcaacgtaccgtaccggtagggaacgggtccgtagtttacccacctaacgttcctaacccgagtaaacgaactaaacttaccccgaaagtaaccgtaccggtacgttacgttaactaccgtagtaacctaaagtcgaaacgcgccgtaggacgtacgtcggtaggaacggacgtacggtcgttaggttacgttagttaccgtggtacgtacggagacgtaggtgtacggtcggtacgtacgttaacggg

SEQ ID NO: 230650 - DNA, 605 bp, Homo sapiens
  misc_feature: GYAE6OF02GXIHX.3.4.A04.1.454.CMB.1.raw
  modified_base (263)..(263): a, c, t, g, unknown or other
  misc_feature (263)..(263): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttctttttaagaggtgtccagtgccaggtgcagctggtggagtcgtgggggaggcggtggcccagccgtgggacggtcccaggaacctctcctgtacngtctcgtggattcaccttaggttactatgctatgcacgtgggtcccgccggggctccgagggcgaagggggctgggaggtggggtggctagttatactcccatggagtagggaggactaacggttaaactccgtaacgcgaacgaccgttcccggtaggaacgggtccgacttccgacctagtctactacgataactaacttaccaaagaaccacgcttacgtactcgtacgaacgtaaacgtacgaacgacgaccgtagagacgcaggacggacgacggcttaggtagttaattacgttggtagcgaggtacgagtaggtagtcgggtagtagttaacggg

SEQ ID NO: 230651 - DNA, 646 bp, Homo sapiens
  misc_feature: GYAE6OF02I6WIZ.3.4.A04.1.454.CMB.1.raw
  modified_base (175)..(175): a, c, t, g, unknown or other
  misc_feature (175)..(175): n is a, c, g, or t
  modified_base (268)..(268): a, c, t, g, unknown or other
  misc_feature (268)..(268): n is a, c, g, or t
  modified_base (296)..(296): a, c, t, g, unknown or other
  misc_feature (296)..(296): n is a, c, g, or t
  modified_base (341)..(341): a, c, t, g, unknown or other
  misc_feature (341)..(341): n is a, c, g, or t
  modified_base (353)..(353): a, c, t, g, unknown or other
  misc_feature (353)..(353): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttggctgagtcttgggttttcctgttgcttcttttaagnggtgtccagtgccaggtgcagtcgtgggtggtacgtcggtgggggagcgtggcccagccgtggggacgtcccaggaccttctaccgtgtaccngtctcgtggattcaccgtttagtactangtactatgctacgtcgggtccgccggtctccgaggcgaagggtcngggtagtcgggngctagtaatctccaagtgtacgtgggtaacgcgttaaacgtaaacgtccgtaacgcgtacgtaaccgtcgtaggaaccgggtacgtactaccgtactaacgtcgtacgagacgaactacgttaaccaagaacctactcgtatactacgtcaagtaaacgtgaaaccgtcgtaaccagggtaactacgggaccgtagggaaccggtaccgaacggtccttaaggtacgttaacggttactggtccgaacgtagtacgtacggtagttacgggtggttaccgttacgtaaacggg

SEQ ID NO: 230652 - DNA, 638 bp, Homo sapiens
  misc_feature: GYAE6OF02G4K9D.3.4.A04.1.454.CMB.1.raw
  modified_base (262)..(262): a, c, t, g, unknown or other
  misc_feature (262)..(262): n is a, c, g, or t
  modified_base (610)..(610): a, c, t, g, unknown or other
  misc_feature (610)..(610): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcgttgggttttcctcgttgctcttttaagaggtgtccagtgccaggtgcagcgtggtggagtcggtgggggagcggtggcccagccgtggggacgtcccaggacctctcctgtacngtctcgtggacttctaccgttggttactagtgtctatgacacgtcgggtcccggccggtcctccgagggcgaaggggtctgggaggtggggtgacgtagttatacgtcccagtggagtgggagacgtagtaaactccgaacgcaacgtaccgtcggtacggaacgggtccgtagttaccaacctacgttacctacgaacgtaacgaaccgtaacgttaaccgaaacgaaccaccgtactacggttactcgtacgtaacgaaagtacgaactcgactaggacgagtcgtacggaacggacgtacggtgttacggtagttacgttacggtcggtcggaggtagaagtagnggtaggttgggtaccgtaaggttaacgg

SEQ ID NO: 230653 - DNA, 638 bp, Homo sapiens
  misc_feature: GYAE6OF02IJA1O.3.4.A04.1.454.CMB.1.raw
  modified_base (174)..(174): a, c, t, g, unknown or other
  misc_feature (174)..(174): n is a, c, g, or t
  modified_base (256)..(256): a, c, t, g, unknown or other
  misc_feature (256)..(256): n is a, c, g, or t
  modified_base (338)..(338): a, c, t, g, unknown or other
  misc_feature (338)..(338): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagnggtgtccagtgccaggtgcagctggtggagtcgtgggggaggcgtggcccagccgtgggaggtcccaggactcctctgtacngtctcgtggtattcaccgttaggttactatgctatgcacgtgggtcccgccgggctccgaggcaaggggctgggaggtgggnggctagttagtactccgatgagtgggagctaagtaactccagcgagtaccgtcggtaggaacggtccgtattcgaccatccgtacagtacgaactaacttaccaaacgtaaccacggtacttacgttacttcgtacgaactaaaagttacgaaaccgtacgtaccgtaggaagtacgtacgtagggaaacggaccgtaccgggtacgttaggtttacgtaacgtttaacggtcggtacggtacggaacggtacgtaagttacggtaacgggttcggggttaccgtaaggtttaaaccggg

SEQ ID NO: 230654 - DNA, 714 bp, Homo sapiens
  misc_feature: GYAE6OF02G9TE8.3.4.A04.1.454.CMB.1.raw
  modified_base (395)..(395): a, c, t, g, unknown or other
  misc_feature (395)..(395): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcggttgcttcttttaagaggtcgtccagtgccgaggtgcagcgtgggtggagtcgtggggggaggtcggtcgggccccaggcccgtgggggacgggtccccaagggtaacctccgtacctaggtaccacggttcctccgtggactttcctaaccgtttaggttactagtgtctatcgctacgtcggggtcccgccggtcctccgaggcgaggggctgggagtgggtggctagttanacgtccagtcgagtggacggactaaggtaactccgtaacgctaacggtaccgtcggtaaggaaccggggtacctacgtttccaacctacgttccctaaccgtaagaacgaaccgtaaaccttacgaaaccgaaaccacggttaccagttacctacgtagaaccgtaaaagtacggaaaccgtacggtaccctagggaaccgaggtaccgtagggaacggaccgaacggtcgtacgggttctaaacgtttacggtcggtaagggaccgtaggtacgtaacgtgggtaaccggttacgggtaccgtaaaggtttaaccggg

SEQ ID NO: 230655 - DNA, 626 bp, Homo sapiens
  misc_feature: GYAE6OF02GGHXK.3.4.A04.1.454.CMB.1.raw
  modified_base (176)..(176): a, c, t, g, unknown or other
  misc_feature (176)..(176): n is a, c, g, or t
  modified_base (259)..(259): a, c, t, g, unknown or other
  misc_feature (259)..(259): n is a, c, g, or t
  modified_base (264)..(264): a, c, t, g, unknown or other
  misc_feature (264)..(264): n is a, c, g, or t
  modified_base (433)..(433): a, c, t, g, unknown or other
  misc_feature (433)..(433): n is a, c, g, or t
tcagagacgcactccacgaccggtgctcgatttagagtagtgatcagggggagctctgggagacgagcccagcactggaagtcgccggtgtttccattcggtgatcatcactgaacacagaggactcaccatggagtttgggctgagctgggttttcctcgttgcttcttttaagnggtgtccagtgccaggtgcagcgtggtggagtcgtgggggagcgtggcccagccgtgggacgtcccaggacctctcctgtacngtctntggattcactttaggttactatgctatcgctacgtgggtcccgccggtctccgaggcgagggctggagtgggtgctagtatactccatgagtggagctaagtaactcctagcacgtacgtcgaggaacggcctatcacatctacgagacgaactactacgaagacacgnttagtactcgtacgaacaaagtacgaactcgtaccgtaggaacgtagaccggttaggaaaccggtaccgtacggtccggtttaggtaccggtttaaacgtttaccgtaggggttacccggtaacggaacggttaaggtaacggttacgggtaaggggtttaccgggtaagttaaaccggtttaaaaccggggg

SEQ ID NO: 230656 - DNA, 723 bp, Homo sapiens
  misc_feature: GYAE6OF02GZ0RA.3.4.A04.1.454.CMB.1.raw
  modified_base (168)..(168): a, c, t, g, unknown or other
  misc_feature (168)..(168): n is a, c, g, or t
  modified_base (176)..(176): a, c, t, g, unknown or other
  misc_feature (176)..(176): n is a, c, g, or t
  modified_base (334)..(334): a, c, t, g, unknown or other
  misc_feature (334)..(334): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttnttttaagnggtcgtaccagtgccgaggtgcagctgggtggagtcggtgggggacgcggtcggcccagccgtggggacgtcccgacggaactctcctgtacagtctcgtggtattcctaccgttagttactatcgtctatgcacggttcgggtccggccgggtaccnccgacgggacgaaggggcgtgggaggtggggtggtcgtaacgttatacaccgtagtagtaacgtggggaacgacgtaagtaaaacgttcccgaacgccgaacgtaccgttaccgggaagggtaacgggaccgtaacgtacctacctaacctcctaccgaaaggtacgaaccgtaaacgtaaccgaacgaaccggtaccgtaactacggttacctacgtacgaacgtaaacgtaacgtaaccgacgtcggtaacgacggtaactcgggtaaggaacggtaaccggcggttacggttacggttagtttaacggtttcggtagggtaccggtaggggtaatacgggttaggtacgggtaggttaacgggttacggtaaacgtttaacggggg

SEQ ID NO: 230657 - DNA, 673 bp, Homo sapiens
  misc_feature: GYAE6OF02IMXDS.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttacttttaagaggtgtccagtgccaggtgcagctggtgagtcgtgggggagcgtcggccagccgtgggacggtcccaggaactctctgtacagtctcgtggtacttctaccgttagttactagtgactatgactacgtcgggtcccgccgggtctccggaggaccgaagggggtcgtagggacggtgggtgacgtagttatacgtccagtgagtggagacaaagttaacctcgtaacgcgtaaacgtacgtaccggtagggaaccggtaccgtacttaccgaacgtactccacaagactaacgtaactaacgaaacgtacgacgtcttacgtacgtacacgtaactaaacgtacgaaacgtcgtacgtagaacggataccggtaacgggaaccgtaccgtaccgggtacgttaacggttacggttaacttaccgggtgtaacgggaacgtaaggtacggttaacggtaggtaacggtttaccggtaacggttaaacgttaaaccggg

SEQ ID NO: 230658 - DNA, 700 bp, Homo sapiens
  misc_feature: GYAE6OF02JZVTG.3.4.A04.1.454.CMB.1.raw
  modified_base (277)..(277): a, c, t, g, unknown or other
  misc_feature (277)..(277): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtcgcagctgggtggacgtcgtgggggagcggtcggcccgagcccgtggggacggtcccaggaacctctccgtgtacagtctcgtggnttcaccttaggttactagtgctagtgtactacgtcggggtccgtcccggcctaccgacggccgaaaggggcgtacgggaggtggggtggtacgtaggtttaactaccgtcccgtaagttcggaagtcgggaggcgtaaaggttaaactaccggtacgacacggtacgtccggtaggaaccgggtcgtaccttaccgacctactccgtaccgagaacgaactacttaaccgaaacgaacctacgtaccgttacgtaactcgtagaaacctaacgtaacgaaaccgtagaacccgtaggtaacgtaccggtcgttacgggaacgtaacccgggaccgggttcttacggttaagtttacggttaacgtcggtacggtacgtaacggagttagtacggtggtttaacgggtacgtaaggtttaacgg

SEQ ID NO: 230659 - DNA, 632 bp, Homo sapiens
  misc_feature: GYAE6OF02HRCLQ.3.4.A04.1.454.CMB.1.raw
  modified_base (289)..(289): a, c, t, g, unknown or other
  misc_feature (289)..(289): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttcttttaagaggtgtccagtgccaggtgcagctgggtggagtcgtgggggaggcgtggcccagccgtggggacggtcccaggactctcctgtacagtctctggattcaccttaggttactatnctatgcacgtcgggtcccgccgggcctccgagggcaagggggctgggaggtggggtggcaggttatacgtcccatgagtggaggactaagtaaactccgtaacgccgaagacctacccggtaggaaccggggtccgagttacccaccgtaactcctaccgaggacgaaactaacttacccaaacgaacaaccggtactagttactacgtcgactaaatacgaaacgtacgaccgtaggacgacgtcgtaggaacggtaccgacggtacgttgttacggttaactttacgtacggtagacggtacgaaggtagtaggtaggtacgggtacgtaagttaaacggg

SEQ ID NO: 230660 - DNA, 597 bp, Homo sapiens
  misc_feature: GYAE6OF02FQ2VT.3.4.A04.1.454.CMB.1.raw
  modified_base (255)..(255): a, c, t, g, unknown or other
  misc_feature (255)..(255): n is a, c, g, or t
  modified_base (343)..(343): a, c, t, g, unknown or other
  misc_feature (343)..(343): n is a, c, g, or t
  modified_base (459)..(459): a, c, t, g, unknown or other
  misc_feature (459)..(459): n is a, c, g, or t
  modified_base (466)..(466): a, c, t, g, unknown or other
  misc_feature (466)..(466): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtgggggagcgtggcccagccgtggggacgtccaggactctcctgtacngtctctggattcaccttaggttactatgctatgcacgtgggtccgccggctccgaggcaaggggctgggaggtggggtgcgtagttanactcccatgatgggagtcaagtaaactccgtacgctacgactccggtgaacgggcctattcacactcacacgagactaattccaagaactacgactacgttactcgtagactaaanacgaacncgaccgtgacgagtcgtaggaacggtaccgacgggtacgttacggtaggttaacttacggtcgggttaacggtacgggtaagtaaggtacgttagggtacggttacggggttacctaggtttaaacccggg

SEQ ID NO: 230661 - DNA, 555 bp, Homo sapiens
  misc_feature: GYAE6OF02FLJEW.3.4.A04.1.454.CMB.1.raw
  modified_base (257)..(257): a, c, t, g, unknown or other
  misc_feature (257)..(257): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtgagtcgtgggggagcggtggcccagcctggggacggtcccaggaactctcctgtacngtctctggattcaccttaggttactatgctatgcacgtggggtccgccgggctccgaggcgaaggggctgggaggtggggtggcgtagttatactcccatgagtgggagcagtaaatcctacgcagaccgtccggtaggacgggccgtacttcaccatctccagacgactaacttaccaacgaaccacgcttgtactctagacaaagtcgaacacgaccgtagagacgcgtaggacggacgacggtctggttagttaattcgttggtgacgagagagtggagtgggtactagtaacgg

SEQ ID NO: 230662 - DNA, 651 bp, Homo sapiens
  misc_feature: GYAE6OF02FWLRS.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttccctgttgcttcttttaagaggtgtccagtgccaggtgcagtctgggtggagtcggtgggggagcgtggcccaggccgtgggacgtcccaggacctctcctgtacagtcctctggtattccacctttaggttactatgctatgctacgtgggtcccgccgggctccgaggcgaaggggctgggagtggggtgcgtaagttatacgtcctagtgagtgggacggactaaggtaaactccgtaacgccaagtaccgttccggaggaacggggcctattaccaccgtatcctaccgagaacgactaaacgttacccaaagtaaccgaccgtcgttagtacttccgtagacaaagttacgaaacacgtaccgtaggtacgtagtactaggaaggacccgacggtacgttggtacggtttaacttaacggttcggtcggaacggtaaggtacggtacggttaggtaacggttcgggggtaacctaacggtttaaacgggg

SEQ ID NO: 230663 - DNA, 643 bp, Homo sapiens
  misc_feature: GYAE6OF02IKMJZ.3.4.A04.1.454.CMB.1.raw
  modified_base (160)..(160): a, c, t, g, unknown or other
  misc_feature (160)..(160): n is a, c, g, or t
  modified_base (165)..(165): a, c, t, g, unknown or other
  misc_feature (165)..(165): n is a, c, g, or t
  modified_base (169)..(169): a, c, t, g, unknown or other
  misc_feature (169)..(169): n is a, c, g, or t
  modified_base (177)..(177): a, c, t, g, unknown or other
  misc_feature (177)..(177): n is a, c, g, or t
  modified_base (181)..(181): a, c, t, g, unknown or other
  misc_feature (181)..(181): n is a, c, g, or t
  modified_base (259)..(259): a, c, t, g, unknown or other
  misc_feature (259)..(259): n is a, c, g, or t
  modified_base (369)..(369): a, c, t, g, unknown or other
  misc_feature (369)..(369): n is a, c, g, or t
tcagagacgcactccacgaccggtgctcgatttagagtagtgatcaggggagctctgggagacaagcccagcactggaagtcgccggtgtttccattcggtgatcatcactgaacacagaggactcaccatggagtttgggctgagtcttgggttttccncgttncttnttttaagnggtntccagtgccaggtgcagcgtggtggagtcgtgggggagcgtgggcccagccgtgggacgtcccaggactctctgtacngtctcgtggacttcaccgtttaggttactagtcggtacttagtcgaccgtacgtccggggtcccgccgggtcctaccgagggcgaagggggtctagggtaggttcggggnggactacgttataccgtccagtgacgtgggacggactaaggtaaactcacgtacgctaacggaccgttccgagggtaacggccgtattaccgactaacgtccgtacgaacggtaacgtaacctaagttaaccgaaacgtaaccgtacgtcgtaagttacgtacgtacgaacgtaagtacgaacgacgtctacggagtacgcgtaagcgtagacgtgtacgtagtactacgtcgtacggtacgacgtagacgtacggtagttagggtactaacgg

SEQ ID NO: 230664 - DNA, 686 bp, Homo sapiens
  misc_feature: GYAE6OF02G2DHC.3.4.A04.1.454.CMB.1.raw
  modified_base (261)..(261): a, c, t, g, unknown or other
  misc_feature (261)..(261): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcgtggtttcctcgttgctctttaagaggtgtccagtgccaggtgcagctgggtggagtcgtgggggagcgtcggcccaggccgtgggacggtccccaaggacctcgtcctgtacngtctgtggtacttcacctttaggttactatgctatcgacacgttggggtccgcccgggtcctaccgagggcgaaggggctgggaggtggggtacgcgtaagtttactactccctagtgaaggtgggaacgtacgtaaagtaaaccgtccgtaacgaccgtaacgtaccgtccggtagggaaccgggtccgtaactaccgtaccctaagttacctaccgaagaagaacctaaacttaaccgaaacgtaaccgtacgtcgttactaacgttcgactaacgtaaacgtacgaactaccgtacgtacggaagtaccgtacgcggtaaacgggcccgtaacggtccgtttacggtagttaacgttacgttgggtacgtaacggaagtaacgtggtaaggacggttacgggttactaacggtttaaccggg

SEQ ID NO: 230665 - DNA, 757 bp, Homo sapiens
  misc_feature: GYAE6OF02HJ2Q7.3.4.A04.1.454.CMB.1.raw
  modified_base (198)..(198): a, c, t, g, unknown or other
  misc_feature (198)..(198): n is a, c, g, or t
tcagagacgcactccacgaccggtgctcgatttagagtagtgatcaggggagctctgggagacgagcccagcactggaagtcgccggtagtttccattcgggtgatcatcactgaacacagaggactcacatggagtttgggactgagcgttgggttttcctgttgcttcgtttaagcgtgtccagtgccaggtgccngctggtgagtcggtgggggagcgtggtcccagccgtgggacgtcccaaggaaccttcctccgtagtacgtacgttctcgtggtaactttccgtaccgtttaaggttacctacgttgctaagtcgtacgtaacgttcggggtacccgtccgggactccgaggtccgaaaggggtctaggggacgtgggtcggacttaggttaactaccgtcccgaagttcgtagtcgggagtacgtacgtaaaacgtccgtacgacgtaacggccgttaccgggtaggaaccgggtccgttaactacctaccgtacttacccgtacgtaacggacaaccgttaaacttaccgaaacgtacgaaccgtacgtttacgtactcgtacgaaaccgtaagtaccgaacgaccgtacccggtagaaccgtacgtacgacgggtaacgtaaccgtacggtaccgtttaggtaaccggttaacggttaacccggttgggtaaccggtaacggtaaaggtcggttaaacggtacgggttaaaccgggtacgggttaacgtaaccgtttaaaaccgggg

SEQ ID NO: 230666 - DNA, 615 bp, Homo sapiens
  misc_feature: GYAE6OF02JLO8I.3.4.A04.1.454.CMB.1.raw
  modified_base (178)..(178): a, c, t, g, unknown or other
  misc_feature (178)..(178): n is a, c, g, or t
  modified_base (432)..(432): a, c, t, g, unknown or other
  misc_feature (432)..(432): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcgttgggttttcctcgttgcttcgttttaagnggtgtccagtgcctaggtgcagctggtggtagtcgtgggggagcgtggccccagccgtgggacggtcccgaggaacctctcgtgtacacgtctcgtggtattccaccgttaggttactagtgtctatcgcacgtcgggtccgccggctccgaggcgtaaggggctggaggtgggtgcgtagttactagtcccgatcgagtggagtacagtaaacgtcctagctacgacgtccggaggaacggtcacttcacctntaccgtcgaagactaactaatacccgaaagaacctacggtactcgtacgtcgtagaacgataagaaccgtacgtaccgtagacgtacgacgtagaacggacgtacggtcgttacgttaggttaacgttacggttagtaccggactaaggtacgaggttacgaggtcggtacgtaagttaacgg

SEQ ID NO: 230667 - DNA, 636 bp, Homo sapiens
  misc_feature: GYAE6OF02JH8I5.3.4.A04.1.454.CMB.1.raw
  modified_base (186)..(186): a, c, t, g, unknown or other
  misc_feature (186)..(186): n is a, c, g, or t
  modified_base (205)..(205): a, c, t, g, unknown or other
  misc_feature (205)..(205): n is a, c, g, or t
  modified_base (324)..(324): a, c, t, g, unknown or other
  misc_feature (324)..(324): n is a, c, g, or t
  modified_base (356)..(356): a, c, t, g, unknown or other
  misc_feature (356)..(356): n is a, c, g, or t
  modified_base (366)..(366): a, c, t, g, unknown or other
  misc_feature (366)..(366): n is a, c, g, or t
  modified_base (368)..(368): a, c, t, g, unknown or other
  misc_feature (368)..(368): n is a, c, g, or t
  modified_base (381)..(381): a, c, t, g, unknown or other
  misc_feature (381)..(381): n is a, c, g, or t
  modified_base (402)..(402): a, c, t, g, unknown or other
  misc_feature (402)..(402): n is a, c, g, or t
  modified_base (418)..(418): a, c, t, g, unknown or other
  misc_feature (418)..(418): n is a, c, g, or t
tcagagacgcactccacgaccggtgctcgatttagagtagtgatcagggggagctctgggagacgagcccagcactggaagtcgccggtgtttccattcggtgatcatcactgaacacagaggactcaccatggagtttgggctgagtcgttgggttttcctcgttgcttcgttttaaggaggttntccaggtcgccgagggttncgagcgttgggtggtaggtcggtagggggggagtcggtcgggccccaggccggtggggacggtcccaggacctctcctgtacagtctgtggtacttctaccgttaggttatatgcttangctacgtcgggccgccggactcgaggcgaggntggaggtggngngtagtactgtccngtcgagcggagactagtaacncgtacgctacggtacnccggtaggacgggtcctacgtccgactcgtccacgagtaacgactaagttacccgaacaacggtactccgtaagtccttacgacgtaacgtaaacgttacggaactaccgacgttaacggaggtaaccgtggaacgacgggacgttacggtacgttagtacggttattccgtagcgttacgaggtaggagttggtagtcgggtacttaaggttacggg

SEQ ID NO: 230668 - DNA, 672 bp, Homo sapiens
  misc_feature: GYAE6OF02FOAFZ.3.4.A04.1.454.CMB.1.raw
  modified_base (262)..(262): a, c, t, g, unknown or other
  misc_feature (262)..(262): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagtcgtggtggagtcgtggggggagcggtcggcccagccctggggacgtcccaggacctctcctgtacngtctctggattcacttaggttactatgcttatgcacgtggggtcccgccgggctccgaggcgaaggggctgggaggtgggtgcgagttatctcccagtgagtggacggacaagttaaactcctacggactacgaccgttcggaggaacgggtaccgattacaccactcctaccgaagaactaaacctaacttacccgaaacgaacctaccgtacgttacgttaacttcgtagaaaccgtaaagttacgaaaccgtacgacccgtaggaacgtacggtaccgtaggaaaccgggtaccgtacgggtcgtacgggtttaagtttaaccggtttacggttacggttacgggtacggtaaggtaacggtacgttagggttacgggttacgggggtaacgtacggttaaaccggg

SEQ ID NO: 230669 - DNA, 680 bp, Homo sapiens
  misc_feature: GYAE6OF02GZGVQ.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcgttgggtttttcctcgttgcttcttttaagaggtgtccagtgccaggtgcagcgtggtggagtcggtgggggacggcgtcggcccgaggccgtggggacggtacccgaggaaccttccgtccgtagtacagttccttcgtggtacttcctaaccgttttaggttacttatcgacttagtcgacgtacgtcggggtccccgccgggtcctccggaggccgaaggggtccgtagggacgggtgggtcggctaagtttaactaccgtcccgtagtaggagtaggaagactaagtaaacctccgtacgacgtacgtaccttaccggacggaaaccgggtccgtaacgttaccaaccgtactcccgtacgaagaacgtaactaacttaaccgaaagtaaccacgtactacgtactcgtacgactaaagacgacacgcgtagacgtgtacgacggaacgacgtacgtgttagtacgttaagttcgttaggtcgtacgaagtaacggtagtacggtaggtacggtagtaacggttaacgg

SEQ ID NO: 230670 - DNA, 662 bp, Homo sapiens
  misc_feature: GYAE6OF02IXT0Z.3.4.A04.1.454.CMB.1.raw
  modified_base (194)..(194): a, c, t, g, unknown or other
  misc_feature (194)..(194): n is a, c, g, or t
  modified_base (370)..(370): a, c, t, g, unknown or other
  misc_feature (370)..(370): n is a, c, g, or t
  modified_base (408)..(408): a, c, t, g, unknown or other
  misc_feature (408)..(408): n is a, c, g, or t
  modified_base (414)..(414): a, c, t, g, unknown or other
  misc_feature (414)..(414): n is a, c, g, or t
tcagagacgcactccacgaccggtgctcgatttagagtagtgatcagggggatcaggactcctcagttccaccttctcacaatgaggctccctgctcagctcctggggcctgcttaatgcctctgggtcccaggatccaggtggggatggttgtgatcgactcagtctccactctcctgccctcaccttggacncgccggcctcatcctctgcaggtctagtacaacgcctgtatacgagtgatacggaaactacctacttagtaagttggttcagcgaggacggccgacggacctaactccgacgaacggcgtaccttaagtttagtaacggtttaccgtaaccggtctcgttcgggtaccagactagnttcgagagctaggtggtcgacgcatgtattcatactanaacgtnagacggaggtggacgtcgtgaggtagtttacggggtttaggtttacttacgtcgagttagtacggacgtaacggaaccacgtacggtccgtaccgttaccggtacgtacccgggaccgaaccgggtaaaccggtaaggtaaccgggtaaactaccggtaaacggtcggttaacgggtacggtacccgtcgtaaccgttacccgaagttttcccggtacgttacccgtttaccctaccgtttcccccgg

SEQ ID NO: 230671 - DNA, 667 bp, Homo sapiens
  misc_feature: GYAE6OF02IBOZE.3.4.A04.1.454.CMB.1.raw
  modified_base (515)..(515): a, c, t, g, unknown or other
  misc_feature (515)..(515): n is a, c, g, or t
tcagagacgcactccacgaccggtgctcgatttagagtagtgatcaggggagctctgggagacgagcccagcactggaaggggtcgccggtgtttccattcggtgatcatcactgaacacagaggactcaccatggagtttgggctgagcttgggttttcctcgttgcttctttttaagaggtgtccagtgccaggtgcaggctgggtggaggtcgtggggggagcggtcggcccaggccgtggggacgtcccgagggaacttcctaccgtgtactagtctcgtaggtacttcaccgtttaggttactatcgtctatcgctacggtcgggtcccgccgggtctccgaggcgaacggggctaggggtaggtggggtcgactagttactcgtccaagtgacgtagggacgataaacgtaaactccgtacgacagtaccgtcggtaggaacgggtcctaatccacctactcaccgagacgtaactaactaccaaagaacctacgtctagtactcgtanaacaagtacgaaccgtcgtaccgtaggaacgacgtcgaacggacggaacgtaccggtacggttaaggtttacggtaacgtttacgcgggttacgaaccgaagggtagtacggttagggtaagggttcgggtaacccgttagttaaaccgggg

SEQ ID NO: 230672 - DNA, 827 bp, Homo sapiens
  misc_feature: GYAE6OF02IBJUX.3.4.A04.1.454.CMB.1.raw
tcagagacgcactccacgaccggtgctcgatttagagtagtgatcaggggagctctgggagacgagcccagcactggaagtcgccggtgtttccattcggtgatcagtcactgaacacagaggactcaccatggagtttgggctgagcttgggtttcctcgttcgcttcttttaaagaggttagtccaaggttcgccgtaaggttcgacgacgtcgtgggtaggtacgtcggtaggggggagcggttcggcccaggcccgttggggacggtaccccgaggtaacttccgtaccgtagtaacgtaggttccttacggtggtaacgtttaccgaacccgttttaaggggtttaccttaagttcggtacttaagttcggtaccgtaaccggtttccggggggtcccccggtacccgggggtccttacccggaacggggtaccggaaaccgggggtccgtaggggtacgggtttgggggtcggtaccgtaacggtttaactacgttaccccgtagtacgggtagttacggggaggtacctaaaggttaaacctccggttaacgacgtaacgaaccgttcggtaacggaacgggtcttaactcgaacccgtagtaccgaccgagtaaacgacttaaacgtacccgtaaagtaaccgaagttcccgtaacggtaactcgtaacgactaaagtccgaaaccgtacggtccgaggtaacgacgttacggacgaaacggtaccgtaggtacgtagttacggtacgtttacgacggtacggtacggaagtaggttaacgtaggtaaccggtttacggggtaccaacggtttaacggg

SEQ ID NO: 230673 - DNA, 844 bp, Homo sapiens
  misc_feature: GYAE6OF02JRMF3.3.4.A04.1.454.CMB.1.raw
  modified_base (181)..(181): a, c, t, g, unknown or other
  misc_feature (181)..(181): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccagtggagtttgggctggagtcgttgggttttcctcgttgcttcttttaaggnggtgtcctagtcgccgaggtcgcagtcgtggtggaggttcggtggggggacgtcggtcggccccaggtccggtaggggaccgtacccgaaggtaccttcctaccgtcgtaacctcgtcctcgtacggtacttaccgtaaccggttttaaggttacttacgtcggtacttaacgtcggtaccttaccggttccgggggtccccggcccgggtcctaccggaacggggtaccggtaaacgggggtccgttgggggtaacgggttcgggggtaccgtaccggttaacggttttaacaccccggttcccgtaaaggttacgtaacgggtacgggggtaaccgaaacctttaacgggttaaaaccctccggttaaaccgtaccgggtaaaccgttacccgggttaacgggttaaccggggaaccggtaccggtttaaccttacccgtaaccgtacgttaccccgtaacggaaaccggttactaaaccgtaacgttaaaccccggaaagtacccgtaaccggttaccgtagttacccacggtaaactacggaacgtaaccgcgtacgtagaacgtacgacgtacggaacgtacgcgtacttgtaaccgttagtcgtaggtccgaaggttcaagtcggtaggtactaggtaccttaggtaaccgtacggg

SEQ ID NO: 230674 - DNA, 708 bp, Homo sapiens
  misc_feature: GYAE6OF02I4DIR.3.4.A04.1.454.CMB.1.raw
  modified_base (264)..(264): a, c, t, g, unknown or other
  misc_feature (264)..(264): n is a, c, g, or t
  modified_base (421)..(421): a, c, t, g, unknown or other
  misc_feature (421)..(421): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcgtgggttttcctcgttgcttacttttaagaggtgtccagtgccaggtgcagctgggtggagtcggtgggggaggcgtcggacccagccgtgggacgtcccgaggactctcctgtacngtctctaggacttcaccgttaggttactatgctatgactacgtgggtcccggccgggtctaccgaggacgaacggggtcgtagggtagggtggggtacggcgtagtttaatacgtcccaagttggagttgggacggactaaggttaaactccgtacncgacgtacgtccggtaaggtaacggccggtaattacccgaaccgtacttaccgacccgaaggtaacgtaactaaacgttaacccaaacgtaaccgtaacgtacgttacgtaactacgtacggaactaaacgttacgaaacgacgtccgtaacgacggttacgacggttacggaaacggggtaccaacggggttcgttacggttaagtttcgttacggttaccggtagggaaccggtaagaacggtaggtaacggtaggtaaccgggttacgtacgttttaaacgggg

SEQ ID NO: 230675 - DNA, 610 bp, Homo sapiens
  misc_feature: GYAE6OF02FQ4E5.3.4.A04.1.454.CMB.1.raw
  modified_base (260)..(260): a, c, t, g, unknown or other
  misc_feature (260)..(260): n is a, c, g, or t
  modified_base (335)..(335): a, c, t, g, unknown or other
  misc_feature (335)..(335): n is a, c, g, or t
  modified_base (353)..(353): a, c, t, g, unknown or other
  misc_feature (353)..(353): n is a, c, g, or t
  modified_base (599)..(599): a, c, t, g, unknown or other
  misc_feature (599)..(599): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttcttttaagaggttgtcccagtgccaggtgcagctggtggagtcgtggggggagcgtggcccagccgtgggacgtccaggacctctcctgtacngtctcgtggtattcgaccgttaggttactatgctagtgcacgtgggtccgcggctccgaggacgaggggctgggnggtggggtgctaggttanactccgatcggatgggacgtacaggttaaactcccgtaagcacggtacctcggtaggacggtcgacttacacgtactcctacgtacgaacgactaaactaccaaagtaaccgacgtactagtactacgtacgactaaagtacgaacgtcgaccgttaggacgtaacggtctaaggaacgaccgacggttccgtagtacggttattaccggtggtacgtcgaaggacgttagcggtagtcgggttanaggttaacggg

SEQ ID NO: 230676 - DNA, 722 bp, Homo sapiens
  misc_feature: GYAE6OF02JCSVX.3.4.A04.1.454.CMB.1.raw
  modified_base (297)..(297): a, c, t, g, unknown or other
  misc_feature (297)..(297): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtgggggagcgtggcccagccgtgggacggtcccaggtaactcgtccgtgtacagtctcgtggtacttcaccgtttaggttactatgctangctacgtggggtcccgccggtctccgaggccgaaggggctgggaggtcggggtgcgtagttacgtactccctagtgaagtgggagtacgaagttaaactccgtaacgcgaacggtacctaccgggtaggtaacggggtcccgtaactttaccccgaaaccttagtccccgtacccggaaagtacggaaactaacgttaacccgaaacgaaacgtaccgtctaaggtacttaccgtacaacgtaaaactcggaaaccacggtacccgttaggaaaccgtcggtaaccgttacgggaaacgggtaacccgtaaccgggttacgttaacggtttaacggtttaactttaccgtaggggttaaccgacggtaggtaacggttaggttacggtaacgggtttaccgggtaacgttaacgttaaaccgggg

SEQ ID NO: 230677 - DNA, 714 bp, Homo sapiens
  misc_feature: GYAE6OF02GPXBP.3.4.A04.1.454.CMB.1.raw
  modified_base (271)..(271): a, c, t, g, unknown or other
  misc_feature (271)..(271): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttcttttaagaggttgtccaggtgccagggtgcagcgtggtgggagtcggtggggggaggcgtcggcccagccgtggggacggtcccgaaggactccgtctgtacngtctgtggattccactttaggttactatcgctatgcacgtcgggtccgccgggctccggaggcgaacgggggtctaggggtaggtggggtggtctaaggtttactaacgtcccagtggtagtcgggagctaaagttaacgtcctaacgtcgaacgtaccgtccggtagggaacgggcctaacttacccaccgtactcctacgaacggactaactaaacgttacccaaaaggtaaccgtaaccgtcgttaagtacgttacctagtaaccggtaaactcggaaaacgtcgtacccgtaagggaacgtacggttaccgaagggaacccgggaaccggttaccgggtacctttgggtttaacgtttacgtttaacggttgggttaccggaacggttaggtacggtagttgggtaagggttcgggttaacgttacggtttaaacgggg

SEQ ID NO: 230678 - DNA, 983 bp, Homo sapiens
  misc_feature: GYAE6OF02IMLFR.3.4.A04.1.454.CMB.1.raw
  modified_base (185)..(185): a, c, t, g, unknown or other
  misc_feature (185)..(185): n is a, c, g, or t
  modified_base (208)..(208): a, c, t, g, unknown or other
  misc_feature (208)..(208): n is a, c, g, or t
tcagagacgcactccacgaccggtgctcgatttagagtagtgatcagggggagctctgggagacgagcccagcactggaagtcgccggtgtttccattcggtgatcatcactgaacacagaggactcgaccagtggagtttgggctgacgtcgttgggttttcctcgttgcttacgttttaaggnggttcgtccaggtcgccagggtnaccaggtcgtgggtcggagtcggtgggggacgtcgtcgggcccagccggttgggacgtacccgaggtaacctcgtccgtagtaccacggttcctacgtcggtacttaccgtaccgtttacggttacctagtcggacttagcggtccgtacggtcggggtcccgtaccgggtctaccggacgggacggaaggggtcctaggggtacggtcggggtacgacgttaggttataccgtaccgagttacggaagttcgggaacggtaccttaaaggttaaaccgttccgttaacgggacctaaacgggtaccccgttacggggtacccgggtaaacgggtacccgtttaagttaccccgtaaaccggtaccgttaacccggtaccgtaaaccgggtaaccgtaaacccgttaacggtttaaacccggaaacccggttaaaccgcggttaaaccccgttggtttaaacccgttacccggtagggtaaaaccttaaacccggtaaccgggaaaacccgttccggttaaccggggttaaacgggaacggttaccgggttaaacccgggtagggtaaaacccccgggggtacgtttaacccgggggttacggttttaacggtttaacccgggttttagttaaaccccggggttaggggtttaaacccggaaccggggttaaaaccgggtttacgggtttaaaccgggttacgggggtttaaccggggggttttaaaccccggggttttacgtaaaaacccgggggtttttaaaaccccgggggg

SEQ ID NO: 230679 - DNA, 756 bp, Homo sapiens
  misc_feature: GYAE6OF02FOOQN.3.4.A04.1.454.CMB.1.raw
tcagagacgcactccacgaccggtgctcgatttagagtagtgatcagggggatcaggactcctcagttcaccttctcacaatgaggctccctgctcagctcctggggctgctaatgctctgggtcccaggatccagtggggatgttgtgatgactcagtctccactctccctgcccgtcacccttggacacgccggcctccatcctcctgcaggtctagtcaaacgcctacgtatacagtgataggaaacacctacttagtaatttggttacagcgaggacggaccgaggacctaatcctaccgaacggccgaccttaatttaacgtaaggtttaccaaccgggtctcgttcgggtaccaagacgagtacttcgaggtccgacgtacggttggggtacacggtcacgttgtaactttaccgaactaacgtaacgaaaacttcgaacggtaccgggtaagggggtcgggaacgggtccggtagggtaaacgggttacggttttagggggttttaaggggtttttaaccgttaacggttacgggtacgttaagtacgggtaacgtaaacgggttaacccgtacgtaacccggttccggggtaccccgttacccgggtacccgggttacccgggaacccgggtaaccgggtaaaccgtaacgggtaacggtaaactaaccggtaaacgtaacggttacggtacggtaccgtaccgtaccgtacccgtacgttccgtacgttcttacctacgttaccccg

SEQ ID NO: 230680 - DNA, 725 bp, Homo sapiens
  misc_feature: GYAE6OF02GGWE3.3.4.A04.1.454.CMB.1.raw
  modified_base (267)..(267): a, c, t, g, unknown or other
  misc_feature (267)..(267): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggaattggggctgagctgggttttccttgttgcctattttagaaggtggccagtgtgaggtgcagcgtggtggaggtcggggggaggcgttggtccaggccgtggggggtccctggagactctcctgtgcagcctntggattcacctttagtagcttcgttggatggaacttgggtcccgccagtcctccgaggggaaggggctagggagtgggtcggcctaagttgaacgccagtagtagggaagtagaagtaaaattactagtggtacggacttcgtaggtgggaacggggtactagtttaccgaaccttagttttacccgaaggtaacgaaaccgaaccggaacccgtaaaggaaacccttctaacgttttaggtacttaccgttagaacctaaaattagggaacctacgtacccgtagaaccggtacccggaacgggaaccgtaccgggtacttttagttttacgttttccgtacggttcgggtccggtccggtttaggggaccttaacggttaacccgggtaaaaccgtccgggttacgggggacccgttaaaccgggggtaaccccgttgggtacccctaaccccggg

SEQ ID NO: 230681 - DNA, 652 bp, Homo sapiens
  misc_feature: GYAE6OF02GRK4F.3.4.A04.1.454.CMB.1.raw
  modified_base (160)..(160): a, c, t, g, unknown or other
  misc_feature (160)..(160): n is a, c, g, or t
tcagagacgcactccacgaccggtgctcgatttagagtagtgatcaggggtgatcaggactcctcagttcaccttctcacaatgaggctccctgctcagctccgtggggctgctaatgctcgtgggtcccaggatccaggtggggatgttgtgatgactnagtctccactcctccctgccctcacccgttggacacgcccggcctccatcctccgtgcgaggtctagtacaaacgtcctacgtatacgagtgatacggaaaccaccttacgttgtaagtttggttacagcaggacgccaggaccaatctaccgaaggcctacctaatctaagttaacggtttaccgaaccgggacgtcgtacggggtacccagacgagtactcgacggcgtacacggtcgggtacagggtcctacgtgttacctttcgaaccgtagtagtaacgtaaagttacggacggtagggggtagaacgggtcgtagggaggtagtttgggtttaggtatttttacgttcgtagcttagtcggtactaacgtccaagtaccgtacgttccgtacccgttacttacgttccgggaccgtaacgggacctaaggcgtaggaacgtaacgtaaccgtaacgtacgtcggtacggaccttgaccctagtccg

SEQ ID NO: 230682 - DNA, 748 bp, Homo sapiens
  misc_feature: GYAE6OF02F7HG5.3.4.A04.1.454.CMB.1.raw
  modified_base (359)..(359): a, c, t, g, unknown or other
  misc_feature (359)..(359): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttctttaagaggtgtccagtgccaggtgcagctgggtggagtcgtgggggagcggtggcccagcctggggacgtcccaggactctcctgtacagtctctggacttccaccgtttaggttactatgctatgcacgtggggtcccgccgggtcctccgaggccgaaggggtcgtggaggtgggtggcgtagtttanactccagtgagtgggaggtacaagttaaactcccgtaacgactacggtaccgtccggtaggaaaccggggtcctacgtttacccaacccgtagttccccgtaccgaacgaacggtaacctaaccgtttaacccgaaaacgtacccgaaccgtacgtttacggtaaccttcctacgtaacctaaacgttaccggaaacgtaccggtaccgtacggtaacgaaccggtacgttacgggaaacggtaacccgtacgggtaccgtttaacggttacggttttaaccggtttaaccgttaggggttaaccgggtaccggtaaaggtaacggttacggttaagggtaacgggtttccgggggttaaaccggttaacggttttaaaacccgggggg

SEQ ID NO: 230683 - DNA, 702 bp, Homo sapiens
  misc_feature: GYAE6OF02G17E5.3.4.A04.1.454.CMB.1.raw
  modified_base (265)..(265): a, c, t, g, unknown or other
  misc_feature (265)..(265): n is a, c, g, or t
  modified_base (364)..(364): a, c, t, g, unknown or other
  misc_feature (364)..(364): n is a, c, g, or t
tcagagacgcactccacgaccggtgctcgatttagagtagtgatcaggggagctctgggagacgagcccagcactggaagtcgccggtgtttccattcggtgatcatcactggaacacagaggactcaccatggagtttgggctgagcttgggttttcctgttgcttcttttaagaggtgtccagtgccaggtgcaggctgggtggagtcggtggggggaggcgtggccccaggccgtggggacggtcccaggactctcctgacngtctctggattcaccgtttaggttactatcggctagtgctacgtcgggcccgccggctccgaggacgaggggctgggagtggggtgctaaggttatacncctagtgagtgggacgataagtaactccgtacgacacggtacctaccggtacggaaacggggtcctaacgttacccgaacctagttacccgtacgaacggtacgtaaaccgtaaattacccgaaacgaacctacgtaccttacggttactacgttaacgaacttaaaggtaaccgaacgacgtaaccgtaggaacgaccgtcggaaacggaccgggtaaccgtacgggttaccgttaggttacggtttaaacgtttacccggtggttaacggacggttaaacggttagacggttacgggtaacgggtttcggggtaacgttaacggtttaaaccgggg

SEQ ID NO: 230684 - DNA, 617 bp, Homo sapiens
  misc_feature: GYAE6OF02FTFCF.3.4.A04.1.454.CMB.1.raw
  modified_base (175)..(175): a, c, t, g, unknown or other
  misc_feature (175)..(175): n is a, c, g, or t
  modified_base (193)..(193): a, c, t, g, unknown or other
  misc_feature (193)..(193): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgcttcttttaagnggtgtccagtgccaggtncagctgggtggagtcgtggggggagcggtggcccagccgtggggacgtcccgaggaactctcctgtacagtctctggattccaccttaggttactatgctatgacacgtgggtccgccgggctccgaggcgaaggggctgggagtgggtggctaggttatactcccatcggagtgggagactaagtaaacttccgacgcaacgtaccgtacggtagaaccggggtccgtagttccaacccgtactccgtaccgaaggtaccgtaaactaactaaccaaagaacctacgtactaggtactcgtacgaacaagtacgaaacgacgtcgtagaacgacgtcgtacggacggacgacggtcgtagtagttacttacgtggtagtacgaaggtagtaactggaggtacgggttacggtaagttaacggg

SEQ ID NO: 230685 - DNA, 602 bp, Homo sapiens
  misc_feature: GYAE6OF02GQM1H.3.4.A04.1.454.CMB.1.raw
  modified_base (258)..(258): a, c, t, g, unknown or other
  misc_feature (258)..(258): n is a, c, g, or t
  modified_base (357)..(357): a, c, t, g, unknown or other
  misc_feature (357)..(357): n is a, c, g, or t
  modified_base (441)..(441): a, c, t, g, unknown or other
  misc_feature (441)..(441): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgcttcttttaagaggtgtccagtgccaggtgcagctggtggagtcgtgggggagcgtggcccagcctggggacgtcccaaggtactctcctgtacngtctctggattcaccttaggttactatgctatgcactgggccgccgggctccgaggcaaggggtctgggagtggggtggctaggttatactcccagtgngtggaggctaagtaactcccgtagcagaccgtccggagaacgggccattcaccactcctacagacaactaactacgaacgaacnccgtactggtactctaggaacaagtacgaacgtacgtacgtaggacgtacgccgttaggaaacggccgtagggttacctaggttacggtttaacttaccgggtggtaccggtaggaagtacggtagttaacggacgggttggtaccgttaagttaaccggg

SEQ ID NO: 230686 - DNA, 859 bp, Homo sapiens
  misc_feature: GYAE6OF02G75WI.3.4.A04.1.454.CMB.1.raw
  modified_base (827)..(827): a, c, t, g, unknown or other
  misc_feature (827)..(827): n is a, c, g, or t
tcagagacgcactccacgaccggtgctcgatttagagtagtgatcaggggagctctgggagacgagcccagcactggaagtcgccggtgtttccattcggtgatcatcatgaacacagaggactcgaccatggtagtttcgggactgagcttgggttttcctcgttagccttacgttttaaggaggttctccagtcgccgaggtgcagtctgggtagagtcggtagggggacgtcgtcggcccctaggtccgtacggggacggttcccaaggtacctctccgtagtaactggtccttcgtagtactttccaccgtttagggttacctaagtcgtacttacgtcgtaccgtaacgggttccggggtcccggtccccgggtaccttacccgggaacgggtaccgtaacggggggtccttcggggtaacgggggttacggggttcggtaaccgttaaagttaccggttaacccgttacccgtaggtaacggttaccgggacggggtaacgttaaacccgttaaaggttaaaaccggtcccgtaacccgggtacgttaaacggttaccggttaccgggtaagggtaacccggggttacctaacccgttaccgaaaccgttacgttaaccccgtaccggtaacgtaaaccgttaacctaaaccgttacccggtaaaaccgtaacttaacccgggtactttacggtaacgttaccgtagtaaaccgtaaactacggtaaccgaccgtaccgtaggaaccggtagtacgtacggaccggtacctaccgtgttaaacggtgttaacttaggtacggtcgtacggaagttacggtntagggtacggttacggtacgtaggttaaccgg

SEQ ID NO: 230687 - DNA, 621 bp, Homo sapiens
  misc_feature: GYAE6OF02FRG34.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttcttttaagaggtgtccagtgccaggtgcagctggtggagtcgtgggggagcgtggcccagccgtgggacgtcccaggaactctcctgtacagtctctggattcaccttaggttactatgctatgcacgtgggtccgccgggctccgaggcgaaggggctgggagtgggtggctagttatactcccatgagtggaggctaagtaaactccgtacgacaagaccgtccggtaggaacgggccgtacgttaccaccgtattccgtaccagaacgtaactaaacttacccgaaacgaacctacgacttacgtaactcgtacgtacaaagttacgaaacgacgtacctaggaacgacgtcgtacggaacgaacgacggtcgtaggttacgttaacgttacgtaggttaccgaggtaagacggtagtagggtaacgtggggtaccgtaaggttaaccggg

SEQ ID NO: 230688 - DNA, 787 bp, Homo sapiens
  misc_feature: GYAE6OF02GPU2Y.3.4.A04.1.454.CMB.1.raw
  modified_base (156)..(156): a, c, t, g, unknown or other
  misc_feature (156)..(156): n is a, c, g, or t
  modified_base (160)..(160): a, c, t, g, unknown or other
  misc_feature (160)..(160): n is a, c, g, or t
  modified_base (170)..(170): a, c, t, g, unknown or other
  misc_feature (170)..(170): n is a, c, g, or t
  modified_base (188)..(188): a, c, t, g, unknown or other
  misc_feature (188)..(188): n is a, c, g, or t
  modified_base (203)..(203): a, c, t, g, unknown or other
  misc_feature (203)..(203): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttggctgagctgggtttccngttnctctttaagngtgtccagtgtccaggtncagctggtgagtcgngggggagcgtggcccagccgttagggacgtcccgaggaactctacccgtgtaccgtaagtcctcgttacggaactttccgtaaccgtttaggtttacctaatcggacttagtacggtcctaacggttcggggtccccggtacccggggttctaccccgggtaagggtaaccggtaaacgggggttcctaaggggggtacgggtttaccggggtaaggggttccgtaaacggttttacgttaacccgttaccccggtaaggtttacggtaaacggtttggggaaccgggttaacgttaaacgttaaaacgtcccggttaaacgccgtaacggttacccggtaccggtacgggaaccggtaaccgtacgttacgaccgttactaccgtaccgaaggtaactaaccgtaacttaaccggaaaccgacgtaaccgtacgttacgtacttaccgtacgtaacgaacgttaacgaaaccgtcggtaacgacggtagaacgtacgtaccggaaagccgtacgtacgttaggtcgttaacgtagtcggtaacgcgtagaccgttagaccgtagtacgggtaccagttaacgg

SEQ ID NO: 230689 - DNA, 750 bp, Homo sapiens
  misc_feature: GYAE6OF02H2D1Q.3.4.A04.1.454.CMB.1.raw
  modified_base (233)..(233): a, c, t, g, unknown or other
  misc_feature (233)..(233): n is a, c, g, or t
  modified_base (302)..(302): a, c, t, g, unknown or other
  misc_feature (302)..(302): n is a, c, g, or t
  modified_base (426)..(426): a, c, t, g, unknown or other
  misc_feature (426)..(426): n is a, c, g, or t
  modified_base (504)..(504): a, c, t, g, unknown or other
  misc_feature (504)..(504): n is a, c, g, or t
  modified_base (514)..(514): a, c, t, g, unknown or other
  misc_feature (514)..(514): n is a, c, g, or t
tcagagacgcactccacgaccggtgctcgatttagagtagtgatcaggggagctctgggagacgagcccagcactggaagtcgccggtgtttccattcggtgatcatcactgaaacacagaggactcaccatgggagtttgggctgtaccgttgggttttcctcgttgtccttacgtttttaaaggaggttcgtcctagttgtcgagggtgctagcgtgggtgggacgtcggngggggaggcgttggccaggccgtggggacgtccctagacgacttccgtccgtgtcgcgacgtcctgtanaacttcctaacttcgaaagttacttatcgtactatcgactacggtcgggtcccgacgcgggtcctaccggggaggtaaccggggcgggtgggttgggtacgacgttagttactacgtttctagnggtaacgtaaagggaacgttgacggtactacgtaccagtacgtaccgtccggtcggacggtaacggtctttagttacncgtacttccncgaagtaacgctaacgtaacctaacgaaaccgaaccctaacctttatactaccgtagtaaaaccgtaaacggtacgaaacccgaacggttccttaaagggcccgttaaacgacgggtaaaccgttaccgccggtaactttcgttaaaatttacccggttaggttgggaaacccgtagggtaacggtacggggaaccgggtacggggtttcccccgggaaagttaccggttaccggg

SEQ ID NO: 230690 - DNA, 724 bp, Homo sapiens
  misc_feature: GYAE6OF02JSUAV.3.4.A04.1.454.CMB.1.raw
  modified_base (128)..(128): a, c, t, g, unknown or other
  misc_feature (128)..(128): n is a, c, g, or t
  modified_base (160)..(160): a, c, t, g, unknown or other
  misc_feature (160)..(160): n is a, c, g, or t
  modified_base (170)..(170): a, c, t, g, unknown or other
  misc_feature (170)..(170): n is a, c, g, or t
  modified_base (183)..(183): a, c, t, g, unknown or other
  misc_feature (183)..(183): n is a, c, g, or t
  modified_base (342)..(342): a, c, t, g, unknown or other
  misc_feature (342)..(342): n is a, c, g, or t
  modified_base (574)..(574): a, c, t, g, unknown or other
  misc_feature (574)..(574): n is a, c, g, or t
tcagagacgcactccacgaccggtgctcgatttagagtagtgatcaggggagctctgggagacgagcccagcactggaagtcgccggtgttaccattcggtgaatcatcactgaacacagaggacctnaccatggagtttgggctgagtctgggtttccnggacctcttntagtagtctcgtntcacgtcgactgctcggtgagtcggtacgggtaggtggaaccggtcccgaggtccccgtggggaccggttccggaacggaccgtacgttccctgtaacctacggtcctacgttcggtactactacttacggttacgttaacgtgtacctagtcggtacncgtggtccggtccggcccgacttttactaaacggggtaccggttacgggtaggtggtaggtacgtacggtactagacccccggttaacggtaagtacggacgtcaaacgttacaccgtacgtacgacgtaccgtcgtaggtaccggtacgtaacgtaccgtaccacgaacctaccgagtaaccgaacgtacctaacgtaacgaacacgaccttagtactaacgtcaacgtanacgaacgtacgtaccgtacgtaacgacggtacgttacgggaaccgtacggacgttacgtaccggttacgtaacgttacgtaaacgtcggggaaatgggtaccgtaggttaacgtaggttaccggtaacgttacggtaagttacggtaagg

SEQ ID NO: 230691 - DNA, 713 bp, Homo sapiens
  misc_feature: GYAE6OF02JKGUW.3.4.A04.1.454.CMB.1.raw
  modified_base (272)..(272): a, c, t, g, unknown or other
  misc_feature (272)..(272): n is a, c, g, or t
  modified_base (332)..(332): a, c, t, g, unknown or other
  misc_feature (332)..(332): n is a, c, g, or t
tcagagacgcactccacgaccggtgctcgatttagagtagtgatcaggggagctctggggagacgagcccagcactggaagtcgccggtgtttccattcggtgatcatcactgaacacagaggactcaccatggagtttgggctgagcgtgggttttcctcgttgcttcttttaagaggttgtccaggtgccagggtgcgagcgtgggtggaggtcgtgggggggagcggtcggcccagccgtggggacggtcccaggactctccgtgtacngtctcgtggacttctaccgttaggttactatgtctagtgctacgtggggtccgccggtcncgaggcgagggctgggaggtgggtggactagttacgtactcctagtagagtacggaggtacctaaaggtaactccgtacgtcgacgtaaccgtccgggaggaaaccgggtccaacgttccgaaccgtacttacccgtaccgacgtaacgtaaacctaacgttaacccgaaaacgtaaccgtacgtacgtaacggttactacgtcggaaacctaaagtacgaacctaacgtcccgtaaggacggtaacgtacgggaagtaaccggggaccgtaacgggtctttacgggtaaacgtttaccggttaacggtggaccgggttaacgaaggttaacggtaaggtaccggtagggttaagggttaaccggtaactttaaacggggg

SEQ ID NO: 230692 - DNA, 660 bp, Homo sapiens
  misc_feature: GYAE6OF02GQGKZ.3.4.A04.1.454.CMB.1.raw
  modified_base (267)..(267): a, c, t, g, unknown or other
  misc_feature (267)..(267): n is a, c, g, or t
  modified_base (342)..(342): a, c, t, g, unknown or other
  misc_feature (342)..(342): n is a, c, g, or t
  modified_base (362)..(362): a, c, t, g, unknown or other
  misc_feature (362)..(362): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaaccatggagtttgggctgagcttgggttttcctcgttgctcttttaagaggtgtccagtgccaggtgcagctgggtggagtcgtggggggagtcggtcggcccaggccgtggggacggtcccaggaacctctcctgtacngtctctggacttcacgttaggtactatgctatgactacgtcgggtcccgccggctccgaggcgaaggggctgggnggtgggtgctaggttatacncctatggatggacgtactaaagttaactccgtaacgctacgtaccgtccggtaggaacggggtccgtacgttaccaacctactcctaccgagtaacgtaacctaacgttaacccgaaacggtaaccgtaaccgtacgtacgttaactccgttagtaaccgaaaagtaacgaaaccgtacgtacccgtaggtaacgtagccgtaggaaccgacgtacggtcgtaggttagttacgttacgttggtacggacgtaggtaacggtgtacggtagggtccggtaggttaaccgttaacgggg

SEQ ID NO: 230693 - DNA, 749 bp, Homo sapiens
  misc_feature: GYAE6OF02FPUCR.3.4.A04.1.454.CMB.1.raw
  modified_base (265)..(265): a, c, t, g, unknown or other
  misc_feature (265)..(265): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtgggggaggtcggtggcccagccgttggggacggtccgaggtaactcctccgtgtacngtcctgtaggtacttcctaccgttaggtttactatgtctatcgctacgtgggtcccggccgggtctccggacggccggaaggggcgtagggtaggtcggggtggactaggttactaccgtcccgtagtacggcgtagggacgtacgtaaagttaaacgtaccctaaccggacgtaacggtaccgttaccgggacgggaacgggtccctaagtttacccaccgttactccgtaccgaacggaacgtaaacccttaacgttaacccgaaaacggtacccgtacgtaccgtttacgttaaacctcgttaacgaacctaaacgtaacgaaaccgttacgtcccgtaagggaccgaacccgggtaacgaaccggtacgttaccgttagttttacgttccggtaggttcccggcgggtaccggtcgggttacaaccggttaacggtaacgtaccgggtccggggacctaaccgggggtccttaacccggg

SEQ ID NO: 230694 - DNA, 755 bp, Homo sapiens
  misc_feature: GYAE6OF02I83LF.3.4.A04.1.454.CMB.1.raw
  modified_base (170)..(170): a, c, t, g, unknown or other
  misc_feature (170)..(170): n is a, c, g, or t
tcagagacgcactccacgaccggtgctcgatttagagtagtgatcaggggagctctgggagacgagcccagcactggaagtcgccggtgttccattcggtgatcatcactgaacacagaggactcaccatggagtttggctgagctgggtttcctcgtgctcttttaagngtgtccagtgccgaggtgcagcgtgggtggtagtcggtgggggaggcggtggcccaggccgtaggggacgtcccgaaggacctcctccgtgtactaggtcctcgtaggtcttccgtaaccgtttaggttaactacgtcgtcctaagtcgaccgtcgtcggggtcccgccgggtcctccgaacgggccggtaacgggggcgtcgggtaggtggggttacggcgttaggttactacctaccgaaggtgtaaggtacgggtacgaacgtaagtaaacctaccggttaacgaccgttaacgtaccggtaccgggttaagggacgggtaccccttaagtacccgtaaccgtaccttacgttaccgaaggtaaacgtactaaaccgttacctaaacggaaacctaccggttacgtattaacccggtaactcggtaaaccaaagttaacggaaacctcgaaccggttagaacgtacggcgtaagggaaccggtacgaccggttagttacgggttaacgtttaaccgacgttggtaacggcgttaaggacggtaaggtcggtaacggttagggtaccctaaaggttaacgggg

SEQ ID NO: 230695 - DNA, 709 bp, Homo sapiens
  misc_feature: GYAE6OF02GC0C7.3.4.A04.1.454.CMB.1.raw
  modified_base (178)..(178): a, c, t, g, unknown or other
  misc_feature (178)..(178): n is a, c, g, or t
  modified_base (199)..(199): a, c, t, g, unknown or other
  misc_feature (199)..(199): n is a, c, g, or t
  modified_base (322)..(322): a, c, t, g, unknown or other
  misc_feature (322)..(322): n is a, c, g, or t
  modified_base (455)..(455): a, c, t, g, unknown or other
  misc_feature (455)..(455): n is a, c, g, or t
  modified_base (467)..(467): a, c, t, g, unknown or other
  misc_feature (467)..(467): n is a, c, g, or t
tcagagacgcactccacgaccggtgctcgatttagagtagtgatcaggggaggctctgggagacgagcccagcactggaagtcgccggtgtttccattcggtgatcatcactgaacacagaggactcaccatggcgtttagggctgagcttggggttttcctcgttgctcttttaagnggtagtccgagtgccagggtnacgacgtccgtagggtggacgtcgttggggggaggtccgtcgggaccccaggtcccggtaggggacggtcccaaggtaccttcgtcctagtacagtctcgtggattccgacgtttaggtactntcactatcacgtcggtcgggtccggtccggctccggaaggtcgaacggggtctaggggacggtcgggtaggcctaagttaaccgtacgttccgaagtcgtagtacggagtaccgtaagtaaactccggtaacncgtaggtacccncgggtacgaacgggtcctaactaccgacctacgtacgtaacccgaaggtacgaaacctaaacgttaaccgaacgaaaccggtcgtacttacggtaaactccgaagtaacgaaactcgaaaccgagttaccctaggaacgtaacgcgtaaacggacggtaaccgacgtacggttagtaggttaacttaagcgggttacgaacgggatacggttaaggtcgtaggtacggtagtacgttaacgg

SEQ ID NO: 230696 - DNA, 777 bp, Homo sapiens
  misc_feature: GYAE6OF02G46ZH.3.4.A04.1.454.CMB.1.raw
  modified_base (270)..(270): a, c, t, g, unknown or other
  misc_feature (270)..(270): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcgttgggttttcctcggttgtcttcttttaagaggttgtccaggtgccaggtgcagtcgtggtggagtcgtgggggaggcgtcggcccagccgtgggacgtcccgaggaacctctcctagtacngtctcgtggattcgacgtttaggtactatcgctagtcgaccgtacgtcggggtccccggccgggtaccgtccgacgggaccggaacggggggtcgtaggggtaggttgggggtcggtacgttaacggtttaagtaccgttacccgtaagttcggtaggtaaggggacggtacgtaaagggttaaaaccttccggtaaaccgtccgtaaacgggttaacccttcccgggtaacgggtaaccggggtacccgtaacgtttacccgaaaccgtaccgttaccccgtaccggaaaggtaacgtaaaccgtaaacttaacccgaaacgtaaacctacggtacctaagtttactacgttacgaactaaacgaacggtaaccacgtaccgtaaggaacgacggtacgtaacggaacggaccgtaacgggtccgttagttacggttaccgtttacggtgaccggttacgaggaagtacggtggttaaccgggttagggtctaaacggttacgggg

SEQ ID NO: 230697 - DNA, 643 bp, Homo sapiens
  misc_feature: GYAE6OF02JO11E.3.4.A04.1.454.CMB.1.raw
  modified_base (169)..(169): a, c, t, g, unknown or other
  misc_feature (169)..(169): n is a, c, g, or t
  modified_base (177)..(177): a, c, t, g, unknown or other
  misc_feature (177)..(177): n is a, c, g, or t
  modified_base (539)..(539): a, c, t, g, unknown or other
  misc_feature (539)..(539): n is a, c, g, or t
  modified_base (609)..(609): a, c, t, g, unknown or other
  misc_feature (609)..(609): n is a, c, g, or t
tcagagacgcactccacgaccggtgctcgatttagagtagtgatcaggggaggcgtcgtgggagacggagcccagcactggaagtcgccggtgtttccattcggtgatcatcactgaacacagaggactcaccatggagtttgggctgagctgggtttcctcgttgctnttttaagnggtgtccagtgcaggtgcagctggtggagtcggtgggggagcgtggcccagccgtggggacggtcccaggactctccgtgtcacgtctctggactcctaccttggttacctagtcgtactgtgtaccgtacgtcgggtcccgccgggtactccggacggaccggaagggtccgagggtcggtgggtggcgtaggttaactcgtaacccgtgcgagttgggaggcgtaacgtaaacgttcgacggtacacgtaccgtcggtacggtagggtacccgtacgtaccgtaccaacggtttccaacctacgggactacgtaaaccttaccgaaagaaccgtcgaacgtcgtactcgtagacctaaancgacgagtccgaagttcgagtcgagacgacgtacgcgttggtacgtcttacgtgggcgtacggtacgganaggtaccgtaggtccggttaagacggtttaacgg

SEQ ID NO: 230698 - DNA, 824 bp, Homo sapiens
  misc_feature: GYAE6OF02F2RHL.3.4.A04.1.454.CMB.1.raw
  modified_base (119)..(119): a, c, t, g, unknown or other
  misc_feature (119)..(119): n is a, c, g, or t
  modified_base (815)..(815): a, c, t, g, unknown or other
  misc_feature (815)..(815): n is a, c, g, or t
tcagagacgcactccacgaccggtgctcgatttagagtagtgatcagggggatcaggactcctcagttcaccttctcacaatgaggctccctgctcagctcctggggctgctaatgctntgggtcccaggatccagtggggatgttgtgatgactcagtctccactctccctcgcccgtcaccgttggacagccggcctccatctcctgcgaggtctagtcaaacgcctcgttatacagtgagtaggaaacctaccgtacttagaagttttggtttccgagcgtaggaacgggtccgaacgggacccaagttccgttacccgaaacgggcccgtaccgttaaacttaccgtaaagttttaaacggggttttacccgttaaaccccgggggtaacgtccgggttaccgggggttacccccaacggaaccgtaaggtaacgtttccgaaacgggtccggacccgtaacgggttacggggttaccgacggggtccctaacgttacggttaacctttccgaaccgtaacgtacggtaagtaaaacggttacggacggtagggggttacgggtaggtcggttacgggtagggttaacggttgggtttagggtttaagtttttaacgttttcgtaagtcgtaagttccggtacgtaaacgttacccgtaacgtaaaccgtaccggggttacgggttaacccgtttaaccttacggggtttttaccggaaccggggtaaccggggaaccgtaacgggttaccgtaaggggaccgtaacgtaacgaaaccgttacgtaggtacggtacgtcgacgtacccgtnttaacccgg

SEQ ID NO: 230699 - DNA, 828 bp, Homo sapiens
  misc_feature: GYAE6OF02IRU98.3.4.A04.1.454.CMB.1.raw
tcagagacgcactccacgaccggtgctcgatttagagtagtgatcagggggagctctgggagacgagcccagcactggaagtcgccggtgtttccattcggtgatcatcactgaacacagaggactcaccatggagtttgggctgagcttgggttttcctcgttgcttcttttaagaggtgtccagtgccaggtgcagcttgggtggagttcggtggggggacggtcggtcggccccgaggcccggttaggggaccggtacccgaagggtaacctccgtaccgtagtaccaggttcctcgttggactttaccgtaccgtttaaggttaccttatcggtacttagtcgccgtaacggttccgggggtcccgcccggggtactcccgaagggggccggtaaaggggggtccttacgggggtagggttcggggggtacggtacgttaacggtttaagttaccgtacccgtaaggttacgggtaggttaacggggaggtacctaaaacggttaaaaccttacccgtacggtaactaccggttaaccggttaccgggttaaacggggaaccggggtacccggttaactttacccgaaacccttacgttacccgtaacccgaaggtaaacgtaaacccgttaaacgttaaaccccggaaacgtaaaccgtacccggtttacgtaaggttaacctacgtacgaaacgtaactaacggtaacgtacgaccgtaggacgacgtacgaggaacggcgtaggaccttaggttacgtacgttacgtcggacggtacggaaagtcgttagtgggtaaggtcgggttaacgaggttaacggg

SEQ ID NO: 230700 - DNA, 707 bp, Homo sapiens
  misc_feature: GYAE6OF02GK4TY.3.4.A04.1.454.CMB.1.raw
  modified_base (159)..(159): a, c, t, g, unknown or other
  misc_feature (159)..(159): n is a, c, g, or t
tcagagacgcactccacgaccggtgctcgatttagagtagtgatcagggggagctctgggagacgagcccagcactggaagtcgccggtgtttccattcggtgatcatcactgaacacagaggactcaccatggagtttgggctgagctgggttttccncgttgctcttttaagaggtgtccagtgccaggtgcagctggtggagtcgtggggggagcggtggccccaggccctggggacggtcccgagggaaccttcgtccctgttaaccaggttcctactgggatttccaacctttaagggtttaacctagtcggtctaagtcgctaactggggtaccccgtccggggctccgaggcgaagggggctgggaggtggggtggctaggtttactatcccgagtggactgggacggataacgtaaaactcccgtaggacctaagtaccgtccggtaggaaacggggtcccgtagtttacccgacctaatcctaccgaagtaacgaactaaacttccgaaacgtaaccacgtcttagttaacgtctagtaacaaattacggaaacctagtacccgttaggaagacgtaccgtagaacgggtacgacggtacgttaggttacggttaactttaccggtggggtaacggtaccgaagggtacgtacggttacggtaagggttacggggttacctaacggtttaaaccgggg

SEQ ID NO: 230701 - DNA, 803 bp, Homo sapiens
  misc_feature: GYAE6OF02JZ62D.3.4.A04.1.454.CMB.1.raw
  modified_base (157)..(157): a, c, t, g, unknown or other
  misc_feature (157)..(157): n is a, c, g, or t
  modified_base (174)..(174): a, c, t, g, unknown or other
  misc_feature (174)..(174): n is a, c, g, or t
  modified_base (177)..(177): a, c, t, g, unknown or other
  misc_feature (177)..(177): n is a, c, g, or t
  modified_base (301)..(301): a, c, t, g, unknown or other
  misc_feature (301)..(301): n is a, c, g, or t
  modified_base (379)..(379): a, c, t, g, unknown or other
  misc_feature (379)..(379): n is a, c, g, or t
tcagagacgcactccacgaccggtgctcgatttagagtagtgatcaggggagctctgggagacgagcccagcactggaagtcgcggtgtttccattcggtgatcatcgactgaacacagagtactcaccatggagttggctgagtctgggttttccncgttgcttactttaagngtntccagtgccagtgcagcgtgtggagtcgtggggagcgtggcccaggccgtgggacgtccaggtacctctcgtgtacgtacgtctcgtgtacttcgtaaccgttacggttactagtcgtacgtancgtccacggttcgggtacccggtaccggtcgtaccgacggtaccgtaacggggtccgttcggtacgggttaccggggngtaccgtaacggtttacgtacgtccccgtaaggttcgtaacgtacggggtaaccgtaccgtaaaggttaacccttaacggacccggtaacaacggtaccgttacggaggtaaccggtacgtactacgtaaccgacttaccgtacgaacggtaccgtaaacgtaaaccgtacgtaaacggaacctaacgtacccggtacggttacccgtattacccgggaataaacggtaacgtaaccgtaccggtccgttaacgggtaacgaacgttaccggttaacggaaccggttaacccgtaccggtagttcggggttactttaacccgggtaacttacggggtaaaccggtaccggggttaacgtaacccggttaggtaaccgggtttaacgggtacgggtttaaaccgggttactttaaacccgggggg

SEQ ID NO: 230702 - DNA, 692 bp, Homo sapiens
  misc_feature: GYAE6OF02GVWLF.3.4.A04.1.454.CMB.1.raw
  modified_base (435)..(435): a, c, t, g, unknown or other
  misc_feature (435)..(435): n is a, c, g, or t
  modified_base (549)..(549): a, c, t, g, unknown or other
  misc_feature (549)..(549): n is a, c, g, or t
  modified_base (576)..(576): a, c, t, g, unknown or other
  misc_feature (576)..(576): n is a, c, g, or t
  modified_base (641)..(641): a, c, t, g, unknown or other
  misc_feature (641)..(641): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcgtggttttccgtcgttagctctttaagaggtgtccagtgccaggtgcagcttgggtaggagtcgtgggggaaggcgtgggcccaggccttggggacggtccccaagggtaacctccgtaccgttagacctagttccttacgtaggtactttaccgaaccgtttaagggtttaccttagttacgtacttaagttccgactacgtttcgggggacccggcccggggtctaccggtaagggccgaacgggggtctagggtagggtggggtacggcgtaaggttacttaacncccgttagtcgtaggtacgggacgtaagtaagtaaacctccggacgtacgacggactacggtacgaaggccgtactcaacactctaccgaagaagtacctaactaccaaacganaccgatgtacctactacgaactaacgngtaaccacgtacgagtacgagtacgtaggaccgacgagtcgttgttaggtaacttacggtacggngtaaggtaacgtagaccggttggacggtacggtacggttaagtaaaccggg

SEQ ID NO: 230703 - DNA, 623 bp, Homo sapiens
  misc_feature: GYAE6OF02HWIW4.3.4.A04.1.454.CMB.1.raw
  modified_base (158)..(158): a, c, t, g, unknown or other
  misc_feature (158)..(158): n is a, c, g, or t
  modified_base (174)..(174): a, c, t, g, unknown or other
  misc_feature (174)..(174): n is a, c, g, or t
  modified_base (256)..(256): a, c, t, g, unknown or other
  misc_feature (256)..(256): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttccncgttgctcttttaagnggtgtccagtgccaggtgcagctggtggagtcgtgggggacgcgtggccccagccgtgggacgtcccaggactctctgtacngtctctggattcaccttaggtactatgctatgcacgtgggtccgccgggctccgaggcgaaggggctggagtggggtgcgtagttactactccatcggagtcggaggctaagtaaatcccgtagacgacgacctaccggtagggaaccgggtccgtaattacccgaccctattaccgtaccgaagtaacgtaaactaacgttacccgaaagaaccgtaaccggtctacgttactacgtacgaacctaaacgtacgaaacgcgtaccgtaggacgaacgtcgtaggaacgacgacgggtacttacggtagtaacgtttagtggtacgtcggtagacgtagtaggtagtacggggttacacgttaacgg

SEQ ID NO: 230704 - DNA, 994 bp, Homo sapiens
  misc_feature: GYAE6OF02F3LUK.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagagactcaccatggagtttgggctggagtcgttgggttttcctcgttgtccttacgtttttaaggagggttgtaccgaggttacgcccgtaggttcgccaggtcgtgggtgggtaggtcggtggggggacggtccggtcggacccgacgtccggtggggacggtcccgaaggaccttcgtccgtagtacgtcgttacctcgtaggtacttaccgtaacgtttaacggtttacctagtcgtacttaagtcggacgtacggtccggggttcccgggaccgggtcctccggaggaccgggtaaggggcgtgggaggtcggggtcgacgtaagttactacgtcccgtagtcggtacgtaggtaggactaagtaacctaccgtagactacgtacctcggtacggaacggtcctacgttaccaaccgttactacccgtacgtaacgaacgtaaccgtaaaccttaacccgaaacgtaacgtacccgttacgtaacgtttaccgtacgtaacggtaaacgttaaaccgttacgaaaccgttacccgtacggtaacgaaaccgggtaccggtaaaccgttaaacgggtaaacccgggtaaaccgttaaccggggttacccggtttttaaaacggttaacggttttttaaaacccccgggttaaaggggtttttacccccggggggttaaaacccgggggttaaaaccgggggggggtttaaaaaaccccgttttaaaacgggggggggttttaaacccggtttttaaaaaccccggggggggtttttaaaaaggggggggtttaaacccccgggggggtttttttaaaaaacccccgtttaaaaaacccgggggggttttttttaaaaaccccggggggggggg

SEQ ID NO: 230705 - DNA, 694 bp, Homo sapiens
  misc_feature: GYAE6OF02H2XOY.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcacatggagtttgggctgagtcgttgggttttcctcgttgtcttcgttttaagaggttgtccaggtcgccagggtgcagcgtgggtggagtcgtgggggagcggtcggcccaggccgtggggacggtcccgaggtacctccgtcctgtacagtctcgtggtattcctaccgtttaggttactatgcttatgcacgtcgggtccgccgggtctaccgaggacggaaggggtcgttagggagggttggggtggtaccgtaagtttacgtacgtacccgtagtagtacggtagggaacggtacgaaacgttaaacgtaccctaagacgtaacggtaccgttaccgggaggtaaccggggtaccgtactaccgacctactacctaccgaagacgaactaacgtaccgaaacgtaaccgacgtacgttacgtactcgtacgtaaacaacgtaacgaacgtacgaccggtagaacgtacgtacggtacgaacgggacgtaccggtactacgttacgttagttacgtggtaggacgtagtaggtacggtagtaggttacggtacgtacgttaacgg

SEQ ID NO: 230706 - DNA, 766 bp, Homo sapiens
  misc_feature: GYAE6OF02IXVXO.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatgggagtttggggctgagcgttggggttttccctcggttgtcttactttttaaggaggttgtccagtcgccgagggtgacaggctgggtggagtcggtggggggaggcggtcggcccaggcccgtggggacggtcccgaggtaacctctcctgtaccagtctcgtggtacttccgtaccgtttaggttactatgtctatcgacacgttcgggtccgccgggctaccggaggaccggaaggggtctagggacggtggggtcgtacgtagttacttactacccgtagtggaagtcgggaggtacgaagttaactccgtacgacgtacgtacctcggacgggaaccgggtcgtacttaccgacctactccgtacgagtacagtaacctaccgaaacgaacgacgtacgtactacgtctacggtaaactaaacgtacgtaaaccgtcggtaccgtaacggtaggtaacgtccggtaacggtaaccgggtaaacccgtccggggttacttacggggtttaccgttttaaaccgtaccgggttacgggttaaccgggaaccgttaaaggggttacggtaaggttccggggtaaacggggttttaccgggggtaaacccgtttaacgggtttaaaaccggggg

SEQ ID NO: 230707 - DNA, 819 bp, Homo sapiens
  misc_feature: GYAE6OF02JWU55.3.4.A04.1.454.CMB.1.raw
  modified_base (176)..(176): a, c, t, g, unknown or other
  misc_feature (176)..(176): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggtttcctcgttgtcttcgttttaagnggtgtccagtcgcctaggtgacagcgtggtggagtcggtggggggtacggcggtggaccccaggtccgtggggaccggttccccgaaggtaacctcgtcctagtaccgtagtccttcgtaggtacttcctaccgtttaggttacctagttcgacttaagtcggtcctaaccggttcgggggcccgtccgggtacctaccccggtaaggggaccgttaaaccggggggcttaggggtacgggtcgggggttcgtaccgttaacggtttaactacgttccccggtaaggttcggtaggttacggggtacgggacttaaaacggtttaaccctaccccgggtaaagtcccgaaaggtccccggtacccggttaaggggaaacccggggttccctaaaccggtttcccaaacccgttacggttaccctacccggtaaacggtacggtaaaccttaaacgtaacccgtaaaacggaccgtaccgtacgttacggttactaaccggttacgaaccttaaaagaccgggtacctacgtaccgaaggtaacacgtacgtaacggaaccgtacgaccggtacttacggtagtttacggtacgtacggtagcggtaaagacgtaggtacgtagggtcgtacgtagtaaacggg

SEQ ID NO: 230708 - DNA, 849 bp, Homo sapiens
  misc_feature: GYAE6OF02GKNOC.3.4.A04.1.454.CMB.1.raw
  modified_base (177)..(177): a, c, t, g, unknown or other
  misc_feature (177)..(177): n is a, c, g, or t
  modified_base (187)..(187): a, c, t, g, unknown or other
  misc_feature (187)..(187): n is a, c, g, or t
  modified_base (518)..(518): a, c, t, g, unknown or other
  misc_feature (518)..(518): n is a, c, g, or t
tcagagacgcactccacgaccggtgctcgatttagagtagtgatcgaggggagctctgggagacgagcccagcactggaagtcgccggtgtttccattcggtgatcatcactgaacacagaggactcaccatggagtttggctggagcttgggtttcctcgttagcttctttaaggngtgtccagtnccgtaggtgcagtctggtgagtcgtgggggagcgtggccagcctgggacggtccaggactcgtaccgtgtaccgagtctcgtacggtacttacgtaccgttaacggtttaactagttacgtaccttaagtcgtacccgtaacgttcgggggttacccggcccgggtaccgtcccggtaacggggacggaaaccggggggtccgttaggggagggttcggggtacggtaccgttagggtttactaacgttcccgtaaaggtgggtacgtggggtaacggtccgtaaaacggttaactacccgtaggacctaaacggtccctttaacccgggngggaaaccgggttacccggttaccgttacctaacccgtaacgttacccgttaccaacggaacgtaaaccgtaaaccgtttaaccggaaacgaaccgttacggtacctacgttaaacgttccgtaaacggtaccaaagtttaccgaaccgtacggtaacccgtaggagaccggttaccaacggggtaccgaaaccgggccggttacgttacggtttaacggttaaccgttttaaccgggtggtaacccgggttaacggaacgtttaaaccggggtagttaaccggggttaggtttaacccgggtaacggtttaacccggtttaaaacggggg

SEQ ID NO: 230709 - DNA, 912 bp, Homo sapiens
  misc_feature: GYAE6OF02FNGED.3.4.A04.1.454.CMB.1.raw
  modified_base (197)..(197): a, c, t, g, unknown or other
  misc_feature (197)..(197): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttcttttaaggaggtgtccagtcgccagggtncgagcgtgggtcggagttcgtggggggaggccggtggcccagcccgtgggacggtcccgaggacctcgtcctgtacagttctcgtggtacttacctaaccgtttaggttactagttcgtacttaagttcgaccgtacgttcgggggtccccggccggggtccttacccggaggggtaccggtaaacggggggtcgtttacgggggacgggttgggggtacggtaccgtaaggttttaataccgtacccgtagtagggtaacggtagggaacggtacgtaaacgtttaaaaccgtccgtaacggtaccgaaacggtccccgttaccgggtaacggggtaacccggggtacccgtttaaccgttaaccccgaaccccgtactttaccccggtaacccgtaaagggtaaacccgtaaaacccggtttaaaccgtttaaccccgaaaaaaccgggtaaaccgtaacccggtttaacgtttaaccggtttaaaccgtacccgtttaacggaaaaccgttaaacgtttaccgggaaaacccgttcgttaacccggaaggtaaccggtaacggtacccggttaaggaacccggtacgggtaaccgttacgggttcggttacggtttaaaccttcggttaagggtacccggaaggtaacggtacggttacggttaaacgggtccgggtttaaggggtaacccgttaaaggtttaacccggggg

SEQ ID NO: 230710 - DNA, 703 bp, Homo sapiens
  misc_feature: GYAE6OF02FQTII.3.4.A04.1.454.CMB.1.raw
  modified_base (157)..(157): a, c, t, g, unknown or other
  misc_feature (157)..(157): n is a, c, g, or t
  modified_base (207)..(207): a, c, t, g, unknown or other
  misc_feature (207)..(207): n is a, c, g, or t
  modified_base (253)..(253): a, c, t, g, unknown or other
  misc_feature (253)..(253): n is a, c, g, or t
  modified_base (258)..(258): a, c, t, g, unknown or other
  misc_feature (258)..(258): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagttgggctgagctgggttttccncgttgctcttttaagaggtgtccagtgccaggtgcagctggtggagtcgngggggagcgtggcccagccgtgggacgtccaggactctcctgtacngtctnggtatcacttaggtactatgctatcgcacgtcggggtccgccgggctaccggaggcgacggggctgggaggtggggtgctagtagtactccgatgacgtgggacggctaagtaaactccgtacgacctaggaccgtaccggtacgggaacgggtccaacgtttccgaacccgtagttcctaccaggtaaacgaaccttaacgttaacccggaaacgtaaccggtacgtacttaaggttccgttactaggaaccttaaaagtacggaaaccgtcggtacccgttaagggaacgacgggttacccgaaggggaacccgtaacgggaccggttcgtttacggttaacggttttaaaccggtccggtttacgggtacggttaaccgggtaaggaagggtacgtttaacgggggatttaaccggggggtacgtaaagggtttaaccgggg

SEQ ID NO: 230711 - DNA, 664 bp, Homo sapiens
  misc_feature: GYAE6OF02GSIX3.3.4.A04.1.454.CMB.1.raw
  modified_base (174)..(174): a, c, t, g, unknown or other
  misc_feature (174)..(174): n is a, c, g, or t
  modified_base (291)..(291): a, c, t, g, unknown or other
  misc_feature (291)..(291): n is a, c, g, or t
  modified_base (336)..(336): a, c, t, g, unknown or other
  misc_feature (336)..(336): n is a, c, g, or t
  modified_base (543)..(543): a, c, t, g, unknown or other
  misc_feature (543)..(543): n is a, c, g, or t
  modified_base (625)..(625): a, c, t, g, unknown or other
  misc_feature (625)..(625): n is a, c, g, or t
tcagagacgcactccacgaccggtgctcgatttagagtagtgatcagggggagctctgggagacgagcccagcactggaagtcgccggtgtttccattcggtgatcatcactgaacacagagactcaccatggagtttgggctgagctgggttttcctcgttgcttctttaagnggtgtccagtgccaggtgcagcgtggtggagtcgtgggggaggcgtcggcccagccgtgggacgtccaggtaactctcctgtacagtctctggtattcacttaggttacatcgctangcacgtcggtccgccggcctcgaggcgaagggctagggagtgggngactagttatacgccaagtcgagtggagactacgtaaacgtcctagaccgaggtaccgtccggtaaggaccgggtcctagttaccgactacgtccgtaccgaagtaacgtaacctaacgttacccgaaaagtaaccgtaaccgtccttacggtactacgtacgtaacaaagttacggaaacttacggaccgttaggacgtaacggtnacggaacggtacctacggggttccttaaggtacgtttaacggttaacggtcggttcgggaaccggtaaggaacggttaacgngggttaacgggtcgggttaacgtaaggttaaacccgggg

SEQ ID NO: 230712 - DNA, 758 bp, Homo sapiens
  misc_feature: GYAE6OF02GR82H.3.4.A04.1.454.CMB.1.raw
  modified_base (176)..(176): a, c, t, g, unknown or other
  misc_feature (176)..(176): n is a, c, g, or t
  modified_base (509)..(509): a, c, t, g, unknown or other
  misc_feature (509)..(509): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagttgggctgagtcttgggtttcctcgttgcttcgttttaagnggtcgtccagtcgccgaggtgcagcgtgggtggagtcgtgggggaggtcggtcggcccaggccgtggggacgtcccgaggtaacctcgtaccgtgtacgacgtctcgtggattcccgtaacgtttacggttacctattggtccttaagtcgtcgtaccggttcggggtccccggtaccgggcctccgacgggaccgtaaacggggggtcgttagggaggttacggggttcgggccgtaaggtttacaccgtccgtagttacggagtgggaagtacgaagtaacgtcgtaccgacgtagaccgtccggaggaacgggtcccgtaactttccacncgttctaacccgagaaaccgactaaacgttaccaaacggacctacgtacgttgtaacctacgtcgaaacctaagttaaccggataccggtccgtaaggtaaccgggtatacccggtaaaggaccgggtaaccgaccggggtttactaacgggttacggtttaaaccgtttacgggttcggtaacggttaaggaaccggtaacgtagggttaaccggtagggttaacgggtacgttaaacgttaacgggg

SEQ ID NO: 230713 - DNA, 681 bp, Homo sapiens
  misc_feature: GYAE6OF02HPBXH.3.4.A04.1.454.CMB.1.raw
  modified_base (343)..(343): a, c, t, g, unknown or other
  misc_feature (343)..(343): n is a, c, g, or t
  modified_base (361)..(361): a, c, t, g, unknown or other
  misc_feature (361)..(361): n is a, c, g, or t
  modified_base (390)..(390): a, c, t, g, unknown or other
  misc_feature (390)..(390): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttcttttaagaggtgtccagtgccaggtgcagcgtgggtggagtcggtggggggaggcggtcggcccacggccgtgggacggtcccgaaggactctcctggtacagtctgtgtacttcctaccgtttaggttactatgctatgcacgtgggtcccgccggctccgaggcgaggggcgngggtacggtgggtacggngtagttactactaccgagtgagtcggganactaaggtaaactccgacgtacaacgtccgtaccggtagggaaccgggtcctaacttcccaacctactacccgtcgaagaccgtaaactactaaccgaaaacgtaacgaccgtactacggttaacctacgtacgaaactaaagtacgaaactaccggacgtagtaacggacgtagtaaacgggaaccggtacgtaccggtcgttagttttacgttaacttaccggtggtaccgtaacggtaggtaacggttagtacggtacgggtacgggttacgtaacgtttaaacgggg

SEQ ID NO: 230714 - DNA, 812 bp, Homo sapiens
  misc_feature: GYAE6OF02HBZIN.3.4.A04.1.454.CMB.1.raw
  modified_base (201)..(201): a, c, t, g, unknown or other
  misc_feature (201)..(201): n is a, c, g, or t
  modified_base (203)..(203): a, c, t, g, unknown or other
  misc_feature (203)..(203): n is a, c, g, or t
  modified_base (205)..(205): a, c, t, g, unknown or other
  misc_feature (205)..(205): n is a, c, g, or t
  modified_base (218)..(218): a, c, t, g, unknown or other
  misc_feature (218)..(218): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccagtggagtttgggctgagtcgttgggttttcctcgttgcttacgttttaagaggtgtccagtcgccgaggtncngntggtggagtcggngggggagcggtcggccagccgtgggacgtcccaggacctctaccgtgtaactgtctcgtggtattcctacgttacgtaacttatcgtctatcgctacgtcggggtcccggcccgggtcctaccggtacggacggaacgggggtccgtaggggtggtacgggggtcgggtacgtaaggtttaaccgtaccgttacccgtaagttaggaggtaggggacgggaacgttaaaggttaaaacctacccggtaaccgtaccgaagtacccgttaccggtaaccggggaaccgggacccggttaacctacccgtaacctaccttaaccgtacccgaacggtaaaccgaaaccgttaaaccgtaacccaaaacccggtaacgttaaccgtaccggttacgttaactaccgtagaaacctaaacgaacgtaaccgaacggtacccgtggaaacgtacgtacgtaaacgggaaccggtacgccggtacggttacgttaaggtttaacggttaacggttagggtacggaaacggtaacgggtaaggtaacgggttacgggtacggttttaacggggttaaccgtaacgggttttaaacccgggg

SEQ ID NO: 230715 - DNA, 639 bp, Homo sapiens
  misc_feature: GYAE6OF02H3GQN.3.4.A04.1.454.CMB.1.raw
  modified_base (177)..(177): a, c, t, g, unknown or other
  misc_feature (177)..(177): n is a, c, g, or t
  modified_base (180)..(180): a, c, t, g, unknown or other
  misc_feature (180)..(180): n is a, c, g, or t
  modified_base (190)..(190): a, c, t, g, unknown or other
  misc_feature (190)..(190): n is a, c, g, or t
  modified_base (208)..(208): a, c, t, g, unknown or other
  misc_feature (208)..(208): n is a, c, g, or t
  modified_base (219)..(219): a, c, t, g, unknown or other
  misc_feature (219)..(219): n is a, c, g, or t
  modified_base (299)..(299): a, c, t, g, unknown or other
  misc_feature (299)..(299): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcacatggagtttgggctgagcgtcggtttcgcgtagcgtactttaagcggtnacngtgacgtagncagcgtggtagagtcggngggagtccggngaccgtagcgtaggacgtaccgagtactcgctagtacagtcagtagtacttacgtacgttaacgtatactagtactagtntacgacgtcggaccgaccggtctacggaacggacgaaggtcctagggtagggttaggacgtagttacgttactaaccggccgtaatcggtaatacgggaagtaacgtaacgtaaccttaccgaagcgtaacgaccggttacgtacgggaacgtaccgtactacacctacgtcgactacgacgactataaccgataacgacgtacgtacgtagcgtacgaactaacgtagaacgtacgacgaagacgaccgtagacgaacgacgtacgtagttacgagtttcggtaaccggttcaggactacgtacgacggtacgtaggttacggttacgtaccgtaacgg

SEQ ID NO: 230716 - DNA, 808 bp, Homo sapiens
  misc_feature: GYAE6OF02F8IL6.3.4.A04.1.454.CMB.1.raw
  modified_base (238)..(238): a, c, t, g, unknown or other
  misc_feature (238)..(238): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagtcgtggtttcctcgttaggccttcgttttaagaggtgtccgagtcgctaggtgcgagcgtgggtggagtcgtgggggacggcggtgccccgngaccgtgggacgttacccgaggttaacctcttccttagtaccagttccttgtcgtaacttccgtaaccgttttacggttaattacgttactaccgttaagtcgttacgaaccgttcggggttcccggccggtacgtaccgagggtaccgaaggggtcgtcggaggttgggcgtaacttagttacgtaccgaccgtagtaatcggtgggaaccgtaacgtaaacggttatacccgtaacgacctagggttaacccgtccgaacgggtaaccgtaccgtaacccgttaccgtaacctacctaccccggtaactaacgacgtaaaccgtaaccgttaccccgaaaggtaacccaacgtccgttaacgttacgttaacgacgttaaccgtaaagccgttaaacgaccgttaaccgacgtaacggtagtaaccgtcgaaaccgggtacgtaccggttacgttacggttagtttaaaccggtaccgttaagggacccggttaagggtaaaccttacggggaatttaccggggtaacggttaacgggttaaccggtaaacgggttttaaacccgggg

SEQ ID NO: 230717 - DNA, 734 bp, Homo sapiens
  misc_feature: GYAE6OF02F0MZ8.3.4.A04.1.454.CMB.1.raw
  modified_base (255)..(255): a, c, t, g, unknown or other
  misc_feature (255)..(255): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtgggggagcgtggcccagccgtgggacgtcccaggactctcctgtacngttcctcgtaggacttccaccgtttaaggttacctatcgcttatcgcacgtcgggtcccggccggtcctaccgagggacgaaggggggtctaggggtaggtcgggggtggtactaggtttactaaccgtcccgaattcggagttgggaaggtccgtaaagttaaacgtccctacgcaacggtacctccggtacgggaaacgggtccgtacgttccaacctactacccgtacgaacgtacgtaacctaaacgttaccgaaacgtaacctacgtacgttacgtaactcgtactaacgtaaacgtacgaaaccgtcgtacccgtaaggaacgtaacggtcgtaacgggtaacggacccgaccggggttcgttaacggttacgggtttaaacgtttaccggttaacgggtaccggtaccggtaaaggtacggtacggttaacgggtacggttacgggggttaacctaaggtttaaacccgggg

SEQ ID NO: 230718 - DNA, 668 bp, Homo sapiens
  misc_feature: GYAE6OF02IYTST.3.4.A04.1.454.CMB.1.raw
  modified_base (203)..(203): a, c, t, g, unknown or other
  misc_feature (203)..(203): n is a, c, g, or t
  modified_base (282)..(282): a, c, t, g, unknown or other
  misc_feature (282)..(282): n is a, c, g, or t
  modified_base (304)..(304): a, c, t, g, unknown or other
  misc_feature (304)..(304): n is a, c, g, or t
  modified_base (306)..(306): a, c, t, g, unknown or other
  misc_feature (306)..(306): n is a, c, g, or t
  modified_base (582)..(582): a, c, t, g, unknown or other
  misc_feature (582)..(582): n is a, c, g, or t
tcagagacgcactccacgaccggtgctcgatttagagtagtgatcaggggagctctgggagacgagcccagcactggaagtcgccggtgtttccattcggtgatcatcactgaacacagagactcacatggagtttggctgagtcgttcggttttcctcgttcgtacttacgtttaagcggtgttccagtcgccgtaggtcgnagtcgtgggtggaggtcggtagggggacgtcggtcgcccgggtccgtgggacgtccaaggtactctcgtgtaactcgtntcgtgtacttctacgttgtatntnctatgctacggtcggccgcgacgtccgtaggcggtaaggcgtgggtagtgggtgaaccgtttagtattccgaccgtaggtcgaacgggtggtaaaccgacgtaaagtacctcggtaacgcgaacgttcgtaaccggagggtaccgtacgtactaaccgacgtacgtaccgtacccgtaaggaacctaccgtaaaccgttaaccgaaagtacccgtacgttaacgtacgttaactacgtaacgaacgtaagtacgaaaccgacgtacgtagaacgancggtagacgtaaccgtacgcgttacgttacgtacgtagttcgagtaccgtagtagtacggttcgaggtacggttacgtaggtaacg

SEQ ID NO: 230719 - DNA, 778 bp, Homo sapiens
  misc_feature: GYAE6OF02I2JQQ.3.4.A04.1.454.CMB.1.raw
  modified_base (90)..(90): a, c, t, g, unknown or other
  misc_feature (90)..(90): n is a, c, g, or t
tcagagacgcactccacgaccggtgctcgatttagagtagtgatcagggggagctctgggagacgagcccagcactggaagtcgccggtntttccattcggtgatcatcactgaacacagaggactcaccatggagtttgggctggagcttgggttttcctcgttgcttcgttttaaggaggtgtccagtcgccagggtgcagcgtgggtggagtcgtgggggagcgtggcccagccgtgggcggtcccaggactctcctgtacagtctctggtattcacttacgtactatgctatcgactcgtcggggtccggccgggacgtccggacggcggaacgggggtcggtacgggagggttggggtacggtacggtaagtttacgtactcccgtaagtggacgttaggggtacggacgttaaacgtaaactttcccggtaacgacgtacggtaaccgttcggggtaacgggtaccgggggaccgttaaacgtacccgaacccggttacttaccgaccgtaaacgacggtaaacctaaaccgttaacccgaaacgaacccgttaacggtacttaacggttaaccttacgacgtaacgtaaacttacgaaccgttacggacccgttagggaaacgacgtacgtaggaaaccgggacgtacccgggtaccgtttaagggttaccgttaacggtttacggtacgggttacgaacgggtacgggtaaggtaccgggttagggttaaggggtttccggggttaacttaacccggtttaaacgggggg

SEQ ID NO: 230720 - DNA, 742 bp, Homo sapiens
  misc_feature: GYAE6OF02IH9E8.3.4.A04.1.454.CMB.1.raw
  modified_base (220)..(220): a, c, t, g, unknown or other
  misc_feature (220)..(220): n is a, c, g, or t
  modified_base (363)..(363): a, c, t, g, unknown or other
  misc_feature (363)..(363): n is a, c, g, or t
  modified_base (439)..(439): a, c, t, g, unknown or other
  misc_feature (439)..(439): n is a, c, g, or t
  modified_base (461)..(461): a, c, t, g, unknown or other
  misc_feature (461)..(461): n is a, c, g, or t
  modified_base (477)..(477): a, c, t, g, unknown or other
  misc_feature (477)..(477): n is a, c, g, or t
  modified_base (628)..(628): a, c, t, g, unknown or other
  misc_feature (628)..(628): n is a, c, g, or t
  modified_base (634)..(634): a, c, t, g, unknown or other
  misc_feature (634)..(634): n is a, c, g, or t
  modified_base (701)..(701): a, c, t, g, unknown or other
  misc_feature (701)..(701): n is a, c, g, or t
tcagagacgcactccacgaccggtgctcgatttagagtagtgatcaggggagctctgggagacgagcccagcactggatcgccggtgttccattcggtgatcatcactgaaccacagaggactacacctagtgggagttttgggctggacgtcgtttcgggtttttcctcgttgcgtttacttttaaggagggtcgtaccctaggttcgaccgaggtcgngacgtcgtaggggttggacggtcgggtagggggggacgtccggttcgggacccgaggtccggttaagggacggttaccccgaaggtaccttcccgtacgtggtacgtcgttacgtcgtagtacttacggtacctttaggtacngttcgactatcggtccgtacggtcgggtacccgccggtccgtacgaccggtacggtaacggtcggtacgggtaggnggtacgtacgtacgttttaacncgttaccaggttacgngtacggggaacgtacgttaaacgtaacggttacaccggggtaacttacggaccgttaacgggtagggtacccggtaactacgttcgaacgttacgtacgtaacgacgtacgtaactacgtacgaacgtaccgatacgcgtactacagtaanacgtanactacgacgtgacgacgtagacggcgtacgaggtgtacggttacgtaaggttccgtagtagtacggngtacggaggttcggaacggtacggtacggtaagttaacggg

SEQ ID NO: 230721 - DNA, 743 bp, Homo sapiens
  misc_feature: GYAE6OF02I3FRE.3.4.A04.1.454.CMB.1.raw
  modified_base (186)..(186): a, c, t, g, unknown or other
  misc_feature (186)..(186): n is a, c, g, or t
  modified_base (291)..(291): a, c, t, g, unknown or other
  misc_feature (291)..(291): n is a, c, g, or t
  modified_base (555)..(555): a, c, t, g, unknown or other
  misc_feature (555)..(555): n is a, c, g, or t
tcagagacgcactccacgaccggtgctcgatttagagtagtgatcaggggagctcgtggggagacgagcccagcactggaagtcgccggtgtttccattcggtgagtcatccactgaacacagaggactcaccatggagtttgggctggagcgttgggttttcctcgttgaccttacgttttaagnggttagtccagtcgcctagggtgcagcgtgggtggaggtcgtgggggagcgttcggcccgaggtcccgtggggacggtcccaaggaaccttcctccgtggtaacngttcgtccgtaggtcttacgaccgtttaggttaactcttgtccttagtcggtactaccggttcggggtcccggcccgggtaccgtccggacgggaccgggtaacgggggtccgttaggggacgggtcgggtcggtaactaccggtttaataaccgtcccgagttagaacggacgggaacggtactaacgttaaacgtccgtaacggccgtaacgccggttacggtagaaccgggtcttactacccgtactacgtcctacggaanacgaacctaaacggttaccaaacggtaactacgacgttacgtacttcgacgtaacaagtaaccgtacggtacacgtacgaaggcccgttagcggtaaacggaccttaggtcgttaggttacgttattccgggtgtaccgttagggaactaggttagtccggtaggtaccgggttacaggttaaccggg

SEQ ID NO: 230722 - DNA, 816 bp, Homo sapiens
  misc_feature: GYAE6OF02HO210.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcacatggagtttgggctgagcgtttgggtttttcctcggtttgtcctttacgtttttaaaggacgggttcgttaccgtaggttcggccgtagggttcgacacggtcgttgggttagggaggttcgggttaggggggacggtccggtcgggaccccgacggtccggttacgggggaccgggtaccccgtaaacgggtaacccttccgttaccgttacgggttaaccgtaacgttcctaacggttcggttaacttccgttaaccgttttaacggttacgttacttcggtacttaagtcggtacgtaccgggttcggggccccggtccggtccgtacggacgggaccgggtaaggggccgttaggggtagggttggggtacgaccgttaagttacgtaaccgtcctaggtaggtagtagggacggtacgttaaaagtaaccttaccgtaccgataacggtaccgtacggtacgggaaccggtacgtactccgaacgtcgtacctacgaagaactaacgtaaacgtaaccgaaacgtaacgtaaccgtactagttacgtacgcgtaaacgaataacgaacgtacgacgtaggacgacgtgacgtacggaactcggtagtacggttaattacggtacgttaggtcgtaagtacggtagtgtaacggtgggtaacggttacggtaacgtttaacggg

SEQ ID NO: 230723 - DNA, 880 bp, Homo sapiens
  misc_feature: GYAE6OF02HX6MZ.3.4.A04.1.454.CMB.1.raw
  modified_base (190)..(190): a, c, t, g, unknown or other
  misc_feature (190)..(190): n is a, c, g, or t
tcagagacgcactccacgaccggtgctcgatttagagtagtgatcaggggagctctgggagacgagtcccagcacgtggaacgtcgccggtgttccgattcggtgatcaatcactgaacacgagagactcacatggagttgggctgagctgggtttcctcgttagcttcgtttaagaggtgtacaggtcncaggtgcagcgtggtggacgtacggtagggggacgtcgtacggccctaggtcccgtaggggaccgtaccccgaaggtaacgtcctacgtacggtactaccgtccgtccgtcggtaacttccgtaacccgtttaagggttaaccttagtaccgtaccttaggtacgtcccgtaaccggttaccgggggtccccgggaccccgggtccggtaccccgtaagggggtccccggtaaagggggggtcccgttaagggggtaccgggtttacggggggttaccggtaaccggttaacgggtttaaccttaccggttaccccgtaaaggtcgggtaacggtacgggtaacgggacgtaaacggttaaaccgtacccgtaaacggtacgaacgtaaccggtaccggttaacgggacggtaccgtaacgtcccgtaacctaaccttccgaccgtaaggaacgaaccttaaacgtacccgtaaaacgaaccgtaaccgtacgttacggtaactaccgtaacggtaaccgtaaacgtaacgtaaacgtccggtaccgtaaggtaccggaacgtacggtacggaaccgggtaaccgtaccgggttacgttaggttaacgttacgtttacggtacggtacggtaagtaacggaggttacggttaggaaccgggtttacgggtacgtaacgtttaaaccgggg

SEQ ID NO: 230724 - DNA, 872 bp, Homo sapiens
  misc_feature: GYAE6OF02GNHH9.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagtctgggtttcctcgttgcttctttaagaggtgtccagtgcaggtgcagcgtggtggagtcggtgggggaggcgtcggcccaggccgtggggacgtcccgaggacctctcctgtacagtcctcgtagtacttcctacttacggttactactgctagtcgacgacgtcgggtcccggccgggtctccggacggtcggaaggggtccgtggggtacgggttcggggtcgggtacgttaacggttttaacgttaccgtaccccgttaaggttaggtaacggtcggggtaaacgggactttaaaacggttaaaacccgttcccgggttaaaaccggtacccgtaaaccggtttaacccgggttccggttaaacggggaaaccgggttcccgtaacgtttacccgaaccctaaccgtaccgttaacccgaaacggtaaccggtaaacgtaaacccttaacccggaaagttaaaccgtaacgtacggtaacctttacgggttaaaccttaccggtaaccgttaaaacgtaaacggttaccggtaaaaccgtacccgggtaaaccggtttagtaaacccggggacgttaaccgggtaacgggtaaaccgggaacggtaacccgggttccggtttagggttaaacccgttttaaagtttcccgttaggggttaagaccgggttaaagtaaggttacggttaagggtaaccggtttacggggtacctttaaagggg

SEQ ID NO: 230725 - DNA, 647 bp, Homo sapiens
  misc_feature: GYAE6OF02I7S21.3.4.A04.1.454.CMB.1.raw
  modified_base (523)..(523): a, c, t, g, unknown or other
  misc_feature (523)..(523): n is a, c, g, or t
tcagagacgcactccacgaccggtgctcgatttagagtagtgatcagggggagctctgggagacgagcccagcactggaagtcgccggtgtttccattcggtgatcatcactgaacacagaggactcaccatggagtttgggctgagcgttgggttttcctcgttgcttcttttaagaggtgtccagtgccaggtgcagcgtggtggagtcgtgggggagcgtcggcccagccgtggggacggtcccaggacctctcctgtacagtctctggattccaccgttaggttactatgctatcgcacgtcgggtccgccgggctccgaggccgaagggggctgggaggtggggtggctaggttatactccagtcgagtgggaggactaaggttaaactccgtacgcacgacctcggtagggaacgggtccgtaacttaccaccgtactccgtacgaagtaacgaactaacttaccaaacgaaaccacgtaccgttaagtacttacgtacgaactaaacgacgaaacncgtaccgtagaacggacgtcggtaggaaccggacgaccggtacttacggtagttaagtttaccgtggtaacggacggtaaggtaacgtacgtaggaggtttcggggaacgttacggttaacggg

SEQ ID NO: 230726 - DNA, 767 bp, Homo sapiens
  misc_feature: GYAE6OF02G0QD9.3.4.A04.1.454.CMB.1.raw
  modified_base (277)..(277): a, c, t, g, unknown or other
  misc_feature (277)..(277): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagtcttgggttttcctcgttgcttactttttaaggaggttgtccaggtcgccaggtgcagcgtgggtggagtcggtgggggacgcgtcggcccaggccgtggggacggtccaggtaacctcgtaccgtgtacngttcctgtggtacttcgtaaccgtttaggttactagtcgacttagtcgccgtacggttcggggtccccgggtacccggggtccgtaccggaacgggaccggggtaacgggggtccggttaggggtaaccgggttgggggtacgggtccgttaaaggtttacgtaccttacccgtagtggtaggtaggggacggtaacgtaaacggttaaacctccgtacgacgtaacgtaccgtacggtagggtaaccgggtaccgtacgttccaccgtaacttccgaacgaggtaacaacgtaacgttacccaaaagtacccgaacgtacgttacgtacctcgtacgtacttaacgacgaacgtccgtacaggtacggacgtaaggttacggaacggaccgtacgggtacttacgggttagttaaccggttacgttcggaacggtaacggaggttacgtacggttggtaaacgggttcggtacggttaacgtaaacggg

SEQ ID NO: 230727 - DNA, 762 bp, Homo sapiens
  misc_feature: GYAE6OF02J2ADX.3.4.A04.1.454.CMB.1.raw
  modified_base (184)..(184): a, c, t, g, unknown or other
  misc_feature (184)..(184): n is a, c, g, or t
  modified_base (500)..(500): a, c, t, g, unknown or other
  misc_feature (500)..(500): n is a, c, g, or t
  modified_base (631)..(631): a, c, t, g, unknown or other
  misc_feature (631)..(631): n is a, c, g, or t
  modified_base (652)..(652): a, c, t, g, unknown or other
  misc_feature (652)..(652): n is a, c, g, or t
  modified_base (730)..(730): a, c, t, g, unknown or other
  misc_feature (730)..(730): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcgttgggtttttccctcgttgtcttacgttttaacggnggttcgtccgtaaggtcgtcccgagggttcgctacggtgttgggtgggtacggttcggtggggggaggccggtcggccccgaggccgtggggaccggtccaacggtactccgtccgtagtaccgtacgtccgtcgtaggtactttccgtaacccgttttaaggttaccttagtcgtaccttagtacggtcctaccggtcgggtccccggccccggtaccgttaccggaagggtaccgggtaacggggcggttacggggtagggttcggggtcgggtacgtaacggtttacctaacggttccaaggttagggtacgngggtaacggacttaacggttaattacccggtacgacgttacggtacccgcggggtaacggtacggtaccgacttaccgaccctacgtcgtacccaggtaaccgtaactacgtaaccgaaacgacgttaccngtataccgcttagactaacgngaacctcgacaggtcaggccgtaggactacgaccggtcttaggttaacctcggtattggtacggacgagtacggtaanacggttaggaccggttagtaaccggttaacgg

SEQ ID NO: 230728 - DNA, 777 bp, Homo sapiens
  misc_feature: GYAE6OF02GPMQN.3.4.A04.1.454.CMB.1.raw
  modified_base (180)..(180): a, c, t, g, unknown or other
  misc_feature (180)..(180): n is a, c, g, or t
  modified_base (754)..(754): a, c, t, g, unknown or other
  misc_feature (754)..(754): n is a, c, g, or t
tcagagacgcactccacgaccggtgctcgatttagagtagtgatcagggggagctctgggagacgagcccagcactggaagtcgccggtgtttccattcggtgatcatcactgaacacagaggactcaccatggagtttgggctgagcttgggttttcctcgttgcgttcttttaaaggnggtcgtaccgtaggtccgccggtaggtcgacgtgtcgtgggtggtacggtcggggtagggggacggtccggtccgacccggtacgtccgggtacggggtaccggtacccgaacgggtaaccttccgttacggtacgtaaccgttcgttcctcggttaggtacttacccgtaacggttttacgttacgtgtacgtacgttacgtcgacgtaccggttcccggggtcccgggcccgggtccgtaccggacgggtacgggacggtcgggtcgggtaggggttcggggtagtacgttaagtacgtaccgtactaggtgtaacgggtagacgtagtaacgttaaccgtcgtaccggactaacggttaccggtacggtacgggtaacggtaccgtacttaccgaccttacgtaccctacggacgaacgtaacgtaaactaaccgaaacgtacgacttacgttagtacgtctaagtaactaacggactaaccggaccgtcgtaaggacgtcggtaccggaaggtaccgacggttcggttaccgaggtttaacgttacgttaggcggtagacgtagacgtgnggtacgtcggtagtaggtaacgg

SEQ ID NO: 230729 - DNA, 770 bp, Homo sapiens
  misc_feature: GYAE6OF02GT4K4.3.4.A04.1.454.CMB.1.raw
  modified_base (180)..(180): a, c, t, g, unknown or other
  misc_feature (180)..(180): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccagtggtagtttgggctgagtcgttgggttttcctgttgtcttactttaagnggtcgtcctagtcgccgaggtgcagtcgtgggtcggagtcggtggggggacgtcgtcggaccccgaggtcccgtaggggaccgttacccgaagggtaacctccgttccgtaggtacctagttccgtacgttcggaacttttccgtaaccgttttaaggtttaacctagttcggtaccttagtcgtaccgttacggtcccgggggtacccgcccggggtacctccgggaggaccggaaggggtccgtggggtagggttcgggtcggtacttaaggtttactaccgttccgaaagttcggaacgtgggtaaccgtacgttaaagtacgtacccgtacgacgtaccgaccgttcggtaacgggaacggccgtacttacccacgtaactccgtaacgaacgtacctaacgtaacctaccaaacgtaacgtaccgtacgtacttacgtactagtaaccgtaactaacggactacggtactaagacgcgtacgtaacggagtacccggtagacgttggttaacgttaacgttcgtaaggtcgtaacgtaggtaacgtacggtcgggtaaacgttcgggtaacgttacgttaacggg

SEQ ID NO: 230730 - DNA, 868 bp, Homo sapiens
  misc_feature: GYAE6OF02I3LWO.3.4.A04.1.454.CMB.1.raw
  modified_base (116)..(116): a, c, t, g, unknown or other
  misc_feature (116)..(116): n is a, c, g, or t
  modified_base (229)..(229): a, c, t, g, unknown or other
  misc_feature (229)..(229): n is a, c, g, or t
tcagagacgcactccacgaccggtgctcgatttagagtagtgatcaggggagctctgggagacgagcccagcactggaagtcgccggtgtttccattcggtgatcatcactgaacncagaggactcaccatggagtttgggctgagcgtgggttttcctcggttgctacttttaagaggtgtccagtgccgaggtgacagctagggtgggagtcgtggggggacgtcgngggaccccaggccgtggggacggtccccaagggtaactctacccgttgaacagtcttcgagggtacttactaacccgttaaggttacctagtacgctaagtcgactacggttaggggccccggtacccggggaccttccgaacggggtacgaaaggggggccgttaagggggacgggttacggggggttggaccttaaggtttaagtacctacccgtaagtacggtaagttcggggaaacgtaactaacggttaaaactcccgtaacgggactaaccggtaccgtacccggggtagggaaaaccggggtacccggtaatttaacccgaaccccggtaacggttacccctaccgaaacggggtaacctaaaacccgttaaaaggttaccccgtaaaaacgggaaaccgtaaaccgttacccggttaacggttaaccggttaacccgttaaacggaaaccttaaaaacgtacggtaaaaccgttacgtaaccccgtaagggaacgtaaccggtaagtacggggaaacggtaaccgtaaaccgggtccgtttaggtaaacgggtttaactttcgtaacgggacggtaccgttaaggacgtacggttaggaccgggtttaacgggtaacgttacggtaaacgg

SEQ ID NO: 230731 - DNA, 839 bp, Homo sapiens
  misc_feature: GYAE6OF02H3X4G.3.4.A04.1.454.CMB.1.raw
  modified_base (155)..(155): a, c, t, g, unknown or other
  misc_feature (155)..(155): n is a, c, g, or t
  modified_base (172)..(172): a, c, t, g, unknown or other
  misc_feature (172)..(172): n is a, c, g, or t
  modified_base (180)..(180): a, c, t, g, unknown or other
  misc_feature (180)..(180): n is a, c, g, or t
  modified_base (269)..(269): a, c, t, g, unknown or other
  misc_feature (269)..(269): n is a, c, g, or t
tcagagacgcactccacgaccggtgctcgatttagagtagtgatcaggggagctctgggagacgagcccagcactggaagtcgccggtgtttccattcggtgatcatcactgaacacagagctcaccatggagtttggctgagtcttggtttccngttgcttcgttttaagngtgtaccngtgccaggtcgcagtcgtgggtgaggtcgtgggggagtcgtcggccctaggccgtggggacgtacccgaaggtaccttcctcgtgtacngttcttcgtggtaacttctaccgttttaggtacctattcgacttatcgactacggttccgggtacccgccggtacctaccgaggtccggaaaggggtccgttagggtaggtggggtcgtaaccgtaggttactaccgttccgaagtcggagtcggacgaacgtaagtaaaacctcggtacgagtaagtacccgttccggaaagggtaaccggtaccgttacttaaccaaccgtacgttacccgtaacctaaaggaaccggtaaacccttaacgttaacccgaaaacggtaaacccgtacgttaaacccgttacggtttaacccttacgtaaccggaaaacctttaaaacggaccgttaaaacccgaccggtttaacccggttaaaggtaaccggaaccgggttaacccggacgggtaaaccggttaacccgggttccgggttaacgttttacggtttaacggttaaaccgggttaccctttaagggggacccgggtaaacgttaagggtgttaaacggggtcgggtttaacggtaaccgggtttaaccgtaaaccggttttaaaccgggg

SEQ ID NO: 230732 - DNA, 740 bp, Homo sapiens
  misc_feature: GYAE6OF02I4DDA.3.4.A04.1.454.CMB.1.raw
  modified_base (170)..(170): a, c, t, g, unknown or other
  misc_feature (170)..(170): n is a, c, g, or t
  modified_base (190)..(190): a, c, t, g, unknown or other
  misc_feature (190)..(190): n is a, c, g, or t
  modified_base (282)..(282): a, c, t, g, unknown or other
  misc_feature (282)..(282): n is a, c, g, or t
  modified_base (321)..(321): a, c, t, g, unknown or other
  misc_feature (321)..(321): n is a, c, g, or t
  modified_base (625)..(625): a, c, t, g, unknown or other
  misc_feature (625)..(625): n is a, c, g, or t
  modified_base (630)..(630): a, c, t, g, unknown or other
  misc_feature (630)..(630): n is a, c, g, or t
tcagagacgcactccacgaccggtgctcgatttagagtagtgatcaggggagctctgggagacgagcccagcactggaagtcgccggtgttccattcggtgatcatcactgaacacagaggactcaccatggagttggctgagtcgttggtttcctgtgtctgtttaagnggtgtccgagtgccgaggtncagcgttggtggagtcgtgggggacgtcggtcggccgagccgttaggggacgtacccgaggaacttccgtaccgtagtactacgtcttacgnggtaccttccgtaacgtttaggttaacctgtacgcttancgaccgtacgtccggggtccggaccggaccttaccggacggtacgggtaacgggtccgttaggggtacggttcggggtgtaccggttaacgttcgtacccgtaccgtaagttcgggtagtacggggtacaaccgtaagttaaccgcccttacggacgttaccgaccggtacggtacggaacgggtacccgtcgttaacccgaccgtagtccccgtaacggaacgtaacgtaaccgtaaccttaccgaaacggtactaccggttacgatttacccgagtacaaccggtataacgaccgacgtacnggacncgttacgagttaacggactggtccgttaggttaagtacttccgggagttaacgccggtaaacgtggtaaccggttaggaccggtttcggtaaggtaaccgtttaacgggg

SEQ ID NO: 230733 - DNA, 762 bp, Homo sapiens
  misc_feature: GYAE6OF02GSOQY.3.4.A04.1.454.CMB.1.raw
tcagagacgcactccacgaccggtgctcgatttagagtagtgatcagggggagctctgggagacgagcccagcactggaagtcgccggtgtttccattcggtgatcatcactgaacacagaggactcaccatggaggtttgggctgagctgggttttcctcgttgcttcttttaagaggtgtccagtgccaggtgcagctgggtggagtcgtggggggaggcgtggccagccgtaggggacgtcccaggaacctctcctgtacagtcctcgtggattccaccgttaggttacctaatcggtacttagtcgcctaggtcgggtccggacccgggctaccgagggacgaagggggctagggtaggttggggtgcgtaagttactacgtcccaagtcggaagtcgggacgggactaaacgttaaaacgtccccgttaaacggccctaaggtaccttacccgggttaagggaacccggggttccgtaaacctttacccgaacccctaaacgtcccctaccggaaaacggtaaccggtaaacctaaaccgtttaacccgaaaaacggaaacccgtaacgtacccttaggttaccgtacggtacaaaccgttaaactacggtaaaaccgacgggtcccgtaaaggacgtaccgtaacgaacgggtaacggaccgtacggtaccggtttggtaacgtttaaccgtttagtagggtacggtacggaggtacggtaagtccgggtagtacggggtagtaacgtttaaccgg

SEQ ID NO: 230734 - DNA, 796 bp, Homo sapiens
  misc_feature: GYAE6OF02H2EEZ.3.4.A04.1.454.CMB.1.raw
  modified_base (109)..(109): a, c, t, g, unknown or other
  misc_feature (109)..(109): n is a, c, g, or t
tcagagacgcactccacgaccggtgctcgatttagagtagtgatcagggggagctctgggagacgagcccagcactggaagtcgccggtgtttccattcggtgatcatnactgaacacagaggactcaccatggagtttggctgagctgggttttcctcggttgtcttcttttaagaggttgtccagtgccaggtgcagctgggtgagtcgtgggggagtcggtggccccagccgtggggacggtaccccgagggacttccgtcctagtaccagttctcgtggacttcaccgtttaggtactatgacttagtgtactacgttcggggtccccggtaccggggccgtaccgaggggaccgtaaacgggggtcgtaaggggtcggttcgggggtaggactaggtttactaaccgtcccaagttcggaagttaggggaacgtacgtaaacggtaaaacttccgtacccggaacgtaacggtacccggtttcccggaggggaaaaccgggttcccgtaacgttacccaacccgtacgttacctacccggaagtaacgtaaacctaaaccgttaacccgaaaaccgaaaccgaaccgtaccgttagttaaccgttacgtacgaaacgtaaaacgtaccgtaaaccgaccggtaccgtacggtaacggtaaccggacggtacgggaaacggtaccgttaccgggtacgttcggttacgttaacgtttacggttaggtacggacggttaacggacgttaacggtaggtaacgggttggggtaccgttaacggtttaaccgggg

SEQ ID NO: 230735 - DNA, 854 bp, Homo sapiens
  misc_feature: GYAE6OF02GFF6D.3.4.A04.1.454.CMB.1.raw
  modified_base (188)..(188): a, c, t, g, unknown or other
  misc_feature (188)..(188): n is a, c, g, or t
tcagagacgcactccacgaccggtgctcgatttagagtagtgatcgaggggagctctgggagacgagcccagcactggaagtcgccggtgtttccattcggtgatcatcactgaacacagagactcaccagtggtagtttgggctggagtcgttgggttttcctcggttgtccttactttttaaaggnggttctaccgagttcgacccgtaggtcgcgagtcgtagggtggaggttcggtaggggggacgggtccggtacggccccgtaggtcccggtaggggtaccggtaccccgtaacgggtaaccttccggttaccgtacggttaaccgtacgttaccgttcgttacggtacttttacccgtaaccgttttaaacggtttaaccttaagtcggtacttagtcggaccgtaccggttccggggtccccgggaccgggtccgttaccggacgggaccgggtaacggggtccggtaggggacgggttcggggtgtacggtaacgtttactaccgtaccgagtacggtagtacgggtacgagtaacgtaactccgtaacgctacgtccgtacggtaacgtacggtccgtactaccgtactacgtccgtagaacgtacgaaaccttaacgtaaccgaaacgaacctacgtaccgttactacgtaacgtacgtaacgttaaacgaacgtaaccgttacgtcccggtaaagacggtaacgtcccggtaaggaaccgtacggtaccgttacggttaggttaccgtttaacgttaacgttaccggggtaaggttacccggaaaggttcggtaacggttacgggtagggtttacgggtaacggtaacggtttaaaccgggg

SEQ ID NO: 230736 - DNA, 656 bp, Homo sapiens
  misc_feature: GYAE6OF02GMYRK.3.4.A04.1.454.CMB.1.raw
  modified_base (558)..(558): a, c, t, g, unknown or other
  misc_feature (558)..(558): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagtcgttgggttttcctcgttgcttacgttttaaggaggtgtccgagtgccaggtgcagcgtgggtggagtcggtgggggagcggtcggccagccgtgggacgtccagactctccgtgtacagtcctcgtggactttaccgactttaacggttactatcgtctaacgtgactacggtcggggtcccgccgggtctaccgaggacgtaacgggggcgtcggggaggttggggtcgacgtagttaatactcccaaggtcgaggtggacggacgtaagtaaacgtccgtaacgacacgtaaccgtccggtaggaaccgggccgtaactccgaacctactaccgcgtaacgacgtaaaccgtaacttacccaagaaccagtcgttacgtactacgatacaaagcgtaacgacgtacgngacgacgactaggaccgagtacgcttaggtacttaaggtaccgttggacgacggtaggaacgaaggttggagttacgggacgttaagtttaaccgggg

SEQ ID NO: 230737 - DNA, 705 bp, Homo sapiens
  misc_feature: GYAE6OF02G29Z3.3.4.A04.1.454.CMB.1.raw
  modified_base (157)..(157): a, c, t, g, unknown or other
  misc_feature (157)..(157): n is a, c, g, or t
  modified_base (171)..(171): a, c, t, g, unknown or other
  misc_feature (171)..(171): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggtttccngttgctctttaagnggtgtccagtgccaggtgcagctggtggagtcgtgggggagcgtggcccagcctggggacggtcccaggactctcctgtacagtctcgtggacttcaccttaggtactatcgctatgcacgtgggtccgcggctccgaggcgaaggggtctagggaggtggggtcgcgtaggttactacgtccctatggacgtagggacggactaacggtaaaactccgtaacggccaacggtacccgtaccggtacgggaacgggtcccgtaacgttacccgaacctaacgttcccgtacgtaagggtaacgtaaccgtaaacgtttaacccgaaagtaacccgaacgggtccttaagttacgtacccttagaaccgttaaaatcgggtaaaacctcggaaccggttggtaaacggtacggtccgtaacgggaagggtaaccgtaccgggtacgttaggttaccgtttaagttaccggttagtccggtacgtaagggaagtaggttacggtagggttacgggtaaccgttaggttaaaccggg

SEQ ID NO: 230738 - DNA, 879 bp, Homo sapiens
  misc_feature: GYAE6OF02HB4CY.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttacgttttaaggaggtgtccagtcgccgtaggtgcagtcgtggtggacgtcggtgggggagcgtcggcccgagccgtgggacggtcccaaggtacctcgtacctgtactacgtctcgtggtacttccaccgttttaaggtactagtgaccttagtcgacgtaccggtcgggggtccccggtccgggtccgtacccggaagggtaccggtaacgggggtcggttaacggggtaggggttcggggtacgggtaccgtttaaggtttaaccggttacctaaccccgaaggtttacggaagggtttcggggaaaccggtacgttaaaacgggtttaaaaaccgtcccggttaacggaccttaaaaccggggtaccccggtttacggggtaaaccgggaacccgggggttaccttaacccggtttaaccccgaaacccggttacgttaacccccggttaacggaaaccggtaaactaaacccgttaaaaccgtaacccggtaaaaaaccgaccgttaacccggttctttaaacggtaacgttcccgtaaggtaaccaaaaaggttacggtaaccaccggttacgaagttacggactacggggtcgaaacggcccgtagggtacgtttagaaccgtttagtcccggtagggtacggtaaccggtagtaggttaaccgtgggttaaacgggtaccggttaggtaaaaccgttttcggggg

SEQ ID NO: 230739 - DNA, 838 bp, Homo sapiens
  misc_feature: GYAE6OF02GD1ET.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttcttttaagaggtgtccagtgccaggtgcagctgggtggagtcgtgggggagcggtcggcccagccgtggggacgtccgaggacctctcctgtacagtctcgtggattccgaaccgtttaggttacctagtcgacttagtcgaccgtaccggtcggggttccccggccggggtcctacccggagggtaccggaacgggggtccgttagggggacgggttcgggggtacgggtaccgttaaggttttaacgtaaccgtaccccgtaagtttacggggaaggttacggggtaacggtaacgtaaaacggtttaaaccgttacccgtaacggaccgtaaaccggtacccggttacccggggttaaaggggaaacccggggtacccgttaaaccgtttacccgaaacccgttaaccgttaccccgttaacccggaaacggtaaacggtaaacccttaaacgggttaaccccgaaaacggtaaacccgaccggttacttacggttaacgttaccgtacggtaaactaaaacgtaccgaaaccgtaccgtacgttacggaacggtaaccggccgttaacgggtaaccggaacgtacccggtagttacgtttacgtaacgttacgtacggcgtaacggagtacgtagtaggtacggtacgggtaacctaggttaacggg

SEQ ID NO: 230740 - DNA, 674 bp, Homo sapiens
  misc_feature: GYAE6OF02JTQZB.3.4.A04.1.454.CMB.1.raw
  modified_base (217)..(217): a, c, t, g, unknown or other
  misc_feature (217)..(217): n is a, c, g, or t
  modified_base (224)..(224): a, c, t, g, unknown or other
  misc_feature (224)..(224): n is a, c, g, or t
  modified_base (300)..(300): a, c, t, g, unknown or other
  misc_feature (300)..(300): n is a, c, g, or t
  modified_base (338)..(338): a, c, t, g, unknown or other
  misc_feature (338)..(338): n is a, c, g, or t
  modified_base (439)..(439): a, c, t, g, unknown or other
  misc_feature (439)..(439): n is a, c, g, or t
  modified_base (474)..(474): a, c, t, g, unknown or other
  misc_feature (474)..(474): n is a, c, g, or t
  modified_base (568)..(568): a, c, t, g, unknown or other
  misc_feature (568)..(568): n is a, c, g, or t
  modified_base (618)..(618): a, c, t, g, unknown or other
  misc_feature (618)..(618): n is a, c, g, or t
  modified_base (624)..(624): a, c, t, g, unknown or other
  misc_feature (624)..(624): n is a, c, g, or t
  modified_base (646)..(646): a, c, t, g, unknown or other
  misc_feature (646)..(646): n is a, c, g, or t
tcagagacgcactccacgaccggtgctcgatttagagtagtgatcagggggagctctgggagacgagcccagcactggaagtcgccggtgtttccattcgtgatcatcactgaacacagaggactcaccaagtcggaggtttgggctgacgcgttgggtttttcctgtgtacctactttaagtaggtgtccagtgtcgacggtggcagcgtggtggngttcggngggggtggcggtccggtaccgaccgcgtgggtaacgggtccgacgggtaactccttccgcgttacacgttctccgngtacgttactaccgttaaggttactcgtcacgttacgngccgtacgtacgggtccccggaccgtcgtaccgacggtaacgggtaaggccggtgttaacggggcggttgggtaacccgtaaggtttactaccgtaaccgngtaaggtcgtaaggacgttaacgacgtttaaaaancccgtgaactacgacgttacccgaggtacgtaccgtaacgtacacacgttacacgaacgtataactacgtaacaactaagccgtactacgttanacgttacaaagaacgataacgaccgtagcgatagataggcgtaagccgtnacggtntaacgttacgtgtacgacgganaggtacgtgaggtggtacgaagtaacgg

SEQ ID NO: 230741 - DNA, 702 bp, Homo sapiens
  misc_feature: GYAE6OF02F0WXQ.3.4.A04.1.454.CMB.1.raw
  modified_base (528)..(528): a, c, t, g, unknown or other
  misc_feature (528)..(528): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccagtggagtttgggctgagtcgttgggttttcctcgttgcttcgttttaagaggttcgtccgtaggtcgcctaggtcgcgagcgtgggtaggacgttcggtgggggacgcggtcggcccgaggtccgtagggggtacgccctaagggtaaccttcgtaccgttagtactagtctacgtggtactttcgtaccgttaggtttactagtcgtctagtcgtacctacggtcgggtccgccgggtaccctccgagggaccggtacgggtcgtagggagggttcgggtgacgttaagttactaccgtcctagtgggacgtaggaaccgacgtaaagttaacccgtcgaacgacgaacgtacccggtccggtaagggacccggcttactactaaccgtctccgtanacgaataaccgtaactacaacgtacgacgtgtacgtatcgacgagtaacgagaaccgtcgtaccgtaggacgagtaccagggaccgtacgcggttagtacgttacggttcttagggtactaccggtaagaacggtaggtaagtaccggaggtttacgggaactaggttaacggg

SEQ ID NO: 230742 - DNA, 731 bp, Homo sapiens
  misc_feature: GYAE6OF02GLG3C.3.4.A04.1.454.CMB.1.raw
  modified_base (160)..(160): a, c, t, g, unknown or other
  misc_feature (160)..(160): n is a, c, g, or t
  modified_base (175)..(175): a, c, t, g, unknown or other
  misc_feature (175)..(175): n is a, c, g, or t
  modified_base (205)..(205): a, c, t, g, unknown or other
  misc_feature (205)..(205): n is a, c, g, or t
  modified_base (211)..(211): a, c, t, g, unknown or other
  misc_feature (211)..(211): n is a, c, g, or t
  modified_base (265)..(265): a, c, t, g, unknown or other
  misc_feature (265)..(265): n is a, c, g, or t
  modified_base (270)..(270): a, c, t, g, unknown or other
  misc_feature (270)..(270): n is a, c, g, or t
  modified_base (282)..(282): a, c, t, g, unknown or other
  misc_feature (282)..(282): n is a, c, g, or t
  modified_base (292)..(292): a, c, t, g, unknown or other
  misc_feature (292)..(292): n is a, c, g, or t
  modified_base (297)..(297): a, c, t, g, unknown or other
  misc_feature (297)..(297): n is a, c, g, or t
  modified_base (315)..(315): a, c, t, g, unknown or other
  misc_feature (315)..(315): n is a, c, g, or t
  modified_base (386)..(386): a, c, t, g, unknown or other
  misc_feature (386)..(386): n is a, c, g, or t
tcagagacgcactccacgaccggtgctcgatttagagtagtgatcaggggagctctgggagacgagcccagcactggaagtcgccggtgtttccattcggtgatcgatcactgaacacagaggactcaccatggagtttgggctgagcgtgggttttccngttgcttctttaagnggtgtccagtgccaggtgcagcgtggtggngtcggngggggagcgtcggcccaggtccgtgggacggtacccaggtacctcgcgtagacngcctnagtaactcactntagtaacttngcttntagccacggttcgggccncgacggtccgtccggggacgacggggcgtaggtcggggcgtgtaggtactagtctgacgtagtaagggaanagtgaacgtactaccggagtagaccgtcggtcgaggtaccgggtacgtaactttacgtccgtactaccgtacgtacgaacggtacgtaacgtaccgttaacgaaaccgtaaccttaaccctaacgtaacgtaccgtacggtaaacctaaacggtaccgaaaaccgttacgtaaccgggtaacgtaacccggaaccggtaaacgggtaaccgggtaaccgggtaacgtaccccgttaagttaaacgttacgttaacgggttaacggtaccgtaaccgggtaaggtaaccgggtaacggggtacccgggtaccgggtttaacccggaacggttccgggttaccgggg

SEQ ID NO: 230743 - DNA, 753 bp, Homo sapiens
  misc_feature: GYAE6OF02IFX5R.3.4.A04.1.454.CMB.1.raw
  modified_base (141)..(141): a, c, t, g, unknown or other
  misc_feature (141)..(141): n is a, c, g, or t
  modified_base (152)..(152): a, c, t, g, unknown or other
  misc_feature (152)..(152): n is a, c, g, or t
  modified_base (166)..(166): a, c, t, g, unknown or other
  misc_feature (166)..(166): n is a, c, g, or t
  modified_base (300)..(300): a, c, t, g, unknown or other
  misc_feature (300)..(300): n is a, c, g, or t
tcagagacgcactccacgaccggtgctcgatttagagtagtgatcaggggagctctgggagacgagcccagcactggaagtcgccggtgttccattcggtgatcatcactgaacacagagactcacatggagttggctgancgtggtttccngtgcttctttaagnggtctccagtcgccgaggtgcagtcgtggtgagtcggtggggcgcgtcggccaggccgtggggaacgtccgaaggtactcgttcgcggtaactgtctcgtagacttacgaccgttaggtactacgtgactagtnacgtagtcggtaccgccggtcctacgacggacgtaacgggccgtagggtaggtcgggtagacgtagttacacgtccgaagttgacggtaggagaacgtaagtaaaaccgtccgtaagaccgtaacgacgtacggtaacgggaacggtccgtaacgttccgaaacgttcggtaacctacggaaacggtaacgtaaaccgttaacgttaaaccggaacgtaaacccggaccgttaacgttaccggtaaacttcggtaaacgtaaccgtaaaacgggttaccgaaaacgttaccccgacgttaaacggggaactaacgggtacccttaaacggggaaacgttacccgaccggtttaccgttagggtaaacctttaccggttaaagttccgggtaaaacgccggtaaaggtacgtagtccgggtaaacggtttaccggacgtaaagtttaaaccggg

SEQ ID NO: 230744 - DNA, 649 bp, Homo sapiens
  misc_feature: GYAE6OF02FLW8S.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtgggggaggcgtggcccagcctggggacggtcccaggaacctctcctgtacagtctctggattcaccttaggttactatgctatgcacgtggggtccgccgggctccgaggcgaaggggctgggagtggggtggcaggttatactccagtgatgggaggcaagtaaactcctaacgcaagtactcggtaggaacgggtcccgtattccaccattacctacccgaagacgaaccttaacttaacccgaaacgtaaaccgaccgacttaggtaacctcgtagaccgtaaaagttacggaaaccaggtaccctaaggaacgaagtaccgtacggaagggaccgtaacggtacgttacggttacgttaacgtttacggttcggtacgggcggtaaaggaggtaagttacgggaacggttacggggtaccgtaaggtttaaaccggg

SEQ ID NO: 230745 - DNA, 747 bp, Homo sapiens
  misc_feature: GYAE6OF02FY8SJ.3.4.A04.1.454.CMB.1.raw
  modified_base (180)..(180): a, c, t, g, unknown or other
  misc_feature (180)..(180): n is a, c, g, or t
  modified_base (677)..(677): a, c, t, g, unknown or other
  misc_feature (677)..(677): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctggagcgttgggttttcctcgttgcttacttttaaggnggttgtccagtgaccgaggtgcagtctgggtggacgtcggtgggggacgcggtggcccaggccgtgggacgtcccaggtactctccgtagtaccagtcctgtaggtacttcctaaccgtttaggttactacgtgtctagtcgcgtacggttcggggtcccggcccggtctaccggagggtaccggaagggggtccttaggggacgggttcggggtaggtacgttaaggtttacgtaacctccgtaagtcggtaggtagggacgtacgtaaagttaaccgtccgaacgactacggtaccgtcggggtaacggaccggggtaccctaacgttacccgacccgttacgtaccccgttaacggaaccgtaaacgtacccgtaaaacttacccggaaaaccgtaaacccgtaacggtacctttaggaacccttacgtaaaccaaacgtaaacgttaacggaacgtccggtacgtaggaactacgacggtacggacgtaccgngttacgtggtacgtttaactggttacgcgagtagagtaggtacgtaaggtccggtaagtacgttaacggg

SEQ ID NO: 230746 - DNA, 767 bp, Homo sapiens
  misc_feature: GYAE6OF02HMTLX.3.4.A04.1.454.CMB.1.raw
  modified_base (189)..(189): a, c, t, g, unknown or other
  misc_feature (189)..(189): n is a, c, g, or t
tcagagacgcactccacgaccggtgctcgatttagagtagtgatcaggggagctctgggagacgagcccagcactgggaagttcgccgggtgtttccattcggtgatcatcactgaacacagaggacctcaccagtggagtttgggctggagtcttgggtttttccctcggttgcttacgttttaaggnggtgtccagtgccgtaggtgcaggctgggtggagtcggtgggggacggcggtcggcccagccgtagggacgtccaggactctcctgtacagtctcgtagtacttcacgtttagtactatgtctagtcgcgtacggtcgggtccgccgggtcgaccggaggacggaaggggtcgtaggggtacgggtggggtacgtacgttaaggttacgtacctccgtaattggagtcggggtaacgtacgtaaaggttaactacccgtaaggacgaacgttaccgtcggtaagggaacccggtccgtaacgttcccgaaaccctacgtacccgaccgtaagggaactaaccgtaaacgttaacccggaaaggtaaacccgtacggttatacggtttaactacggttaacgaaacgttaaacgtacggaaacgtaccggtaccgtaaaggtacgtaggtaccgtaaggaacccgggttacgtaccgggtctttaagggtttaccgttaactaccggttcggttaagggaccgtaagggtacggtacggttaaggtacccggggttagttaccggtaacggttaacggg

SEQ ID NO: 230747 - DNA, 817 bp, Homo sapiens
  misc_feature: GYAE6OF02IRYLF.3.4.A04.1.454.CMB.1.raw
  modified_base (180)..(180): a, c, t, g, unknown or other
  misc_feature (180)..(180): n is a, c, g, or t
  modified_base (803)..(803): a, c, t, g, unknown or other
  misc_feature (803)..(803): n is a, c, g, or t
tcagagacgcactccacgaccggtgctcgatttagagtagtgatcagggggatcaggactcctcagttcaccttctcacaatgaggctccctgctcagctcctggggctgctaatgctctgggtcccaggatccagtgggatgttgtgatgactcagtctccactcctcctgacccgtcnccttaggaccacgccggtcctcctagtcctcctgcgtacggtctacgacaaacgcctgtaactcagtagatacggaaacctaccgttattgtaacgttttcggttacacgacgaacggacggtccgaacggaaccttaaacgtttccccgaaccggtaacggtacccgtaaccttttaaaagttttaaaccggttaaaccgggttttacccgtaaacccgggttacgttaccccgggttagggtaccctaagtaaccgtagtacttaccggagtcccggatggggtacgtcgaaggtcctacggttatacgtttaccaacgtacgttaaacgaaacgtcgaacggtaaccgggtaggggtccggtaagggttaccgtaaggggtacggttaaaccgggttttgggggtttttacggtttacgttaaccgttggaaaccgtttgttaccggaaaccggttaccgtaaactaccggtaaccggtccgggtacctaaccccgggttagtaccccgggtaccgaccgggtaaaacgtaacgggttaccgtaaacgtaacggtaaccgtcggttaggacccgtacgtcccgtaagtaacccggttacttcccgttagttccccgttanaccccgtttcccgg

SEQ ID NO: 230748 - DNA, 800 bp, Homo sapiens
  misc_feature: GYAE6OF02HV72K.3.4.A04.1.454.CMB.1.raw
  modified_base (185)..(185): a, c, t, g, unknown or other
  misc_feature (185)..(185): n is a, c, g, or t
  modified_base (194)..(194): a, c, t, g, unknown or other
  misc_feature (194)..(194): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcacatggagtttggctgagcgttggtttcctcgttgcttctttaagaggtctacaggtcnccgtaggtnacgacgtcgtgggtaggtaggtcgggtgggggacgtcggtccggacccgtaggtccccgtaggggtaccggtaccccgtaagggtaaccctttccgtcccgttaacgttacgtacggttcctttaccggtacggtacttttacccgttaccgttttaagtttaccgtaacgttcgtaccttaagtaccgtacgtaaccggttcgggtcccgtcccgggtacctaccggaggtacgacgggtcggtacgggtgggtacggggtgtaccgtagttacgtacgtacctagtacgtaggtaacgaggtacgtaaacggtaacgttacccgaagtaccctaacggaccgtaccgggacgtacggtacgttaccgtaccgtacctaccgtacgtaaccgtacgaacgaacttacgttaaacggaactaacggtaactagtacgttactacggactaaccgtaagaaccgtaacgtaccgtaccgtacgtaacggtacgacggttacgaaccggtacgaccggttacgttacggtacgtttaacgtacgttacggtacggtacggaaggtcggttaagtagttacggacggtttaacggaatttaacccgggg

SEQ ID NO: 230749 - DNA, 886 bp, Homo sapiens
  misc_feature: GYAE6OF02G81BW.3.4.A04.1.454.CMB.1.raw
  modified_base (188)..(188): a, c, t, g, unknown or other
  misc_feature (188)..(188): n is a, c, g, or t
  modified_base (300)..(300): a, c, t, g, unknown or other
  misc_feature (300)..(300): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccagtcggagtttgggctggagtcgtttcgggttttcctcgttagtcttacgttttaaggnggttgtccaggtcgccgtaggtcgcagtcgtgggtcgggagttcgggtgggggaggtcgacggcccgaggtccgtacggggacgtacccaggtaacctccgttccgtagacncgttctacgtgtacttcgtaaccgtttagtaacttgtgtactagtcgacgtcggttccgggacccgcccgggttacaccccggtaagggtaccggtaacggggtcggtgggtaagggttcggggaccggtagttaattccgtaccgtacgtacgtaggtacgggttaggaacggtaacgtaaacgttaaccgtaccgtacgaacggtaaacctcccgggtttaacggggaaacgggaaccggttaccgtacccgtttaaaccgtaccgtaccccggttaacgttaccgaacgtaaaccgttaaaccgtaaacccgtaaacccgttaaaggaacccgttaaccggttacttaccggtttaaacgttaccgaacgttaaacctacggtaaaaccggtaaccgttaccgggaccttaaggaaccgttagaaccgggtaaccggtaacggtaccgaaccgggttggttaacgtttaacgggttaccgttaacggttacggggaccggtttaaacgggacggtttaagggtaccgggtttaacggttacggggtttacggttaacccggtttaaagggtttaaacccgggg

SEQ ID NO: 230750 - DNA, 896 bp, Homo sapiens
  misc_feature: GYAE6OF02IN3HC.3.4.A04.1.454.CMB.1.raw
  modified_base (862)..(862): a, c, t, g, unknown or other
  misc_feature (862)..(862): n is a, c, g, or t
tcagagacgcactccacgaccggtgctcgatttagagtagtgatcagggggagctctgggagacgagcccagcactggaagtcgccggtgtttccattcggtgatcatcactgaacacagaggactcaccatgggagtttgggctggagcgttgggtttcctcgttgcttcttttaagaggttgtccagtcgccaggtgaccagccgttagggttgggagttccggtggggggacgtccggtacggccccgtaggcccgttggggaccggttccccgaagggtaaccctcgtcccgtagtaaacctcgttaccgttcgtacggtacgttaccgtacccgttttaagggttaacctaagttcgtaccttagttcgacccgttacggtccggggtttaccccgggcccggggtaaccgtcccggtaacgggggaacccggtaaacggggggggtcccttagggggttacggggtacgggggggttcggtaaccggttaaaggtttaaccggttaacctcccggtaaaggttcggaaggttcggggaacgggtaacttaaacggttaaaaaccttccggtaaacgtaccgtaaaccgggacccgtttaccgggtaacggggtaacccggggtacccggttaacttacccggtaaccctaacggtttacacccggtaaggtaaccgtaaactaaacccggttaaaccgaaacgtaacgtaaccggtacttacgttaactaccgtactaacgtaacggttaaccaacggtacgtaccgtagggtacaacggtcgtagggaaccggaacctaacgggtcttacggtacgtttacggtaacgttcgggtagtacgtaagacgtttacgnggttaaggtccgggttaagtaaccgtttacgggg

SEQ ID NO: 230751 - DNA, 781 bp, Homo sapiens
  misc_feature: GYAE6OF02GEOHS.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcgttgggttttcctcgttgcttacttttaagaggtcgtccagtcgccgaggtgcagcgtgggtggaggtcggtggggggaggcggttcggccctaggccgtggggacggtcccgaaggtaacctcctccgtacgttactacgttccgtcgtggtacgtttacctaaccgtttaggtttaactagttgtacttagtcgtacgtacggttccggggtcccgggacccggtcctaccggaacgggccggaaggggtcgtgggaggggtgggggtacggtacgttaggttactacgtcctagtggacgtggggaacggtactaaaggttaaaacgttcccgtaacgaacgtaccgtaccgttaccgggtaacggaaccgggtaccctaacgtaccaccgtacgtccctaacgaagtaaacgtaacctaaacgtaaccgaaacgtaacctacgtacgttacgttaacttccgtaacggtaactaaaacgtaaccggaacctacggtacgtaacggaacggttacgtacggtaacggaaccgggaaccggtcggtacgttaggtaacgttaacgttacgtcgggtacggtacgaaggtacggtacgtaagggttacggtcgggtacgttaaggttaacggg

SEQ ID NO: 230752 - DNA, 774 bp, Homo sapiens
  misc_feature: GYAE6OF02IQESP.3.4.A04.1.454.CMB.1.raw
  modified_base (161)..(161): a, c, t, g, unknown or other
  misc_feature (161)..(161): n is a, c, g, or t
  modified_base (182)..(182): a, c, t, g, unknown or other
  misc_feature (182)..(182): n is a, c, g, or t
  modified_base (211)..(211): a, c, t, g, unknown or other
  misc_feature (211)..(211): n is a, c, g, or t
  modified_base (340)..(340): a, c, t, g, unknown or other
  misc_feature (340)..(340): n is a, c, g, or t
tcagagacgcactccacgaccggtgctcgatttagagtagtgatcaggggagctctgggagacgagcccagcactggaagtcgccggtgtttccattcggtgactcatccactgaacacagagctcaccatggagtttgggctgacgtcttgggttttccnggttgacttacgttttaaggnggttcgtaccaggttcggaccgtagggtnacgaggtcgttgggtacggacggtcggttaggggggcgcggtcgccccgaggtccgtggggaccgtccgaagggtaccttccgtcgtgaactgtcctcgtggacttcgacgtttacggttactattcgnttacgtcgtcgtacggttcggggtcccgtaccgggtccgtaccggaaggtcggtaacggggtccggtacggggtaggttcggggtacggtaccgttaagttccggttaccacccggtaagttcgggacggttaggacgggtacttaaacggtaaccttccgtaaccggtacgacggtacccgtagggtcggacggaccgtaccgtaccaaccgtcgtactaccgaacgtaactaaccgtaacgtacaacggtaaccgtaccgtactacgttaacgtcctaagtaccgtaactacggtaacgaccgtactaagggactaacggtacgtacggaacgttaccggacgttaccgttaacggtagtttaaacgtccggtggttaacgaccgtaaggttacggacggttggacgttacgggttacgtacgttaaccggg

SEQ ID NO: 230753 - DNA, 671 bp, Homo sapiens
  misc_feature: GYAE6OF02JEEA4.3.4.A04.1.454.CMB.1.raw
  modified_base (400)..(400): a, c, t, g, unknown or other
  misc_feature (400)..(400): n is a, c, g, or t
  modified_base (567)..(567): a, c, t, g, unknown or other
  misc_feature (567)..(567): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcttgggttttcctcgttgcttcttttaaggaggtgtccagtcgccaggtgcgagcgtgggtaggagtcggtggggggagcggtggcccaggccgtggggacggtcccgaaggtaaccttcgtccgtgtaccagtccttcgtaggtacttccgtaaccgtttaaggttactagtcgtcttagtcgactaccggttcggggtaccccggccgggtcctaccggagggtcggtaaggggcgtgggacgggttggggngactagttactactccagtgagtgggaagtctaagtaactccgtagcgtagtaccgtcggaggacgggtcctataccgacattccgacgagaactaaccgtaactaccgaaagaacctcggtactgtacgtctagaaccgtaagtacgaaacgccgtatgaacgtcncggtaggaaccgaccgtaggtcgttaggttacgttcgtaagtcggtacggtacgtagacggtaggtaacggtacgggtcgggtaccggttaagttaaccggggg

SEQ ID NO: 230754 - DNA, 700 bp, Homo sapiens
  misc_feature: GYAE6OF02JK9JD.3.4.A04.1.454.CMB.1.raw
  modified_base (255)..(255): a, c, t, g, unknown or other
  misc_feature (255)..(255): n is a, c, g, or t
  modified_base (262)..(262): a, c, t, g, unknown or other
  misc_feature (262)..(262): n is a, c, g, or t
  modified_base (265)..(265): a, c, t, g, unknown or other
  misc_feature (265)..(265): n is a, c, g, or t
  modified_base (346)..(346): a, c, t, g, unknown or other
  misc_feature (346)..(346): n is a, c, g, or t
tcagagacgcactccacgaccggtgctcgatttagagtagtgatcaggggagctctgggagacgagcccagcactggaagtcgccggtgtttccattcggtgatcatcactgaacacagaggactcaccatggagtttgggctgagcgtggtttctcgtagctctttaagagtgtcagtgccaggtgcagctggtggagtctgggggacgcgtcggcccagccgtgggacgtcccgaggacctctacctgtaacngtctacnggnttccacctttaggttactatgctatcgcacgtcgggtcccgccggctccgagggaccgaagggtcgtgggagggtcggggngacgtagttatacgtcccaagtgtacgtggacgtacgtaaggtaacctctacggacaggtaccgtccggaaggtaaccggtaccgtacgtaccctaaccgtacgttaccgtaccctaaggtaacgtaaacgttaaaccttaaaccgaaaccggtaaaccttaccggttaccgttaggttaaccttcgttaaggaccctaaacgtaaccgtaaaccgaccgtaccgtaggtaacggtcgttaacgaggtaacggtcccgacggttacccgtttaggaccgtttaacggttaccgtaaggacggttacgaaaggtcggtacggttagacggttcgggtaacgttagttaacccggg

SEQ ID NO: 230755 - DNA, 811 bp, Homo sapiens
  misc_feature: GYAE6OF02F2DXL.3.4.A04.1.454.CMB.1.raw
tcagagacgcactccacgaccggtgctcgatttagagtagtgatcaggggagctctgggagacgagcccagcactggaagtcgccggtgtttccattcggtgatcatcactgaacacagaggactcaccatgggagtttgggctgagtcgttcgggttttacctcggttgccttacttttaaggacggttgtaccagtcgccgaggtgcagcgttgggtggacggtcggtaggggggagtccggtcggccccaggcccgtggggacgtcccgaaggtacctcctaccgtgtactcgtctcgtaggtacttcctaccgtttaggttactgtcgactagtcgcgacggttcggggcccggccgggtccgtaccggacgggcggacggggtcgtacgggtaggggtcgggtgtacgttaaggtttactaccgtacccgtagtcggtaggtacgggtacggtacgtaaacggttaacctacccgtaacgaccgtaacggtacccggttaccgggtacgggtaacggggtcccgttaacgttaccccgaacctaccgttccgaaccggtaacgtaacgtaaccgtaaccgttaaccgaaaccgtaaccgaccgtacgttacgttaccttacgtacgtaaacctaacgtaacgaaccgtacgtaccggtacggaacggtacgttaccggtacgggtaaccgggaccgttacgggtacgttacgggttaggtttaacgttaccggtggtaaccggtaaggtaacggtacgttaacgggttaggtaaccggttcggggttaacttaacggttaacgggg

SEQ ID NO: 230756 - DNA, 750 bp, Homo sapiens
  misc_feature: GYAE6OF01CZTQ8.34.13.B02.1.454.CMB.1.raw
  modified_base (159)..(159): a, c, t, g, unknown or other
  misc_feature (159)..(159): n is a, c, g, or t
  modified_base (193)..(193): a, c, t, g, unknown or other
  misc_feature (193)..(193): n is a, c, g, or t
  modified_base (267)..(267): a, c, t, g, unknown or other
  misc_feature (267)..(267): n is a, c, g, or t
tcagtacacgtgatcacgaccggtgctcgatttagtctagcgactttggctttggggctgggagaggagcccagcactagaggtcggcggtgtttccattcggtgatcagcactgaacacagaggactcacatggagttggctgagcttgggttttccncgttgctcttttaagaggtgtccagtgtcaggtncagtctggtggagtcggtgggggagcgtggacccagtcccgtgggacctcccgtgacgtcctcgtcctaggtcncgagccgtgtggtattcctaaccttcgaagttagtctagtggctaagtgcctacgtcgggtacccgccgaacggcctacccgaagggtacgaacgggggctaggggaggtggggtggacctaaggttataaggtgggtaagtaggtaacgttaggggaaagtacggttaacgaaattaaccgtagttacggacccgtaagtacccgtacccggttagggaacggggtacccgtaacgttacccgtaacccgtacgtaaccggtaaagaacgtaaaccctaacgtaaccccgaaagtaacccgagtccgttaacggtaactcgtaacgaacccgtaaaagttaccggaaaccccgagtaccccggtaggaacgggtacccggaaccggaaaccggggaaccgaaccggtaccgttaaattacggtttaattaacccgttggaacggaccggaaaggaaacgaaccggtaccgaacgtaccccgg

SEQ ID NO: 230757 - DNA, 938 bp, Homo sapiens
  misc_feature: GYAE6OF01DP1QD.34.13.B02.1.454.CMB.1.raw
tcagtacacgtgatcacgaccggtgctcgatttagtctagcgactttgggtttaggggctggggagaggagcccagcactagaggtcggccggtgtttccattcggtgatcagcactgaacacagaggactcaccgatggagtttgggctgagcttgggttttccctgttgcttctttttaagaggtgtccaggtgtcgaggtgacagctggtggagtcgtgggggacgcgtcgggccctaggtcccgttaggggaccgttcccctggaacgtaaccttccgttacccgttaggttcgaccgtaagggttacccgttacgttaacggggtaacctttcccgaaaccccgtttttaccgaaacggttttaaccggttacctaaacggttcgggtaaccttaacggtttccggaacccgttaccgggtttaccggggggttccccgacccgggtaacgggggtccccttaccccggggaacgggggaccggtaaaacgggggggttcccttaagggggaacgggtttcgggggtacgggtaccgttaaagggtttaacgtaaggttagggtttaaacttgggaacgtttaaggggtaaacttacggtaaactaaaacgttaccgttaaagtccggaccgtaaaggtacccgttacggtaagggaaccgggtacccgttagttaaccccggtacccggttccttaaccggtaaagtaccggtaaacctaaacgttaaccccgaaagtacccgtaccgtcgtttaacttaacgtcgtaacgtaaccgaaacgtccggaaccgacgtaaccgtaacgggaacgaacggtaacccgggtaacggaacccgttacgggtaccgttaaacgttaggtttaaccttacggttacggtggtaaccggtaacggaaacgtaccgaaaccggtcgtaacccgttaaccgg

SEQ ID NO: 230758 - DNA, 743 bp, Homo sapiens
  misc_feature: GYAE6OF01BODOU.34.13.B02.1.454.CMB.1.raw
  modified_base (179)..(179): a, c, t, g, unknown or other
  misc_feature (179)..(179): n is a, c, g, or t
  modified_base (733)..(733): a, c, t, g, unknown or other
  misc_feature (733)..(733): n is a, c, g, or t
tcagtacacgtgatcacgaccggtgctcgatttagtctagcgactttgagtttggggctgggagaggagcccagcactagaggtcggcggtgtttccattcggtgatcagcactgaacacagaggactcaccatggagtttgggctgagcttgggttttcctcgttgcttcttttaagnggtgtccagtgtcaggtgcagctggtggagtcgtgggggagcgtggccccagccgtgggaccgtcccgtgacgtacctccgttcctggtgcctaggtccgttcgtaggtacttcctaacccgtttcaaggttacgtccagttcgggacctagttcgaccgtaccggttcggggtccccgcccgaagggtccctacccggaagggaccggaaacgggggtcgtaggggtaaggttggggtacgaccgttaaggtttaagtagttagggtaagttagaacggttaggggtaaaagttacgtaaccgtaaaattaccgttaatcggaccgtaaacggttaccgttacccgggtaaggggtaaacgggtccccggtaaatttacccccgaccgttaccgtaccgaaagtaaccgaactaaacctacccgaaagacctacgtctagtactcgtagaaccgaagtcgaaccgcgaccgtaggaacgacgtaccggaagaaccgtacggaattaacgttgttaacgttcgtgggacgtaccgaaggtaacgtacggaccgnggtaaccccg

SEQ ID NO: 230759 - DNA, 725 bp, Homo sapiens
  misc_feature: GYAE6OF01C23FJ.34.13.B02.1.454.CMB.1.raw
  modified_base (138)..(138): a, c, t, g, unknown or other
  misc_feature (138)..(138): n is a, c, g, or t
  modified_base (180)..(180): a, c, t, g, unknown or other
  misc_feature (180)..(180): n is a, c, g, or t
  modified_base (251)..(251): a, c, t, g, unknown or other
  misc_feature (251)..(251): n is a, c, g, or t
  modified_base (256)..(256): a, c, t, g, unknown or other
  misc_feature (256)..(256): n is a, c, g, or t
  modified_base (272)..(272): a, c, t, g, unknown or other
  misc_feature (272)..(272): n is a, c, g, or t
tcagtacacgtgatcacgaccggtgctcgatttagtctagcgactttggctttggggctgggagaggagcccagcactagaggtcggcggtgtttccattcggtgatcagcactgaacacgagaggactcaccatggngttggctgagcgtgggttttcctcgttgctactttagaggtntccagtgtcgaggtgcaggcttgggcggagtcggtggggacgcgtcggaccctagccgtgggaccgtccgnggacncctctccgtgtcgacnggtcgtcgtcggtacttccgtaccttacgtaggtacgtctaagtggactagtcgtaccgtaccggttcccggcgaccggaacggtcctaccggaggacgggaacggggtcgaggggtaggttcggggaagtccgtagtttaagtcggtagagttgaacgtagggactataccgtaagtacttgacgacgacgtaccgttaccggaggtaaccggtacgtccgttaccgtaccgtacgaccgtaacgaacgtaaacgaacccttaacccgaaacgtaaccgtaccggttacgttaaccgttacgtaccgtacgaaccttaaacgacgaaccgacgttaacggacgaacggtccgaaaccgggtacgtaaccggaacgttaaccgtaacgtttagttaaccggtttaagtcccggttaggaaccgtaaaggacggaaaccgccggtaacacccgg

SEQ ID NO: 230760 - DNA, 745 bp, Homo sapiens
  misc_feature: GYAE6OF01D5ZDS.34.13.B02.1.454.CMB.1.raw
  modified_base (106)..(106): a, c, t, g, unknown or other
  misc_feature (106)..(106): n is a, c, g, or t
  modified_base (174)..(174): a, c, t, g, unknown or other
  misc_feature (174)..(174): n is a, c, g, or t
  modified_base (499)..(499): a, c, t, g, unknown or other
  misc_feature (499)..(499): n is a, c, g, or t
  modified_base (633)..(633): a, c, t, g, unknown or other
  misc_feature (633)..(633): n is a, c, g, or t
  modified_base (712)..(712): a, c, t, g, unknown or other
  misc_feature (712)..(712): n is a, c, g, or t
tcagtacacgtgatcacgaccggtgctcgatttagtctagcgacttttgggtttgtggctgggagaggagcccagcactagaggtcggcggtgtttccattcggtnatcagcactgaacacgagacggctcaccagtggagtttgggctgagtcgttgggttttcctcggttanctttacgttttaagcggttctccgaggttcgtcgaggtcgctaggtcgtgggtaggtacggttccgggagggggcttccgttaccgggacccagggtcccggttcgggaacccgttccctagggacctaccttccggttcgttaggtcgacgtacggtccgttgtacggtcttaccgttaccgttgaaggttacgtatacggttcggactacggttcgaccgtaccgggttccggggtacccaccggtacggtacctaccgggacgggtacgggaacggggttcgtagggtagggtcgggtacgtagtacgttagtaggtgtagngttagtaggaagttcgactaagtccgtatcggtacgtaccggtacgtacggacggtaccggtacttacgtcgacccgtctaacgaacgaaccgtaaccgtaacctacccgtaaagcccgtaacgtacgtttaanccggttacgtaactaacgacgtacgaaccgtcggaacgtcggaacgaccggacgtacgacggtcgtacttagtcgttancggtactacgggaacagagaccgtcaaggtccg

SEQ ID NO: 230761 - DNA, 722 bp, Homo sapiens
  misc_feature: GYAE6OF02H6H1S.34.13.B02.1.454.CMB.1.raw
tcagtacacgtgatcacgaccggtgctcgatttagtctagcgactttgggtttgaggctgggagaggagcccagcactagaggtcggcggtgtttccattcggtgatcagcactgaacacagaggactcaccatggagtttgggctgagctgggttttcctgttgctcttttaagaggtgtccagtgtcaggtgcagctggtggagtcgtgggggagcgtggcccaggtcccgtgggacctcccgtagacgtacttcctccgtgtgccgagtccgttcgtgggtactttccgacctttcgaggttacgtccaagttcgggactaagttcggaccgtaacggttcgggggtaccccaccggtaggtccctaccggagggaccgtaaggggggccttaggggtaggttcgggggtacgtactaggtttaactaggttggtaactggaagttagggtaaacgttacgtactaaagttcgtagtcggacgtacggtacgttaccggtagggtaacgggttacccgtaacgttaccgtacccgttacgaccgtaacggtacgaaaccgttaacctaaccccgaaagtaaacccgtgtaccttacgttaacgttccgtaacgaaccgtaaacgttaccgaccgacgtccgtaggtaccgacgaccggaggaccgacggtactacgttagtacttacgtcggtacgcgagtacgagtaccgacgtcccg

SEQ ID NO: 230762 - DNA, 637 bp, Homo sapiens
  misc_feature: GYAE6OF02HQBWU.34.13.B02.1.454.CMB.1.raw
  modified_base (433)..(433): a, c, t, g, unknown or other
  misc_feature (433)..(433): n is a, c, g, or t
tcagtacacgtgatcacgaccggtgctcgatttagtctagcgactttgagtttggggctgggagaggagcccagcactagaggtcggcggtgtttccattcggtgatcagcactgaacacagaggactcaccatggagtttgggctgagcttgggtttttcctcgttgcttctttttaaggaggtgtccagtgtcaggtgcagctggtggagtcgtgggggagcgtggcccaggccgtgggacctccgtgacgtctcctcctggtgcagccgtcgtggtattccacctttcagttacgtcagtggactagtgccacgttcggggtcccaccacgggcctaccggaagggccgaaagggggcgttgggacggttggggtcgacgtagtttacgtagtggtatggaagtggtaaagtgtaacaaagttacttagngtactagtaccgtcggtaggaacgggtcctacgttccgtaccgttctaccgaagtaacgaactaaaccgtacccgaaagtaccacgtctagtactcgtagtaacaacgtcgaaccgtagccgtagaccgacgaccggaggacaacgggtaacttacgtagttaacgttacgtaggttcgaacggaggaagacgaccacggaccg

SEQ ID NO: 230763 - DNA, 912 bp, Homo sapiens
  misc_feature: GYAE6OF02IT6RN.34.13.B02.1.454.CMB.1.raw
tcagtacacgtgatcacgaccggtgctcgatttagtctagcgactttgagtttggggctgggaggaggagcccagcactagaggtcggcggtgtttccattcggtgatcagcactgaacacagaggactcaccatgggtaggtttgggtcgtggaggtcgtttcggggttttttccttccggtttcggtcctttacttttttaaaggtagggttcggttccgtaggttggttcgtagggtggcgaggtcgttgggttgggtaggttcgggttggggggacgggtcggtcgggcccgacggtccggtcgggtaccggtcccgtcacgggggggggggggggggggggggggggggtaccttccgttccgttcggtcggtccgaacggtaccggttcgttcgggtactttaccgttacccctttaccgtaacggttaacggttcgtacgttcggccgtaagtacgtccgtaccggttccggggttccccggtccccggaccgggtcccgttacccggaacgggaccgggtaaacggggggtaccggttgggggtaggggttgggggtcgggtaccggtaacggtttaagttaggttagggttaggttaggtaggtagggtaaaggttaagtaacgtaaacgttaacgttagttacgacgtacgtacgtacccggtaggaaccgggtacgtacttccgtaccgtacgtacgaacggtaactaacctaaccgttaacccaaacgtaaccgtaccgtctagtaaccgttccgtaacggacctaaacgttaccaaccgtcggttacccgtaggaaccgaaccgggaaccgggtacggaaccggtaaccggtaagttacgttaggttaacgttacggtacggttacgacggaagaacgggtaacgtaccacggaacccg

SEQ ID NO: 230764 - DNA, 746 bp, Homo sapiens
  misc_feature: GYAE6OF02ISLRI.34.13.B02.1.454.CMB.1.raw
  modified_base (165)..(165): a, c, t, g, unknown or other
  misc_feature (165)..(165): n is a, c, g, or t
  modified_base (356)..(356): a, c, t, g, unknown or other
  misc_feature (356)..(356): n is a, c, g, or t
  modified_base (390)..(390): a, c, t, g, unknown or other
  misc_feature (390)..(390): n is a, c, g, or t
tcagtacacgtgatcacgaccggtgctcgatttagtctagcgactttggtttgaggctgggagaggagcccagcactagaggtcggcggtgtttccattcggtgatcagcactgaacacagaggactcaccatggagtttggctgagctggtttcctcgttgctnttttagaggtgtccagtgtcaggtgcagctggtgagtcgtgggggagcgtggcccagcctgggacgtccctgagacctctcctgtgacagccgtctggtacttcgtaccttcgacgtagtccagtggcatcgcacgttgggtcccgaccaggctccgaggcgaaggggctgggagtggggtagctaagttntagtggtatgagtcggaagtagtctaaatcgtancgcgaacgtactcccggtagggaaacgggtaccgacttcctaacccggtccgtaacccagggaactaaaccgaaacgtaccccctaaaaggaaacccccgaacgtaccggtttacgtaaccggtacttacggtaaaccgaaaacgtttaccgaaacccccggttaacggaccccgttttaaaggggaacgggttaaccccgggacccggggaaaccgggttaaacccccggaaccgggggttaaccctttaaccgggtttaacggtttaaaccggttttaacccgttacgggggttaacgttaaccggggtacccggaaagggttaaaccgggaaccgttacccggaacccccggg

SEQ ID NO: 230765 - DNA, 125 bp, Homo sapiens
  misc_feature: GYAE6OF01ALLGY.10.13.B02.1.454.CMB.1.raw
  modified_base (125)..(125): a, c, t, g, unknown or other
  misc_feature (125)..(125): n is a, c, g, or t
tcagcatagtagtgcacgaccggtgctcgatttagtctagcgactttggggcacagcggccctgggctgcctggtcaaggactacttcccactactatgctgagcgggctggcaaggcgcatagn

SEQ ID NO: 230766 - DNA, 129 bp, Homo sapiens
  misc_feature: GYAE6OF01BSP7U.10.13.B02.1.454.CMB.1.raw
  modified_base (125)..(129): a, c, t, g, unknown or other
  misc_feature (125)..(129): n is a, c, g, or t
tcagcatagtagtgcacgaccggtgctcgatttagtctagcgactttggggcacagcggccctgggctgcctggtcaaggactacttcccactactatgctgagcgggctggcaaggcgcatagnnnnn

SEQ ID NO: 230767 - DNA, 127 bp, Homo sapiens
  misc_feature: GYAE6OF01EQPSE.10.13.B02.1.454.CMB.1.raw
  modified_base (126)..(127): a, c, t, g, unknown or other
  misc_feature (126)..(127): n is a, c, g, or t
tcagcatagtagtgcacgaccggtgctcgatttagtctagcgactttgggggcacagcggccctgggctgcctggtcaaggactacttcccactactatgctgagcgggctggcaaggcgcatagnn

SEQ ID NO: 230768 - DNA, 125 bp, Homo sapiens
  misc_feature: GYAE6OF01C4RFK.10.13.B02.1.454.CMB.1.raw
  modified_base (124)..(125): a, c, t, g, unknown or other
  misc_feature (124)..(125): n is a, c, g, or t
tcagcatagtagtgcacgaccggtgctcgatttagtctagcgactttggggcacagcggccctggctgcctggtcaaggactacttcccactactatgctgagcgggctggcaaggcgcatagnn

SEQ ID NO: 230769 - DNA, 128 bp, Homo sapiens
  misc_feature: GYAE6OF01CP4G2.10.13.B02.1.454.CMB.1.raw
  modified_base (126)..(128): a, c, t, g, unknown or other
  misc_feature (126)..(128): n is a, c, g, or t
tcagcatagtagtgcacgaccggtgctcgatttagtctagcgactttgggggcacagcggccctgggctgcctggtcaaggactacttcccactactatgctgagcgggctggcaaggcgcatagnnn

SEQ ID NO: 230770 - DNA, 126 bp, Homo sapiens
  misc_feature: GYAE6OF02GFEDW.10.13.B02.1.454.CMB.1.raw
  modified_base (126)..(126): a, c, t, g, unknown or other
  misc_feature (126)..(126): n is a, c, g, or t
tcagcatagtagtgcacgaccggtgctcgatttagtctagcgactttgggggcacagcggccctgggctgcctggtcaaggactacttcccactactatgctgagcgggctggcaaggcgcatagn

SEQ ID NO: 230771 - DNA, 127 bp, Homo sapiens; identical to SEQ ID NO: 230767
  misc_feature: GYAE6OF02FI11X.10.13.B02.1.454.CMB.1.raw
  modified_base (126)..(127): a, c, t, g, unknown or other
  misc_feature (126)..(127): n is a, c, g, or t

SEQ ID NO: 230772 - DNA, 154 bp, Homo sapiens
  misc_feature: GYAE6OF01BBDVF.29.79.H02.1.454.CMB.1.raw
  modified_base (153)..(154): a, c, t, g, unknown or other
  misc_feature (153)..(154): n is a, c, g, or t
tcagatagagtactcacgaccggtgctcgatttagtgtcacacgaagggaaagggaccaaggtggaagtcaaaggaactgtggctgcaccatctgtcttcatcttcccaccctcctcatagcgtactctgagcgggctggcaaggcgcatagnn

SEQ ID NO: 230773 - DNA, 158 bp, Homo sapiens
  misc_feature: GYAE6OF01EP59F.29.79.H02.1.454.CMB.1.raw
  modified_base (153)..(158): a, c, t, g, unknown or other
  misc_feature (153)..(158): n is a, c, g, or t
tcagatagagtactcacgaccggtgctcgatttagtgtcacacgaagggaaagggaccaaggtggaagtcaaaggaactgtggctgcaccatctgtcttcatcttcccgccctcctcatagcgtactctgagcgggctggcaaggcgcatagnnnnnn

SEQ ID NO: 230774 - DNA, 281 bp, Homo sapiens
  misc_feature: GYAE6OF01CEGHI.13.70.G04.1.454.CMB.1.raw
  modified_base (276)..(281): a, c, t, g, unknown or other
  misc_feature (276)..(281): n is a, c, g, or t
tcagtcacgtactacacgaccggtgctcgatttagtgtagtgtgaagggaaaggggactataccggggcgatattcgcgacctggacttctacttctacatggacgtctgggcaaagggaccacggtcaccgtctcctcagcctccaccaagggcccatcggtcttccccctggcgccctgctccaggagcacctccgagagcacagcggccctgggctgcctggtcaaggactacttcctagtacgtgactgagcgggctggcaaggcgcatagnnnnnn

SEQ ID NO: 230775 - DNA, 153 bp, Homo sapiens
  misc_feature: GYAE6OF01CRLZG.13.70.G04.1.454.CMB.1.raw
  modified_base (153)..(153): a, c, t, g, unknown or other
  misc_feature (153)..(153): n is a, c, g, or t
tcagtcacgtactacacgaccggtgctcgatttagtgtagtgtgaagggaaagggacacgactggagattaaacgaactgtggctgcaccatctgtcttcatcttcccgccatctgatagtacgtgactgagcgggctggcaaggcgcatagn

SEQ ID NO: 230776 - DNA, 277 bp, Homo sapiens
  misc_feature: GYAE6OF01DPKDE.13.70.G04.1.454.CMB.1.raw
  modified_base (273)..(277): a, c, t, g, unknown or other
  misc_feature (273)..(277): n is a, c, g, or t
tcagtcacgtactacacgaccggtgctcgatttagtgtagtgtgaagggaaaggggactataccggggcgatattcgcgacctggacttctacttctacatggacgtctggggcaaagggaccacggtcaccgtctcctcagcctccaccaaggcccatcggtcttcccctggcgccctgctccaggagcacctccgagagcacagcggccctgggctgcctggtcaaggactacttcctagtacgtgactgagcggctggcaggcgcatagnnnnn

SEQ ID NO: 230777 - DNA, 305 bp, Homo sapiens
  misc_feature: GYAE6OF01DPAVB.13.70.G04.1.454.CMB.1.raw
  modified_base (280)..(280): a, c, t, g, unknown or other
  misc_feature (280)..(280): n is a, c, g, or t
  modified_base (282)..(305): a, c, t, g, unknown or other
  misc_feature (282)..(305): n is a, c, g, or t
tcagtcacgtactacacgaccggtgctcgatttagtgtagtgtgaagggaaagggactataccggggcgatattcgcgacctggacttctacttctacatggacgtctggggcaaaagggaccacggtcaccgtctcctcagcctccacaagggcccatcggtcttccccctggccgccctgctccaggagcacctccgagagcacagcggccctgggctgcctggtcaaggactacttcctagtacgtgactgagcgggctggacaaggcgacaatagncnnnnnnnnnnnnnnnnnnnnnnnn

SEQ ID NO: 230778 - DNA, 295 bp, Homo sapiens
  misc_feature: GYAE6OF01CHJPL.13.70.G04.1.454.CMB.1.raw
  modified_base (278)..(295): a, c, t, g, unknown or other
  misc_feature (278)..(295): n is a, c, g, or t
tcagtcacgtactacacgaccggtgctcgatttagtgtagtgtgaagggaaaggggactataccggggcgatattcgcgactggacttctacttctacatggacgtctgggcaaagggaccacggtcaccgtctcctcagcctccaccaagggcccagtcggtcttccccctggccgccctgctccaggagcacctccgagacgcacagcggccctgggctgcctggtcaaggactacttcctagtacgtgactgagcgggctggcaaggcgacatgnnnnnnnnnnnnnnnnnn

SEQ ID NO: 230779 - DNA, 443 bp, Homo sapiens
  misc_feature: GYAE6OF02F3GOF.13.70.G04.1.454.CMB.1.raw
  modified_base (437)..(443): a, c, t, g, unknown or other
  misc_feature (437)..(443): n is a, c, g, or t
tcagtcacgtactacacgaccggtgctcgatttagtgtagtgtgaagggaaggggctggagtgggtaggtttcattaggagcaattctcatgatgggacaacagaatacgccgcgtctgtaaaaggcagattcaccatctcaagagatgagtccagaagcatcgcctttctgcagatgagtagcctgaagaccgaggacacagccatctattactgtgctagagagtattgcagtcctacgacctgctatgggggccttggtggccactggggccagggcaccctggtcaccgtctccgcagcctccaccaagggcccatcggtcttccccctggcaccctcctccaagagcacctctgggggcacagcggccctgggctgcctggtcaaggactacttcctagtacgtgactgagcgggctggcaaggcgcatagnnnnnnn

SEQ ID NO: 230780 - DNA, 282 bp, Homo sapiens
  misc_feature: GYAE6OF02F1KM6.13.70.G04.1.454.CMB.1.raw
  modified_base (279)..(282): a, c, t, g, unknown or other
  misc_feature (279)..(282): n is a, c, g, or t
tcagtcacgtactacacgaccggtgctcgatttagtgtagtgtgaagggaaaggggactataccggggcgatattcgcgacctggacttctacttctacatggacgtctggggcaaagggaccacggtcaccgtctcctcagcctccaccaagggcccatcggtcttccccctggcgccctgctccaggagcacctccgagagcacagcggccctgggctgcctggtcaaggactacttcctagtacgtgactgagcgggctggcaaggcgcattaggnnnn

SEQ ID NO: 230781 - DNA, 285 bp, Homo sapiens
  misc_feature: GYAE6OF02HFRFG.13.70.G04.1.454.CMB.1.raw
  modified_base (276)..(285): a, c, t, g, unknown or other
  misc_feature (276)..(285): n is a, c, g, or t
tcagtcacgtactacacgaccggtgctcgatttagtgtagtgtgaagggaaaggggactataccggggcgatattcgcgacctggacttctacttctacatggacgtctggggcaaagggaccacggtcaccgtctcctcagcctccaccaagggcccatcggtcttcccctggcgccctgctccaggagcacctccgagagcacagcggccctgggctgcctggtcaaggactacttcctagtacgtgactgagcgggctggcaaggcgcatagnnnnnnnnnn

SEQ ID NO: 230782 - DNA, 154 bp, Homo sapiens
  misc_feature: GYAE6OF02GN2NV.13.70.G04.1.454.CMB.1.raw
  modified_base (153)..(154): a, c, t, g, unknown or other
  misc_feature (153)..(154): n is a, c, g, or t
tcagtcacgtactacacgaccggtgctcgatttagtgtagtgtgaagggaaagggacacgactggagattaaacgaactgtggctgcaccatctgtcttcatcttcccgccatctgatagtacgtgactgagcgggctggcaaggcgcatagnn

SEQ ID NO: 230783 - DNA, 446 bp, Homo sapiens
  misc_feature: GYAE6OF02F6IB9.13.70.G04.1.454.CMB.1.raw
  modified_base (436)..(436): a, c, t, g, unknown or other
  misc_feature (436)..(436): n is a, c, g, or t
  modified_base (442)..(446): a, c, t, g, unknown or other
  misc_feature (442)..(446): n is a, c, g, or t
tcagtcacgtactacacgaccggtgctcgatttagtgtagtgtgaagggaaggggctggagtgggtaggtttcattaggagcaattctcatgatgggacaacagaatacgccgcgtctgtaaaaggcagattcaccatctcaagagatgagtccagaagcatcgcctttctgcagatgagtagcctgaagaccgaggacacagccatctattactgtgctagagagtattgcagtcctacgacctgctatggggccttggtggccactggggccagggcaccctggtcaccgtctccgcagcctccaccaagggcccatccggtcttcccccctggccaccctcctccaacgacgcacctctgggggcacagccggccctgggctgcctggtcaaggacctacttcctagtacgtgactgagcgggctggcaggcncatagnnnnn

SEQ ID NO: 230784 - DNA, 289 bp, Homo sapiens
  misc_feature: GYAE6OF02F00V7.13.70.G04.1.454.CMB.1.raw
  modified_base (279)..(282): a, c, t, g, unknown or other
  misc_feature (279)..(282): n is a, c, g, or t
  modified_base (284)..(289): a, c, t, g, unknown or other
  misc_feature (284)..(289): n is a, c, g, or t
tcagtcacgtactacacgaccggtgctcgatttagtgtagtgtgaagggaaagggactataccggggcgatattcgcgacctggacttctacttctacatggacgtctggggcaaagggaccacggtcaccgtctcctcagcctccaccaagggcccatcggtcttccccctggcgccctgctccaggagcacctccgagagcacagcggccctgggctgcctggtcaaggactacttcctagtacgtgactgagcgggctggcaaggcgcattaggannnncnnnnnn

SEQ ID NO: 230785 - DNA, 295 bp, Homo sapiens
  misc_feature: GYAE6OF02IXB0E.13.70.G04.1.454.CMB.1.raw
  modified_base (280)..(295): a, c, t, g, unknown or other
  misc_feature (280)..(295): n is a, c, g, or t
tcagtcacgtactacacgaccggtgctcgatttagtgtagtgtgaagggaaaggggactataccggggcgatattcgcgacctggacttctacttctacatggacgtctggggcaaagggaccacggtcaccgtctcctcagcctccacaagggcccatcggtcttcccctggccgccctgcctccaggagcacctccgagagcacagcggccctgggctgcctggtcaaggactacttcctagtacgtgactgagccgggctgggcaaggcgcagtagnnnnnnnnnnnnnnnn

SEQ ID NO: 230786 - DNA, 322 bp, Homo sapiens
  misc_feature: GYAE6OF02IQXGH.13.70.G04.1.454.CMB.1.raw
  modified_base (191)..(191): a, c, t, g, unknown or other
  misc_feature (191)..(191): n is a, c, g, or t
  modified_base (274)..(274): a, c, t, g, unknown or other
  misc_feature (274)..(274): n is a, c, g, or t
  modified_base (281)..(281): a, c, t, g, unknown or other
  misc_feature (281)..(281): n is a, c, g, or t
  modified_base (283)..(283): a, c, t, g, unknown or other
  misc_feature (283)..(283): n is a, c, g, or t
  modified_base (287)..(287): a, c, t, g, unknown or other
  misc_feature (287)..(287): n is a, c, g, or t
  modified_base (291)..(322): a, c, t, g, unknown or other
  misc_feature (291)..(322): n is a, c, g, or t
tcagtcacgtactacacgaccggtgctcgatttagtgtagtgtgaagggaaaggggactataccggggcgatattcgcgacctggacttctacttctacatggacgtctggggcaaagggaccacggtcaccgtctcctcagcctccaccaagggcccatcggtcttcccctggccgccctgcctccaggngcacctccgagagcacagcggccctgggctcgcctggtacaaggctacttcctagtacgtgactgagcgggctggacaaggcncataggntncgtnagcnnnnnnnnnnnnnnnnnnnnnnnnnnnnnnnn

SEQ ID NO: 230787 - DNA, 910 bp, Homo sapiens
  misc_feature: GYAE6OF02G9KKQ.41.14.B03.1.454.CMB.1.raw
tcagtctatactatcacgaccggtgctcgatttagtgtgagtagttaggggttagggggggagagggagcccaggcgactgggactccgaggtgttccgattcggtgactccagcgacctggaacacagaggactcaccactcggacgtttggctgaggctgcggtttccttggtcgctatttaaaggtcgtccactgtgacgatcgtaccgtggtggtaggtctcggaggcggcttgatccagccggggggtccctgtagtactcctcagtgtcgcgagccgttcgtacgggttttaaggtgttactaagttagtactactacagtacgaagcgtacggttcccggacccgaaggaacccctttaaccgaacggggtaaacggtccggtacgttagggtaaaggttcgggggttaccttacgtaaggttttaccgtttaccgtacccggtacggtttacgggtaaacctacccgttttaccttaccgttccgtaacggtacccttacccgggttaggtaaccggggggtacccgtaacgtttacccgaaacgtttcccctaaccgtttacccgtaccccgtaaacggtaaccggtaaccccgggttacccgggtacccccgtaaaaacgttaaacgttaacgtttacgggtttacggttaacggtttaccggtttaggtaaaccttagttaacgtaaacctaaccgtttaggtaaccgtaacggtacccggtaaacgtaaccggtaaccgggtaccccgttacggttaaacgtttaccgttacggttccggtaccgggtaacggggttccggtaaggggtttacggtacggggtaagggtaccgggtacccgaccgggtcccccggtgggtacccgtaccggtccgggggacccggggtaacccccggg

SEQ ID NO: 230788 - DNA, 176 bp, Homo sapiens
  misc_feature: GYAE6OF02GRGAL.41.14.B03.1.454.CMB.1.raw
  modified_base (171)..(176): a, c, t, g, unknown or other
  misc_feature (171)..(176): n is a, c, g, or t
tcagtctatactatcacgaccggtgctcgatttagtgtgagtagttccgcgggcacgaccggtgctcgatttagtgtgagtagttccgcggcacgaccggtgctcgatttagtgtgagtagttccgccctcctcatagtatagactgagcgggctgggcaaggcgcatagnnnnnn

SEQ ID NO: 230789 - DNA, 607 bp, Homo sapiens
  misc_feature: GYAE6OF01CMQ1S.47.36.D03.1.454.CMB.1.raw
tcagagctcacgtacacgaccggtgctcgatttagctgcgtcacgatctctcttggggcaggagtcagacccagtcaggacacagcatggacatgagggtcccgctcagctcctggggctcctgttgctctggttcccaggttccagatgcgacatccagatgacccagtctccatcttctgtgtctgcttctgtaggagacagagtcaccatcacttgcgggcgagtcagggtattagcaactggttagcctggtatcaacagaaaccagggaaagcccctaacctcctcatctctactgcatccactttgcaaagtgggtcccatcaaggttcagcggcagtggatctgggacagatttcactctcactatcagcagcctgcagcctagaacgtattttggaactttattaattgttacaaacgtaggggttaaacctacggttttacccccgcttacccgtaacccgtttccggggaccgggtaacggggtaaccccgtaaagggggttcgggaaaggtaaagttaacgggaaaaaacggtaaccgtttacgggttacgggtacccttacgggaccctaaacccgtaacgttccgtttaccggg

SEQ ID NO: 230790 - DNA, 496 bp, Homo sapiens
  misc_feature: GYAE6OF01CWZVH.47.36.D03.1.454.CMB.1.raw
tcagagctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcagcagaaaccagggaaagttcctaagctcctgatctatgttacatccactttgcaattcggggtccatctcggttcagtggcagtggatctggggacagatttcactctcaccatcagcagcctgcagcctgaagatgttgctaacttattactgtacaaaaatataaacagtgccccgctcactttcggcggacgggaccagggttggagatacaaacgaactgtggctgacc

SEQ ID NO: 230791 - DNA, 501 bp, Homo sapiens
  misc_feature: GYAE6OF01EIKWN.47.36.D03.1.454.CMB.1.raw
tcagagctcacgtacacgaccggtgctcgatttagctgcgtcacgatctctcttggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggagtctgggggagacttggtcaagcctggagggtccctgagactctcctgtgcagcctctggattcaccttcagtgactactacatgagctggatccgcaggctcgagggaaggctggagtggattgcttacatcagtgtagtggtattaccatatactacgcagactctgtgaagggccattcaccgtctccgagggacaacgccaagaatcattggatctgcgaatgaacagcctgagacgccgaggaccggtccgtttatcgtgcgcgagacggcctctcgtccctag

SEQ ID NO: 230792 - DNA, 566 bp, Homo sapiens
  misc_feature: GYAE6OF01C82Z0.47.36.D03.1.454.CMB.1.raw
tcagagctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaacgcccctaacctcctcatctctactgcatccatttgactaaaggtcgggtacccatcgaaggttcagcggcaggtgatcgtagggacagtatttcactctacactatcagcagcctgcagcctagaagtattttaggaactttatttattagtacaacgtagggttaacctacgtttccccgcttacccgaccgtttcgggacgggtacgggaaccgtaagggtaggaagtaagtaaggaaaaaggtacgttggtacggtacttacgacctaacctagttcgttacg

SEQ ID NO: 230793 - DNA, 544 bp, Homo sapiens
  misc_feature: GYAE6OF01C474G.47.36.D03.1.454.CMB.1.raw
  modified_base (462)..(462): a, c, t, g, unknown or other
  misc_feature (462)..(462): n is a, c, g, or t
  modified_base (535)..(535): a, c, t, g, unknown or other
  misc_feature (535)..(535): n is a, c, g, or t
tcagagctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttggtcgggcgagtcagggtattagcaactggttagcctggtatcaacagaaaccagggaaacgcccctaacctcctcatctctactgcatccactttgactaaaggtcgggtaccccagtcgaaaggttcaggcggacaggtggactcgtagggacagtattcactctcactatcagcagcctgcagcctagaagtattttggaactttattattgtacaacgtagggttaactacgttcccncttacgtaccgttcgggcggacggaccgaagggtggaagtataaggaaaagacgttgacggtactagccaacnttcgttacg

SEQ ID NO: 230794 - DNA, 640 bp, Homo sapiens
  misc_feature: GYAE6OF01CLY44.47.36.D03.1.454.CMB.1.raw
tcagagctcacgtacacgaccggtgctcgatttagctgcgtcacgatctctcttgggggcaggagtcagacccagtcaggacacagcatggacatgagggtcccgctcagctcctggggctcctgctgctctggttcccaggtgccaggcgtgacatccagatgacccagtctccatcctcctgtctgcatctgtaggagacagagtcaccatcacgttcggccgggcgagtcgagggtcgttgcaaatgtctttggcctggttcagcagacacgagggaacgcccgtaagcgcctgactctagtggtgcaatactactttgacgtaaagggttcggggtaccccaagttacgtaaacggttccaaggtcgggtcgtaagggtacggttacgtacggggtaactagggtacgttccacgttcctacgtaacgttacgtcgaacggtcggtcctcggactacggtcctagaacgtacttcgtacgacttaaacttacgtttacgtacgttccttaccgtagttacgttcgacttcggtaccctttaccccgtcgggttaaccgtttaccgggacccgtaaaggggtacccgtaagggtaacggaaacgttaacggaaacgtaggttacggtggtcgtacgg

SEQ ID NO: 230795 - DNA, 525 bp, Homo sapiens
  misc_feature: GYAE6OF01CCQ8W.47.36.D03.1.454.CMB.1.raw
  modified_base (516)..(516): a, c, t, g, unknown or other
  misc_feature (516)..(516): n is a, c, g, or t
tcagagctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaacgtggttagcctggtatcaacagaaaccagggaaacgcccctaactcctcatcctctactgcatccactttgacaaagtcgggtaccatcgaaggttcagcggcagtgatcgtgggacagtatttcactctcactatcagcagcctgcagcctagaagtatttaggaactttattattgtacaagtaggtaactcgtttcccgcttcgaccttcggcggacgggtaccaagggtgaagagtaggaaaagtacgtggtcgctagacctaccngttcgttcg

SEQ ID NO: 230796 - DNA, 516 bp, Homo sapiens
  misc_feature: GYAE6OF01B5HQX.47.36.D03.1.454.CMB.1.raw
tcagagctcacgtacacgaccggtgctcgatttagctgcgtcacgatctctcttggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctgggtggagtcgtgggggagacttggtcaagcctgggagggtccctgagactctcctgtgcagcctctggattcaccttcagtgactactacatgagctggatccgccaggctccgaggggaagggactggagtggattgcttacatcagtagtagtggtattaccatatactacgcagactctgtgaagggccattcaccgtctccgagggacaacgcaagaagtcattggatctgcgaatgaacagcctggagacgccggagggaccggtccgtttatcgtgcgcgagacggccctctcctcccgtacg

SEQ ID NO: 230797 - DNA, 564 bp, Homo sapiens
  misc_feature: GYAE6OF01CEKL8.47.36.D03.1.454.CMB.1.raw
tcagagctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaacgcccctaacctcctcatctctactgcatccactttgcaaagtgggtcccatcaaggttcagcggcagtggatcgtgggacagtatttcactctcactatcagcagcctgcagcctgaagtagttttggaactttattagttgtacaacgtacgggttaaactacggttttccccgcttccgtacccgtttcgggccgggtaagggacccgtaaaggggtcggaacggtagttaaggaaaacggtaacgtggtacgggtctacggacaaccctagttccgttcgg

SEQ ID NO: 230798 - DNA, 512 bp, Homo sapiens
  misc_feature: GYAE6OF01EZBTK.47.36.D03.1.454.CMB.1.raw
  modified_base (397)..(397): a, c, t, g, unknown or other
  misc_feature (397)..(397): n is a, c, g, or t
tcagagctcacgtacacgaccggtgctcgatttagctgcgtcacgatctctcttgggggcaggagtcagacccagtcaggacacagcatggacatgagggtcccgctcagctcctggggctcctgttgctctggttcccaggttccagatgcgacatccagatgacccagtctccatcttctgtgtctgcttctgtaggagacagagtcaccatcacttgtcgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagnttctgcaacttattactgtctcctagtatgatgcttacccgtcggtacgtttccggaccgtaagggaccctaagggtacgaaagtacgaaacggtaactagtacggctgtacccg

SEQ ID NO: 230799 - DNA, 811 bp, Homo sapiens
  misc_feature: GYAE6OF01BXTRV.47.36.D03.1.454.CMB.1.raw
  modified_base (125)..(125): a, c, t, g, unknown or other
  misc_feature (125)..(125): n is a, c, g, or t
tcagagctcacgtacacgaccggtgctcgatttagctgcgtcacgagggtcctacgtacgttggggcaggagtcgaggacccacgtcaggaccacaggccagtcggtacactcgacgggtccccnctcacgctcctggggcctccgtgttcgcttcgtggttccctaggttccagtagtcgcgactactccacgactcggaccctagtcgtccgtacctcgttctgtcgtctacggtcttccgtggtaacgggaacgactaggtacggtacaacgtacttcgtacgttcggtacgggtacgacgtcgagggtcgttagaccgaaagtcggtacgttccggcgttggttcaggtcctaacgaacgtaccggtaagggaaccggtacccgtaacggccgtcccgtaggaacgttcgtacggtggtcgactaacttaccgtacgtttcggaaccgtaaacggtccggggttacccctaagggttacccgtaaaccggtttcccgaacgggtacccggtacggtaacgggttaaccgggttccggtaaggggaaaccgtacgggttaacgttacccgacgttacccgttaaccgtaaccgtttaacgttaccggacggtccgggtcgtaggtacgtacggtccgttaaggtaacgttcgttacgtcgtaccgtaacgtttcgtacggtcgttaccgtaccgtacggttactacggtactaccggtacccgttaacccgtaccgtaacccgttccggtaaccgtaacggacctacggtaccgtaaccacgtaacgtacgtgacgtcgtccgtaccg

SEQ ID NO: 230800 - DNA, 675 bp, Homo sapiens
  misc_feature: GYAE6OF01BCK4W.47.36.D03.1.454.CMB.1.raw
  modified_base (214)..(214): a, c, t, g, unknown or other
  misc_feature (214)..(214): n is a, c, g, or t
tcagagctcacgtacacgaccggtgctcgatttagctgcgtcacgatctctcgttgggggcaggagtcagacccagtcaggacacagcatggacatggacgggtccccgctcagcctccgtggggcctcctgcttactctggcctccggaggtgccagatgtgacatccagatcgacccagtcctccatccctccctgtctgcatctggtaganacagtacgtacaccgtatccacgttcggcccgggataacggtcaagagtctaacttaacgagtaccgttaaattttaaagttggtaactaccgaaaccgaaggaaaaccccgaggggaaaaccctcccccttaaaccttccgtagtaactcgtaactggcctagtactacgttaccgtagtttcgactaagttacgggtcggtcccagttccgtaggtcaggtcgactaggtgactcggtaggtactagtacttcgacttcgtaccacgtatacgagtctacgtcgtcaccgtaactgtaacgttagtttccgaactaacgttcctaacgtgtaacccaagttacgtaccgttaacccgtacccgtaacgttccggtttaccggaccggtaaccggtaaccctaaacggtcgaaccgtacgtaacgtaaaccgtacggttagtacggtcctacggtaaccc

SEQ ID NO: 230801 - DNA, 649 bp, Homo sapiens
  misc_feature: GYAE6OF01AYGT8.47.36.D03.1.454.CMB.1.raw
tcagagctcacgtacacgaccggtgctcgatttagctgcgtcacgatctctcttgggggcaggagtcagacccagtcaggacacagcatggacatgagggtcccgctcagctcctggggctcctgttgctctggttcccaggttccagatgcgacatccagatgacccagtctccatcttctgtgtctgcttctgtaggagacagagtcaccatcacttgtcgggcgagtcagggtattagctaacgtggttagcctggtatacaacagaaaccaagggaacgaccccctaacctcctacactcctctactgcactcctactttgaccgtaaaggtcgggtaccatacgaaggttcaggcgcaggtgactcgtagggacagtactttcgacttctactactatcacgcacgcctgacacgtccgtagtaaagttacgtttagtaacttttattacgttcgtaaccgtaacggtaacggttaaaccttccgtttaccccggacttaccccggtaccgttaccggggaccggggtaaacgggtacccggaaaggggttacgggaaacgttaaggtaaagggtaaaaacgggtaccgttacggggttacgggtaccgttacgaaccccgaaccgttagttcccgtttaaccg

SEQ ID NO: 230802 - DNA, 606 bp, Homo sapiens
  misc_feature: GYAE6OF01DH3TE.47.36.D03.1.454.CMB.1.raw
  modified_base (226)..(226): a, c, t, g, unknown or other
  misc_feature (226)..(226): n is a, c, g, or t
  modified_base (290)..(290): a, c, t, g, unknown or other
  misc_feature (290)..(290): n is a, c, g, or t
tcagagctcacgtacacgaccggtgctcgatttagctgcgtcacgatctctcttgggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagcgtggtggagtcgtggggganacgttggtcaaggcctgggacgggtccctgagactctcctgtgcagcctctggacttcaccttnagtgactactacatgagctggactccgcagctcgagggaggctggagtggattgcttacatcagtagtagtgtaatacatatactacgcagtactcgtagtacggaaacgggccgtacttccgacccgtccgtaccgaacggggaacctaaaccggccgaaaggaacgtctaagttcgggacttcgtaggacgaatacggaaacacggcgtaggaactacgggaccggacgggtaaccgtacccggggttaccgtttttgtaaccggttcggccggtaacggacggaccgggtccccttccgtccccgttacccgg

SEQ ID NO: 230803 - DNA, 612 bp, Homo sapiens
  misc_feature: GYAE6OF01D69AD.47.36.D03.1.454.CMB.1.raw
  modified_base (359)..(359): a, c, t, g, unknown or other
  misc_feature (359)..(359): n is a, c, g, or t
  modified_base (505)..(505): a, c, t, g, unknown or other
  misc_feature (505)..(505): n is a, c, g, or t
  modified_base (517)..(517): a, c, t, g, unknown or other
  misc_feature (517)..(517): n is a, c, g, or t
tcagagctcacgtacacgaccggtgctcgatttagctgcgtcacgatctctcttggggagctctgggagaagagccccagccccagaattcccaggagtttccattcggtgatcagcactgaacacagaggactcaccatggagtttgggctgagcgtggtttctgtgctctttaaagtgtcagtgtgaggtgcaggtagtggaggtccgggggagcttagttcagccgtggggacgtccctgagactctcctgtgtagtctctggaatctagtttcagttaccttgtggattgcacgtcggtcccaccaaacgtccgaagggtaagggctgggtggtggtctcacgtatcgaacttcngatggactagttagttaaataagttatggcggtactccggtaggacgggtcctaattcgagtacactctaccgagaacgacgaacgcaaagtgtaatacgtgtatacgtaagaaatgaacctaagttcgtagacgtagtacggtanaagttccgggtnttacggtattaaccttggttaattttgggtttactttacggattccggttaccccggttcgggtacccggtcgggttacgtcgggtacccggggg

SEQ ID NO: 230804 - DNA, 618 bp, Homo sapiens
  misc_feature: GYAE6OF01C6ELD.47.36.D03.1.454.CMB.1.raw
tcagagctcacgtacacgaccggtgctcgatttagctgcgtcacgatctctcttggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctgggtggagtcgtgggggagacttggtcaagcctggagggtccctgagactctcctgtgcagcctctggacttcaccttcagtcgtactactacagttgagcgtggactcccggccaggccgtaccgaggggaagggctgggagtggattgcttacagtctagtagtagtgtattacatactactacgctagtactgtggtacgaggtccgattccaccgtcgaccgacgggacctaacgccgaaagtacgtcgtacgttggaactcgtagaacgtaacgtgaaccacggaccgtaggacggacgtacccgggaacgggtaacccggttaccggtttacccggtttaacttaacccggtgggacccggacgggtaacgtaccgggtcccccttccggtcccgttaacccccgg

SEQ ID NO: 230805 - DNA, 566 bp, Homo sapiens
  misc_feature: GYAE6OF01D3DXH.47.36.D03.1.454.CMB.1.raw
  modified_base (302)..(302): a, c, t, g, unknown or other
  misc_feature (302)..(302): n is a, c, g, or t
  modified_base (486)..(486): a, c, t, g, unknown or other
  misc_feature (486)..(486): n is a, c, g, or t
  modified_base (541)..(541): a, c, t, g, unknown or other
  misc_feature (541)..(541): n is a, c, g, or t
  modified_base (555)..(555): a, c, t, g, unknown or other
  misc_feature (555)..(555): n is a, c, g, or t
tcagagctcacgtacacgaccggtgctcgatttagctgcgtcacgatctctcttggggagctctgggagaagagccccagccccagaattcccaggagtttccattcggtgatcagcactgaacacagaggactcaccatggagtttgggctgagcttgggttttccttgttgctattaataaaaggtgtccagtgtcaggtgcagctgggtggagtcgtgggggagacttggtacaagccgtgggacgggtccctgagacctctcctgtgcagccctcgtggactttccacctttcaggtnactactacatgagctggactccgccaggcctaccgaggggaacgggacgtggagtggtattcgactacatcgagtagtagtgtatacatatactacgcagtctcgtgtaggaacggcctattccaccgtctaccgagggaccaacgccaaaggtatctagttggactcgtagacgaatcgaacngcctaggagaccgccgggaaggaccctacgggttacttttacaccggtgacccgngaacggcgtccctntcccgtacccg

SEQ ID NO: 230806 - DNA, 548 bp, Homo sapiens
  misc_feature: GYAE6OF01DQTPA.47.36.D03.1.454.CMB.1.raw
tcagagctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcatctgtaggagacagagtcaccatcacttgccgggcagtcagggcgttgcaaatgctttggcctggttcagcagacaccgagggaaggcccctaagcgcctgatctatggtgcaatacactttgcaaaggtcggggtacccagtcaaggttcaggcggcagtaggtctgggacagagttcactctacacttatcgagcggcctgcagcctagaagtactttctagactaaactttattaccttgtcctctagttatgtactcgtaccttacccgtcggtaccgtttccggaccgaaaggggtaccctaaaggggttacgaaaacgtaccgtaaaacgtacgttggtggtcgtaacgg

SEQ ID NO: 230807 - DNA, 653 bp, Homo sapiens
  misc_feature: GYAE6OF01EAKHX.47.36.D03.1.454.CMB.1.raw
  modified_base (309)..(309): a, c, t, g, unknown or other
  misc_feature (309)..(309): n is a, c, g, or t
tcagagctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcctccctgtctgcatctgtaggagacagagtcaccatcacttggccgggcgagtcgagggtcgttgacaaagtgtctttggccttggtttcagcagacacgagggacgccctaagcgctgatctagtggtncatactacttgacgtaaaggtcgggtaccagtacgaaggttcgaaggcggacgtaggtaggtcgtagggactaggtacgttaccacgttcctacaacttatccgaacggccggtaccgtggaccgtacggtaccgtaggaacgtacttacgtagtaaccttaactttacgtttaaccgttcgtaccttaccgtaagttacgtacgtacttaccgtacccgtttacccgttaccggttaacccgttttacccgggaaccggtaaacgggaacccggtaaagggtaacggtaaaacgtaaaccgtaaaaccggtaacgttagggtacgggtacgtcggtaaccccg

SEQ ID NO: 230808 - DNA, 757 bp, Homo sapiens
  misc_feature: GYAE6OF01DKRMD.47.36.D03.1.454.CMB.1.raw
tcagagctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcctccctgtctgcatctgtaggagacagagtcaccatcacttgccgggcgagtcgaggcgttgacaaatgtctttggcctggtttcagcagacaccgagggaacgccctaagcgcctgatctatggtgcactactactttgacgtaaaggtcggggtacccctaagtaccgtaaagggtttccgaaggtccgggaccgtagggttacgggtaccgttaggggaacctaagggtacggtttacccaaccttcccgttaacctaaccgttaacgtacccgtaacgggtcccgggtcccgtggtacccgacggtccccgtaagggtaaacgttacgttttaccgtacggtaacccttaaacggttttaactttaaccgttacggttacccttaccgtaaggtttactacggtacttcggttaacccctttaacccggttacccgggttaaccggttttacccgggaacccggtaaaacgggggtaaccccgttaaaagggggttaaccgggtaaaaaccttaaccggtaaaaaccgggttaaaccgtttgggttaaccgggtccgttaccgggtaaaccccg

SEQ ID NO: 230809 - DNA, 628 bp, Homo sapiens
  misc_feature: GYAE6OF01AQD4W.47.36.D03.1.454.CMB.1.raw
  modified_base (226)..(226): a, c, t, g, unknown or other
  misc_feature (226)..(226): n is a, c, g, or t
tcagagctcacgtacacgaccggtgctcgatttagctgcgtcacgatctctcttggggagctctgggagaagagccccagccccagaattcccaggagtttccattcggtgatcagcactgaacacagaggactcaccatggagtttgggctgagcttgggttttccttgttgctattataaaaggtgtccagtgtcaggtgcagctgggtggagtcgtggggganacgttggtcaaggccgtgggacgggtccctgagactctcctgtgcagccttctggtacttcctaccttcagtgactactacatgacgcgtaggactcccgacgaggccgtaccgaggggacgggacgtgggaggtggtagttcgacttacatacgtaggtagtacgtaggtacttaccgtatactactacgcagtactcgtagtacggaacgggtccgtacttccgaccgttctacccggaagggacctaaacgggacccaaaggtaactacgtagttacggactaccgtggaacgtaacgtacgaacgacgtccgtaggacgaccggacggacgggtaccggtactttaacgtacgtcggacggacggtaacggacggtaccctccgtccgtcccgttacg

SEQ ID NO: 230810 - DNA, 526 bp, Homo sapiens
  misc_feature: GYAE6OF01ALH17.47.36.D03.1.454.CMB.1.raw
  modified_base (406)..(406): a, c, t, g, unknown or other
  misc_feature (406)..(406): n is a, c, g, or t
tcagagctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcctccctgtctgcatctgtaggagacagagtcaccatcacttggccgggcgagtcagggcgttgcaaatgctttggccttggtttcagcagacaccaggggaacggcccctaagcgcctgatctatggtgcatacactttgcaaagtcggggtacccatcaaggttcagcggcagtaggtcgtgggactagagttcactctcactatcagcgcctgcagcctagagtnttctgactaacttattactgtctcctagttatgtatcgtccttacccgttcggtaccgttcggaccgtaagggaccgaaggtaggaaacttacgaaaacgtactaggtcggtcgtgaccc

SEQ ID NO: 230811 - DNA, 828 bp, Homo sapiens
  misc_feature: GYAE6OF01CFD1S.47.36.D03.1.454.CMB.1.raw
  modified_base (255)..(255): a, c, t, g, unknown or other
  misc_feature (255)..(255): n is a, c, g, or t
tcagagctcacgtacacgaccggtgctcgatttagctgcgtcacgatctctcgttgggggcaggagtcagacccagtcaggacacagcatggacatggacgggtccccgctcagctccgtggggctcctgttgctctcggtcccaggttccagatgcgacactccagatcgaccctagtcctcctattcttctgtgtctcgtcttcgtaggtaggagacgagtacgtacaacctagtccgtactttgggccgggngagtcggagggtcgttgaactaagtgtcgtttcgggtccgttggtttccagaccgacgaaccgaacccggaacgggggaaccggtaccccgtaacggccggtacctaggtacttacgtagtcgggtacgactaactaccgttacgttcgaaccggtaaagggttccggggtaaccctagtaccggttaagggttcacgggtaccgggacgtacgggttacggtcggtaacggggactaggtaccgttacctaccgttctacctaacttacgtaccgacggtccggtaccgtcggaccacggtccgtaaggtaacgttacgtttcctaacgttaaccttaaacgtttaccgtttacctttaccgggttacccttaacggttaagttacgttacgtaccgtttaccggttacccccgtttacccgggttaccccggtttaaacccggtttacccggggaaaccccggttaaaacgggggtaaacccggttaaaacgggtaaccgggttaaaaacgttaacccgggaaaaccggttaaacggttaccgggttaacggccgttaaccgtaaccccgg

SEQ ID NO: 230812 - DNA, 531 bp, Homo sapiens
  misc_feature: GYAE6OF01EK38J.47.36.D03.1.454.CMB.1.raw
  modified_base (356)..(356): a, c, t, g, unknown or other
  misc_feature (356)..(356): n is a, c, g, or t
tcagagctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaacgcccctaacctcctcatctctactgcatccactttgactaaaggtcgggtccatcaaggttcagcgcagtgatcgngggacagtatttcactctcactatcagcagcctgccagcctagaacgtattctgactaactttattactcgtcctactagttatgtactcgtccttacccgtcggtaccgttccggaccgtaaacgggaccaagggtagaaactacgaaacgtacgtaggtaggctgcctaaccg

SEQ ID NO: 230813 - DNA, 724 bp, Homo sapiens
  misc_feature: GYAE6OF01CAC4Y.47.36.D03.1.454.CMB.1.raw
tcagagctcacgtacacgaccggtgctcgatttagctgcgtcacgatctctcttgggggcaggagtcagacccagtcaggacacagcatggacatgagggtcccgctcagctcctggggctcctgttgctctggttcccaggttccagatgcgacatccagatgacccagtctccatcttctgtgtctgcttctgtagagacagagtcaccatcattgtcgggcagtcaggtattagcaacgtggttagctggtatcaacagaaaccagggaaacacccctaactcctacatctactactgactactcctaactttgactaaaaggtcgggttaccaagtcgaaaggttcaagcggacaggtgacttcgagggaacagtacgttcaacgtctacactactacgacggccggtcctacgaccgaacgtcccgtaaggaaacgtacgttttaccgtagtaacccttaaacgtttaactttaaccgttcggtttacccgttacccgttaaggttaaactttacggtaacgtttacccggttaaccccgttttaacccccggttaaggggtttaacccctttttcccgggggaaacccgtaaaaaccggggggtaaacccggtttaaaaaggggtaacgggttaaaaaaccgttaacccgtaaaaaaccgggtaacgtttacggggtaacgggtaccgtttaacggaccccgtaaacccgttaaacgg

SEQ ID NO: 230814 - DNA, 803 bp, Homo sapiens
  misc_feature: GYAE6OF01C51JC.47.36.D03.1.454.CMB.1.raw
tcagagctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatcgacccagtctccattcttctgtgtctgtcttctgtaggagacagagtccaccatcacgttggtcgggcgagtcgagggttattaccccgataacgtggttacgccttaggtactacaacaagaaaccgaagggaaaccgcccctaacctcctcactcctactacgtcgactactccctactttcgaccgtaaaggtcggggtaccctaagtaccgtaaaacgggtttcgaacggtccgggacgtaacgggtcgggtaacgtcgggttaaggggaacctaaggttacgttttaccaacctttaccttaccctaaccttaacgttacgaacggacccgtaacggtcccgttacggacccgtaacgggtacccgttagggttaaaagttttaacggtttttttaaacgggtaaacctttttaacttttaaccgttcggtttaacccttaccgttaaacggttattacggtacgttaccgtttaaccccgtttaccccggttaacgggttaccccgttttaccggggaacccgtaaaacggggtaaacccggtaaaaggggttaacggtaaaaaccgtaaacccggtaaaaccggtaaaccggttggtacgggtaccctaggaacccgtacctacgttaccg

SEQ ID NO: 230815 - DNA, 595 bp, Homo sapiens
  misc_feature: GYAE6OF01CL8NF.47.36.D03.1.454.CMB.1.raw
tcagagctcacgtacacgaccggtgctcgatttagctgcgtcacgatctctcttgggggcaggagtcagacccagtcaggacacagcatggacatggacgggtccccgctcagctcctggggctcctgttgctctggttcccaggttccagatgcgacatccagatcgacccagtctccattcttctgtgtctgtcttctgtaggagacagagtcaccatctacgttggtcgggcagtcgagggtatagactaacgtggttacgccttggtactacgaaaacacggaaaaccgaaggggaaacctccccctaaacctcctcaacttcctactactgacctactcctactttgaacgtaaacggtcgggtacccaattcgaaacggttcaaggtcggactaggtcggtaactcgtagggactacgttatttcgactctactactatcagtcaacgctgacagcctagtaagttgtttaacgatttatagttacgaacaaggtacggtaacctcgttcccattaccgtacggtcggacggagaccgtagggcgaataggaagtaaacgtctggagtcctagacctactcgtgttacg

SEQ ID NO: 230816 - DNA, 608 bp, Homo sapiens
  misc_feature: GYAE6OF01D7KQW.47.36.D03.1.454.CMB.1.raw
  modified_base (228)..(228): a, c, t, g, unknown or other
  misc_feature (228)..(228): n is a, c, g, or t
tcagagctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacgttgccgggngagtcagggtcgttgacaaagtgtctttggccttggtttcagtcacgacaccgaaggggacgacccctaagccgcctagtactctagtggtgactatactactttgacaaaggtcgggtacccagtcgaaggttcgaggcggactaggtacggtcgtagggactaggtacgttcactactacacttactcgacgcggcctagcgacgtctagtaacgtacttcgtagtacctaattttacttacgttcgtaccttacgtaagttattacggtattcggttacccttaccgttccggtacccgtttcgggaaccgtaacgggtaaccgtaagggtaacgtaaacaaccgtaaacgtacgttggtacggtcgtcggtaaccc

SEQ ID NO: 230817 - DNA, 664 bp, Homo sapiens
  misc_feature: GYAE6OF01C0A4Y.47.36.D03.1.454.CMB.1.raw
  modified_base (300)..(300): a, c, t, g, unknown or other
  misc_feature (300)..(300): n is a, c, g, or t
tcagagctcacgtacacgaccggtgctcgatttagctgcgtcacgatctctcttgggggcaggagtcagacccagtcaggacacagcatggacatgaggggtccccgctcagctcctggggctcctgctactctggctccgaggtgccagatgtgacatccagatgacccagtctccatcctcctgtctgcatctgtagagacagacgtcaccatcactcgccgggcaagtcagagcaattaaccgagtactaattttaaacttaggtactaccaaccgaagaaacccgaagggaaaccnccccctaaacctcctagatactactgactgacacttcctaggtttcgactaagttagggtcggggtacccctagtcgttaagggttctaacggtgggtactaggtagtactcggtgggaaccgttaagttactttttaccttccaaccttagttaccgaaggttaaccgtcctttaggacccgtacgtaacccgtaaggtaaacgttaagttacgttacgaactaaaccgttaattttaacgttactacggtactaaacgtaacgttatacgtaacttaacctcccttaccccgttaccgttccggacccgttacgggtaaacctaacggtagtaatacgtaacaacggtaacgtgtagtaccg

SEQ ID NO: 230818 - DNA, 724 bp, Homo sapiens
  misc_feature: GYAE6OF01EBL44.47.36.D03.1.454.CMB.1.raw
  modified_base (116)..(116): a, c, t, g, unknown or other
  misc_feature (116)..(116): n is a, c, g, or t
  modified_base (233)..(233): a, c, t, g, unknown or other
  misc_feature (233)..(233): n is a, c, g, or t
tcagagctcacgtacacgaccggtgctcgatttagctgcgtcacgatctctcttgggggcaggagtcagacccagtcaggacacagcatggacatgagggtccccgctcagctccnggggctcctgttgctctggtcccaggttccagatgcgacatccagatcgacccagtcctccattcttctgtgtctgtcttcgtgtaggagacagagtccaaccatcacgttggcggngagtcgagggtattagctaaatttattacgccgttggtaactcagacgaacggaaaaccgtaaggggtaaactttccctaaaggtcctacctaggtactttacgtaattacgtttaacacttaccccgttagtttacggaccgttaacggtttcccggggtaccctacgttccgtttacggtttacgaacgggttcgaacggtacgggtaggtacgttccgggtaaggggaaccttacggtttacttacccgtacttacctacccgaacctactaccgacgtacacgggggtcctacggcctaacggtccgtacgtaagtacgttacgttacgtaacctaactttacgtaacttaacgtaactaaaaacttactaaacgtacgtacccgacccgtacgtaccgtaccggttacggtaccgggaacgggtaaccggtaaggtacggaacgtaactaaaccgtaacgtaacgtaggtacgtcgtcggtaaccc

SEQ ID NO: 230819 - DNA, 741 bp, Homo sapiens
  misc_feature: GYAE6OF01BN9DT.47.36.D03.1.454.CMB.1.raw
  modified_base (229)..(229): a, c, t, g, unknown or other
  misc_feature (229)..(229): n is a, c, g, or t
tcagagctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtcctccatcttctgtgtctgcttctgtaggagacagagtcaccatccacttgccgggngagtcgagggcgttgacaaatgctttggccttggtttcagcagacaccgagggaacgcccctaagccgcctgatcgtagtggtgactatactacgtttgacgtaaaggtcggggtacccaagttacgtaaacggtttcgaacggccggtacgtaaggtacgggttacgtacggggaacctaagggtacgtttacctacgttaccgtactaaccttaagtacccgaacggtccggtacccgtcggacccgtaccggtaccgtaggtaaacggtacgtttcggttacgtaaccgttaaacgttttaaccgtttaaccgttaacggttaaaactttaaaaaacgttaacttaaaaccgtaaccggttaccgtacccccggtaccttacccgttaaccggtttaccggggaaccgggtaaaccggggtaacccgtaaaggggttacgggaaacgtaacgtaaaccggtaaaaccggtaaccggttagggtacggttaccgtaaccggtaaaccccg

SEQ ID NO: 230820 - DNA, 866 bp, Homo sapiens
  misc_feature: GYAE6OF01BBPBA.47.36.D03.1.454.CMB.1.raw
tcagagctcacgtacacgaccggtgctcgatttagctgcgtcacgatctctcttggggagctctgggagaagagccccagccccagaattcccaggagtttccattcggtgatcagcactgaacacagaggactcaccatggagtttgggctgagcgttgggttttccttgttgctattataaaggtgtccagtgtcaggtgcagcgtgggtggagttcgtggggggagtacgttgggtcaacggtcccgtgggacggggtccccttggacgtaccttccgttcccgttggtcgccgtacgtcccgttcgtcgggtactttcctacccctttcgaacggttcggtaacccttaaccttaacctaagttacggaacgtccggttagggtaaccttccccggaccgtacggggtcccttaacccgggaacggggggaaacggggtaccgttaggggtaaggttagggtaatttacgggtacctttaacgtagttaccgtaaaggtttaacggttaaggtttacgggttaaactttaacccgtaatttaacgttaaccttaacggtacctacggttaccttcgttaggtaacgggtaaacggggtacccttaacgtttacccgtacccggttaccgttacccgggaaacgggtaaccaaaccggtacccgaaaggtaacgttaccgttaagttacgggtaacttaccgtacggtaaccgtaaagttacgaaaccgtacggtacccgtaagggtaacggaccggaacccggtaacgggaaacccgtaccggggtttaccgtttttaaagtacccggtaggacccggtacggaacggtacccggttaccccttccgttccccgttaacccg

SEQ ID NO: 230821 - DNA, 565 bp, Homo sapiens
  misc_feature: GYAE6OF01BHCYB.47.36.D03.1.454.CMB.1.raw
  modified_base (355)..(355): a, c, t, g, unknown or other
  misc_feature (355)..(355): n is a, c, g, or t
tcagagctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgcgggcgagtcagggtattagcaactggtagcctggtatcaacagaaaccagggaaacgcccctaacctcctcatctctactgcatcctactttgacaaaggtcgggtcccatcaaaggttcagcggcaggtggntcgtagggacagtatttcactctacactatcagcaagcctgccagtcctagaagtattttaggaaactttatttagttgtacctaaacgtacggggttaacctacggttttaccccgcttaccgtacccgttcgggacgggtacgggaccctaagggtcggagtaagtaggaaaagtacgtggtacggcttagacctaccgtgttcgtcg

SEQ ID NO: 230822 - DNA, 644 bp, Homo sapiens
  misc_feature: GYAE6OF01EC3ER.47.36.D03.1.454.CMB.1.raw
  modified_base (278)..(278): a, c, t, g, unknown or other
  misc_feature (278)..(278): n is a, c, g, or t
  modified_base (360)..(360): a, c, t, g, unknown or other
  misc_feature (360)..(360): n is a, c, g, or t
  modified_base (382)..(382): a, c, t, g, unknown or other
  misc_feature (382)..(382): n is a, c, g, or t
tcagagctcacgtacacgaccggtgctcgatttagctgcgtcacgatctctcttggggagctctgggagaagagccccagccccagaattcccaggagtttccattcggtgatcagcactgaacacagaggactcaccatggagtttgggctgagtcgttgggtttttccttgttgcttaattaataaaaggtgtccagttgtcgaggtgcagcgtggtggagtcggtgggggagtacgttggtacaagccgtgggacgggtccctgacgctctctgngcagcctgtgtacttccaccttcgagtcgacttactacagtagacgcgtggactccggacacggctaccggaagggaacggngtggagtggtattgacttacgngtacgtaaggtagtagttagttaacttacgtattaacgtactacgactacgtaccgttgtaggtacggaacggtcccgtattcccggtacccgtccgtaccggaacgggaaccaccggaacgaaagtacgtaccgtagtgtactcgagtacgtaacgtacgaacgtacgcgtaggacggtaccggaccggtaacgggtaccgttacggttttatccggtggccgaccgggtacgaccgttcccctcttcccgcgttaaccgg

SEQ ID NO: 230823 - DNA, 852 bp, Homo sapiens
  misc_feature: GYAE6OF01AF7WA.47.36.D03.1.454.CMB.1.raw
  modified_base (262)..(262): a, c, t, g, unknown or other
  misc_feature (262)..(262): n is a, c, g, or t
tcagagctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccattcttctgtgtctgcttctgtaggagacagagtcaccatcacttggcgggcgtagtcgtagggtattagctaacgttgggttacnccgttggtactaccgaaacaacggaaacccgaaggggaaaccgtaccccctaacctccctcacttctacctactgacctactccctactttcggacgtaaacggtccggggtaccccagttaccgtaaacgggtttccgacgggtccgggacgtaacgggtggtaacgttaccggtacgggggtaacctaacgggttaacctttttacccgaacccgtttccgttaacccgtaaaccgtttaacgttacccgtaaccgggtacccgtaaccgggtccccgttacgggaaccccgtaaccgggttaccccgtttaagggtaaacggttttaacgttttttaacgggtaaaactttttaacgttttaacggttttacggttaaccgtaaaaccgggttaacggggtttaaacccgttacccggtttttaccccgacgtttaccccgttacccgggtttaccggggaaccggggtaaccggggtaaacccgtaaagggggttacgggaaacggtaaggttaaacgggaaaaaccggtaccggttagggtaccgggtaccgttacgaacccgtaaccccgttgttcccgttacg

SEQ ID NO: 230824 - DNA, 795 bp, Homo sapiens
  misc_feature: GYAE6OF01AX3Q7.47.36.D03.1.454.CMB.1.raw
tcagagctcacgtacacgaccggtgctcgatttagctgcgtcacgatctctcttggggagctctgggagaagagccccagccccagaattcccaggagtttccattcggtgatcagcactgaacacagaggactcaccatggagtttgggctgagcgtgggttttccttgttgctattataaaggtgtccagtgtcaggtgcagcgtgggtggagtcgtgggggagtacgttggtcaagccgtgggacgggtccctggagactctcctggtgcgacgtcctcgtggtacttccgaccttcgagtacgtacctactacgagtcgagtcgtcggactcccgaccgaggccgtacggaaggggaacgggacgtgggtaaggtggtattcggtacttaacgatacgtaaggttaagtaggttacggttacttaaccgtaattaacgttaaccgtaccgggtctaaacggtacccttcggttaacgggtaacggggaaaccccggggtccgtaaaccgttttccccgaaacccggttcccgtaacccgggtaaaaccggggaaccctaaacccgggaccctaaaagggtaccgttacgtaacggttttagggaacctttccggaaggtaccggtaaaacgttacggaaacccgtacggtcccggttaaagggaacccgtacggggtaccccggtaaaggggttccccgggtttaccgttttaaacgtcccggtacgggaccgggtaacggtaaccgggcccggttaccccttcccggttacccgttcccgttaaacgggg

SEQ ID NO: 230825 - DNA, 736 bp, Homo sapiens
  misc_feature: GYAE6OF01AFJLY.47.36.D03.1.454.CMB.1.raw
  modified_base (466)..(466): a, c, t, g, unknown or other
  misc_feature (466)..(466): n is a, c, g, or t
tcagagctcacgtacacgaccggtgctcgatttagctgcgtcacgatctctcgttggggagctcgtgggagaagacgccccagccccagaattcccaggtagtttccattcggtgatcagcactgaacacagaggactcaccagtggagtttgggctgagtcgttgggttttccttgttgacttaattaagtaaaaggtcgtaccgtaggtgtcgaggtgcgaggtcgtgggtaggagtcggtggggactacgttggtacacggccgtagggtacggtcctgacgtactcgtcctgtcgcacgtcctgtagtactacctacttactaattattatcgtacctagcgtacggtacggtccgggtacccgacgtcgggtacctaccggacgggtacggtacggggtacgtagggtaggggtcgggtcgggtacgtactacggttacgtcgtacggtaggtacgtactnttacgtacgtacgttacgtacgcccgtaacgcccgttaccgggacgggtaccggtaccctacgtacccaccgtacgttacccaacgtaacgtaaccctaacctaccgtacccggaaacgttacccggttacgtacctaacgtacccgtacgtaacccctaaccgttacggaacccgtacgttaacccgaaggaaccgtacgtaccgaacccgtctaacccgttctaccttacgtacgtacggtaggtacgacggtagtagtgttaaccgg

SEQ ID NO: 230826 - DNA, 818 bp, Homo sapiens
  misc_feature: GYAE6OF01DEHIO.47.36.D03.1.454.CMB.1.raw
tcagagctcacgtacacgaccggtgctcgatttagctgcgtcacgatctctcttggggagctctgggagaagagccccagccccagaattcccaggagtttccattcggtgatcagcactgaacacagaggactcaccagtggagtttgggctgagcgttgggttttccttgttgacttattaagtaaaaggtgtaccagtgtcaggtgcgagcgtgggtggagtcggtgggggatacgttggtcgaggccgtgggacgggtccctaggaacgtaccttccgtccgttggtcgccacggtccttcgtacggtactttccaaccgtttcgacggtataacccttaactacagtgacgtctacggactccccgacgtacggcccttaccgggaagggggtaacgggacgtgggaggttacgggtattcgggtacttaaccgagttacgtaaagggtttaggttaaggttacggtttaacctttaaccaagttaaacgttaccgttaaccggcgtaacggttaccttaccggtagggttaccgggaaacggggtcccttaacgttcccgtaacccggttacccgtaaccgggaaacggggaaccctaaacccgggaaccctaaaagggtaaccttaccgtaagtttcgggaaacttcccggttagggaaccgttaaaagcgaaacccgtaggccccgtaagggaccgtaacccggaccgggtaaaccgggtacccggtaaccgggtttacccttttaaagttccgacggggacccgtaccggaaaggtaccccggtccccttaccccgtcgttacccccgg

SEQ ID NO: 230827 - DNA, 820 bp, Homo sapiens
  misc_feature: GYAE6OF01CBQ2A.47.36.D03.1.454.CMB.1.raw
  modified_base (107)..(107): a, c, t, g, unknown or other
  misc_feature (107)..(107): n is a, c, g, or t
  modified_base (133)..(133): a, c, t, g, unknown or other
  misc_feature (133)..(133): n is a, c, g, or t
  modified_base (807)..(807): a, c, t, g, unknown or other
  misc_feature (807)..(807): n is a, c, g, or t
tcagagctcacgtacacgaccggtgctcgatttagctgcgtcacgatctctcttgggggcaggagtcatacccagtcaggacacagcatggacatgagggtccccgntcagccctcggcgggccttcgtgtcncctgttccgtaccgtacggtacagtgtcgacgactacctacgagtacgtacccgacccgtacttccctacctactttccttcgtgttcgtcgtcgttcttacggtagggtagacgacgaggtacaccactactaccgttacggttcggggtccgggacgtagtaccgggtagggtttaactacgaacttacgggttacggtaccgtaccggttagtacaacaaacggaaaccggaaaccggtaacggaacccctaccccttaacctcctactaccttcctaccttagaccacttacctaccgtttaacgttcgaaaccggttaaccggggttccgtaacctagtaaccggtacgtggaccggcggtacgtagggtcgtacgtccgggtaacgtactaagtttctaccctccttacccgaaccctaaccgtacacccctaaccccgtcgtacgtacgaccgttacccgtattacggtttacgtttacgtttaccgaacgttttacttaacgtacccgtaagtaaaaccttaagtaacgttacggttaccgtacccgtttacccgttccgggtttaccggtacccggtaccgggtaaaccggaaacgttagggtaacttaacgtaaccgtaaacccggtaaacggttcggttacggacttaccgggctaacccgtnttccgtcgttccc

SEQ ID NO: 230828 - DNA, 579 bp, Homo sapiens
  misc_feature: GYAE6OF01DVT0E.47.36.D03.1.454.CMB.1.raw
  modified_base (488)..(488): a, c, t, g, unknown or other
  misc_feature (488)..(488): n is a, c, g, or t
  modified_base (573)..(573): a, c, t, g, unknown or other
  misc_feature (573)..(573): n is a, c, g, or t
tcagagctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttggtcgggcgagtcgagggtattagcaacgttggtagcctggtatcaacaagaaaccgaggaaacgcccctaacctcctacatctctactgcatcctactttgacgtaaaggtcgggtacccagtacgtaacggttcaggcggacaggtggtactcgtaggggactaggtactttacacttctacactatcgagcagcctgccagtcctagaagttattttaggaacttttattattcgtaactaagtaacgggtactacggtttcccncttaccgaccgttacggacgggacgggtacctaaggggtgaacgtagaaccaaaacggtacgtggacggtctacgacctaacgtntcgtcg

SEQ ID NO: 230829 - DNA, 866 bp, Homo sapiens
  misc_feature: GYAE6OF01C4G4R.47.36.D03.1.454.CMB.1.raw
  modified_base (324)..(324): a, c, t, g, unknown or other
  misc_feature (324)..(324): n is a, c, g, or t
tcagagctcacgtacacgaccggtgctcgatttagctgcgtcacgatctctcttggggagctcgtgggagaagacgccccagccccagaacttcccgaggtagtttccattcggtgatcagcactgaacacagagactcacagtggtagtttggctgagtcgttggttttccttgttgtacttaattaaagtaaaaggtcgtccgagtgtcgaggtgcgagcgtgggtagaggtcggtaggggtatacgttggtacaacgtccgtgggacggtcctggacgactctccgtgtcgcctacgcctgtaggtacttccgtaccgttnaggtacgtaaccttaacgacgtagtcggagtccggtacggacgtccccggaccgtacgggtaccgtacccgggaaagggggaacgggtcgtaggggaacggttaggtaacgtttacgtaaccgtttaaacgtaagttacgtaaagggtttaaaggttacgggttttaacgttaaaaccctttaaaccggtaaatttaaacccggttaacccgttaaaccgggtaccgtaaacggttacgttaccgggttaagggtaacggggtaaaccgggttacccggtttaacctttaccccgggaaccccggtttacccgtaaaccgggaaaaccgggtaacccaaaacccggaaacccggtaaaagtaacgttaccggttaagttaccggtaaacttcggtaacgaacggtaaactacggaaaccgtcggtacccgtaaggaacggtaccggacccgggtaaaggggtttcccgttaaggttttactacgggtccggaaccggtaggtacccggcgttaccccgtaccctccgtacccgtttaacggg

SEQ ID NO: 230830 - DNA, 840 bp, Homo sapiens
  misc_feature: GYAE6OF01CLFLW.47.36.D03.1.454.CMB.1.raw
tcagagctcacgtacacgaccggtgctcgatttagctgcgtcacgatctctcgttgggggcaggagtcagtcccactcaggacacagcatggacatggacggggtcccgctcagctccgtggggctctgctgctcgtcggttcccaggtcgccgtaggtgtgacactccagactcgaccctagtcctccactccctccctgtactcgctactcgtggtaaggacgacgaggactacacctactccgtacgtcggaccgggtcgtacggtcggacgggtcgttagactaagtcgtacgttcggcgttggttacacgcaagaccgaacggaacgggtaccgtacccgtaacggccgtaccgtaggtactacgtacgttcggacgactagttacctagttacggaacgtaacgggtcggtaccagtacggtaaggtccgaggtccggtaagtacgggtacggtacggtacggaacgtacgtacgtctaccgtactaccggtaactacgtacggaccgggaccgtacgtaccggaacgttaccggtaccgtaaggtaaccgttacgtttacgtaacccgttaacttttaaaccgtttaacggttttacccgtaaccgttacccgttaacggttaacgtttaccggtacggttaaccgtttacccgggttaccccgttttaaaccccgggttacccgggttaacccgggtttaccccggggaaacccgggggttaaaacccggggtaaccgggttaaaaccggggttaaacgttaaaacccgggttaaacccggtaaaacggttaaccggggttacgggtaacccggttaccggtaaaccccggg

SEQ ID NO: 230831 - DNA, 823 bp, Homo sapiens
  misc_feature: GYAE6OF01EVG6S.47.36.D03.1.454.CMB.1.raw
tcagagctcacgtacacgaccggtgctcgatttagctgcgtcacgatctctcttgggggcaggagtcagacccagtcaggacacagcatggacatgagggtcccgctcagctcctggggctcctgtgctctggttcccaggttccagatgcgacatccagatgacccagtcctccattcttctgtcgtctgtcttctgtaggagacaggacgtcaaccatcctacgttggcgggcgtagtcgagggttattaggactaacgtggttaacgtccgtaggtactacaaacgaacggaaaaccgaacggggtaaaccgtaccccctaacctcctaccgtacttcctactacttcgacctactaccgtactttacggacgtaaacgggttccgggtaccctaacgtacggttaaccggtcggacggacggtacgttagggtacgtacgtacgggtacgtaacgttattaccgttactaccgttactacttacgtacgtacgtaccgcgtaccgtcgtaccgtacgtacggttcgtaaacggttacgttttacgtttaacgtttaacttttaacggtttagttaaccgttaaccgggtaaagggttaaacccggttacccggtttaccccggtttaccccgttacgttaccccggggttaacccgggggtttacgggaaaccccggggggttaaacgggtaaaccggggttaagggggtacgggttaaaacggtaaaggggttaaaaccgggtaaacgttaaccgggggtttggaaacccggggttacgacccgttaaagttacccggttactttcccgggtttaccg

SEQ ID NO: 230832 - DNA, 711 bp, Homo sapiens
  misc_feature: GYAE6OF01BWX92.47.36.D03.1.454.CMB.1.raw
  modified_base (108)..(108): a, c, t, g, unknown or other
  misc_feature (108)..(108): n is a, c, g, or t
tcagagctcacgtacacgaccggtgctcgatttagctgcgtcacgatctctcttgggggcaggagtcagacccagtcaggacacagcatggacatgacgggtccccgntcagctcctggggctcctgttgctctggttcccaggttccagatgcgacatccagatcgacccagtcctccattcttctgtgtctgtcttcgtggtaggacgacaggtacgtccaaccatccgtacgttcgggaccgggacgagtccgagggtcgttagactaaagtcgtctttcggccttggtttcagtcacgaccgtaccggaaggggaacggtcccccttaaggccgtacccgtaggtaacttcgtaagttgggtcgactacggttactacgtttacgacgtaaaggttcgggtacccaagttacgaacggtttcgaggtccggtacgtaggtaacgggttcgtacgggacgtacggtacggttacacgtactaccacgtatccgacggtcggacctcggactacggtcccgagtaacgtacttcgtagtaaccgttaacttacttaaccgtacgttccgtaccgttaagttactgtacttacgttcccgttaaccgtccggttaccgtttaccgggaacccggtaagggtaaccctaaggggtaaacgtaaacgtaaacggaaaccgttacggtaggttaccggtacttcggaaacccg

SEQ ID NO: 230833 - DNA, 538 bp, Homo sapiens
  misc_feature: GYAE6OF01EMPZU.47.36.D03.1.454.CMB.1.raw
  modified_base (269)..(269): a, c, t, g, unknown or other
  misc_feature (269)..(269): n is a, c, g, or t
  modified_base (349)..(349): a, c, t, g, unknown or other
  misc_feature (349)..(349): n is a, c, g, or t
  modified_base (361)..(361): a, c, t, g, unknown or other
  misc_feature (361)..(361): n is a, c, g, or t
  modified_base (373)..(373): a, c, t, g, unknown or other
  misc_feature (373)..(373): n is a, c, g, or t
  modified_base (382)..(382): a, c, t, g, unknown or other
  misc_feature (382)..(382): n is a, c, g, or t
  modified_base (395)..(396): a, c, t, g, unknown or other
  misc_feature (395)..(396): n is a, c, g, or t
  modified_base (405)..(405): a, c, t, g, unknown or other
  misc_feature (405)..(405): n is a, c, g, or t
  modified_base (423)..(423): a, c, t, g, unknown or other
  misc_feature (423)..(423): n is a, c, g, or t
tcagagctcacgtacacgaccggtgctcgatttagctgcgtcacgatctctcttgggggcaggagtcagacccagtcaggacacagcatggacatggagggtccccgctcagctcctggggctcctgttgctctggttcccaggttccagatgcgacatccagatgacccagtctccatcttctgtgtctgcttctgtaggagacagatacaccatctacttggtcgggcgagtcgaggtattagcactggttagcctggtatcaaacncgaaaccaagggaaacgacccctaaccctccctcatctctaactgtccatccactttagcaagtgggtcccaatcaagtngcggcagtgatntggatagattcnctctcactntcagcagcctgcnncctagtaanattttagaactttagttnttagtacaatacggtaactacgtttccgtccttccaccgtcgggtccggagggtaccgaaagggtggagaagtaacgaaaggtacgtagtcggcgtacgacacctgtcgttaccg

SEQ ID NO: 230834 - DNA, 558 bp, Homo sapiens
  misc_feature: GYAE6OF01BTZV4.47.36.D03.1.454.CMB.1.raw
  modified_base (398)..(398): a, c, t, g, unknown or other
  misc_feature (398)..(398): n is a, c, g, or t
  modified_base (462)..(462): a, c, t, g, unknown or other
  misc_feature (462)..(462): n is a, c, g, or t
tcagagctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttggtcgggcgagtcagggtattagcaacgtggttagcctggtatacaacagaaaccagggaaacgcccctaacctcctcatctctactgcactccactttgactaaaggtcgggtacccatacgaaggttcaggcgcgtaggtggatcgtagggactagtactttcaactctacactancagcagcctgcacgctagatatttagaactttatattgtacaacgtaggtaactacgtttcccnctaccgtaccgttcgggacggaacgggtaccgaagggtacggagtaagtaaggaaaagtacgtggtacggactacggaccaaccgttatcgttacg

SEQ ID NO: 230835 - DNA, 673 bp, Homo sapiens
  misc_feature: GYAE6OF01ECYQO.47.36.D03.1.454.CMB.1.raw
  modified_base (452)..(452): a, c, t, g, unknown or other
  misc_feature (452)..(452): n is a, c, g, or t
tcagagctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtcctccatcttctgtgtctgcttctgtaggagacagagtcaccatccacgttggcgggcgagtcgagggttattagctaacgttggtacgccgttggtaactcaaacgaacgaaaaccgaaggggtaaaccgccccctaaacctccctacacttcctctactcgcctaacttaccctaactttcggacgtaaaacgggttccgggtaccctaagtaccgtaaagggttccaaggtcggacgtaaggtaggtcgtagggacaggtacgttcactctcactancgacggccgctgactacgacctagtaacgtcttcgagtaccttaactttattacgtcgtactaccgtagttacgtagtagttcctaccgttacccggtcggttaaccgtttaccgggaccggtaaacggggtaaccgtaaacggggttaacggaaaactaaccggtaaaaaccggtcgttaacgggtcggtaaccgttacgaccctaccgtgtttaacccg

SEQ ID NO: 230836 - DNA, 767 bp, Homo sapiens
  misc_feature: GYAE6OF01BGW3R.47.36.D03.1.454.CMB.1.raw
  modified_base (205)..(205): a, c, t, g, unknown or other
  misc_feature (205)..(205): n is a, c, g, or t
  modified_base (278)..(278): a, c, t, g, unknown or other
  misc_feature (278)..(278): n is a, c, g, or t
  modified_base (361)..(361): a, c, t, g, unknown or other
  misc_feature (361)..(361): n is a, c, g, or t
  modified_base (709)..(709): a, c, t, g, unknown or other
  misc_feature (709)..(709): n is a, c, g, or t
  modified_base (746)..(746): a, c, t, g, unknown or other
  misc_feature (746)..(746): n is a, c, g, or t
tcagagctcacgtacacgaccggtgctcgatttagctgcgtcacgatctctcgttgggggcaggagtcagacccagtcaggacacagcatggacatgagggtccccgctcagctcctggggctctgtgctctggttcccaggttccagatgcgacactccagatcgacccagtctccattcttctgtgtctgtcttctgtagganacgagacgtccaccatccgtacgttggtccgggacgagtcggtaagggttattacgactaacgttgggttacnccgttaggtactacaaacgaagaaaaccccggtaagggaaaccctacccccttaaacctccgtacctacttaccgtacttacncgtactactacccttaactttcgaacgtaaacgggtccggtacccaataccgtaagggttccgaacggtaccggaacgtagggttacggaacgttacgggtacgggtaactacggtttacctttacctacccgtttaccttaacctaacccgtttacgacgtaaccgtaccggaaccgtccggttacgaacccgttacggtcgttaacgggttaaattttacgttttaacggtaaaccttttagtttaacgttacgtaagtaaaccggttaaacggggttaccttacccggtttacccgacccttacggtacccgggttcgggaacgggtacggtaccgaaaggggtnaacgggaagttaaaggaaccggtagtggtaccggtanaccgtataccgtgttacgtcg

SEQ ID NO: 230837 - DNA, 764 bp, Homo sapiens
  misc_feature: GYAE6OF01EMY1H.47.36.D03.1.454.CMB.1.raw
  modified_base (367)..(367): a, c, t, g, unknown or other
  misc_feature (367)..(367): n is a, c, g, or t
tcagagctcacgtacacgaccggtgctcgatttagctgcgtcacgatctctcgttgggggcaggagtcagacccagtcaggacacagcatggacagtggacgggtcccgctcgagcctccgtggggctccgtgttgctcgtcggttcccaggttccagtagtcgcgacatccagtactcgaccctagtcctcctattccttctgtcgtactcgtcttcgtaggtaaggagtacgacgtacgtccaaccgtacttcgtacgttgggcgggtacgagtacgtagggttacttacgacgtaacggttcgggttacaccgttaggttaactaaccgaaacgtaacggaaaacccgtaacggggtaaacccnccccctaaaccgtcctactacttcctccgtaactcgtaccaacttcctaaacggtttcgaaacgtaacgggtccggtaacctaactacggtaacggtcgacggtacgagtaggtacgtagttaacgcggtaaactagtttactccgtaacgtctacgtactacgtagtaccgtacgtaccgacgtacgaccgtaggttaccgtaacgtttaacgttaccttttaccgaacgtttaacccttaacggtaacctagggtaaccaaccggttaaccggttaaccgtttaaccccggtaaccttacggtaccgttaccgggaaccggtaacgaaaccgttacgaaacgtacgtaacaacggaaccgtaggttcgacgtcgtaactacgtactgttcgtacg

SEQ ID NO: 230838 - DNA, 888 bp, Homo sapiens
  misc_feature: GYAE6OF01A2K2S.47.36.D03.1.454.CMB.1.raw
tcagagctcacgtacacgaccggtgctcgatttagctgcgtcacgatctctcttgggggcaggagtcagacccagtcaggacacagcatggacatgaggtcccgctcagctcctgggctcctgttgctctggttcccaggttccagatgcgacatccagatcgaccagtctccatcttctgtgtctgcttctgtaggagacagacgtccaaccatccgtacgttggtcgggacgtaggtcgagggtccgttaggactaaagttcgtacgttttcggtccgtttaggtttaccaggtacctaacggaacccgtaaccccggaaacggggggaaaccggggtaaccccctttaaacgggcccggtacccgttaggtaacctttaccggttaaggttcggggtactaccgtaaacttaacccgttacgttttaccggaacgtaaaacgggttccgggggtaacccctaagttaaccggtaacggtttaccggaaacgggtccggtaaccgtaagggttacgggtttaccggtacgggtaaccgtaacggttacggtttaccctacgttaccgttaccgtaaccttaacgttaccgacggtccggtacccgtacggtaccgtaccggtaccgttaaacggtaacgtacgtttaaccgtaccgtaaacctttaactttaaccgtttaccgtacgtttaccccgttaacgttaacggttaacgttagtaccgtttaacccggttacccgttttaacccggttaccggtttaacccgggtttacccggtaaaccccgggttaaacgggtaaaccccgggtaaagggttaacccggtaaaacgtaaccccgtaaaacggtaccgttacgggtacggttaccgtccgtaaaccccgg

SEQ ID NO: 230839 - DNA, 891 bp, Homo sapiens
  misc_feature: GYAE6OF01CX63M.47.36.D03.1.454.CMB.1.raw
tcagagctcacgtacacgaccggtgctcgatttagctgcgtcacgatctctcttggggagctctgggagaagagccccagccccagaattcccaggagtttccattcggtgatcagcactgaacacagaggactcaccatggagtttgggctgagcttgggttttccttgttgcttattaataaaaggtgtccagttgtcgaggtgcagctgggtggagtcggtgggggagtaacgttggtacaagccgttgggacgggttccctgagtacctcttccgtgtcgcagtcccgtcgtaggtactttccgacctttcagttcggtaacctaaccttaacctagttggaactccggtagggtaaccgtccccggccgaacgggtacccgttaccgggaaaggggggtaaacggggtaaccgttgggggaacggtttacgggtacgtttacggttaaccggtttaactacgtacggttaaagggttaggtttaacgttaggggttttaaacttaaacccggtaatttaacgtaaccggtaccgtaaccgtaaggtaccctttacggttaggtaacgggtaaacggggttcccggtaagttttaccccgaccccggtttaccgttacccgggaaaccggggtaacccaaaaccggtacccgtaaacggtaaacgttaccgttaacggtttacgggaaccgtttaccgtacgggtaaccggaaaacgttacgggtaaacccgacgggtaccgttaacgggaaacgtacccggggtaacccgggaaaccgggtaacccggtaaccccggggttaacgtttttttaaacgtacccggttaggacccgggtacgtaacgggtacccggttacccttcccggttaccccgtttaaccccgg

SEQ ID NO: 230840 - DNA, 796 bp, Homo sapiens
  misc_feature: GYAE6OF01EBTFA.47.36.D03.1.454.CMB.1.raw
tcagagctcacgtacacgaccggtgctcgatttagctgcgtcacgatctctcttggggagctctgggagaagagccccagccccagaattcccaggagtttccattcggtgatcagcactgaacacagaggactcaccatggtagtttgggctgagtcttgggttttccttgttgcttattataaaggtgtcagtgtcaggtgcagcgtggtggagtcgtgggggagtacgttggtacaacgtccgtgggacgggtcctggacgacttcgtccttgtgcgacgtcctcgtggtacttcgtacccttctagtacgactactaacagttgacgcgtacggacctcccggaccgacggcgtaccggaaggggaacgggtactagggagttacggtattcgtacttacgatacgtaaggtagtacggtagttacttactaattactaacgtacgactaggtacctacgtgggtaacggaaccgggtcctaacgttccccgaccggttaccgtacccgaacgggaacctaacccggaacctaaacggtaaacgttccaaagggttttacggaacttacggtacggtaacccgtaaagttaccgggaaaactccgggtaccgtaacgggtaaaccgggacccggaacccggggtaaccggtaaaccccggggttaacccggggtttttacccgtttttaaacggttaaacccgggtttccggggaacccggggttacccggggtaaacgggtttacccccgggtttccctttccccgggttccccccgtttaaaccccccgg

SEQ ID NO: 230841 - DNA, 712 bp, Homo sapiens
  misc_feature: GYAE6OF01AON4X.47.36.D03.1.454.CMB.1.raw
  modified_base (705)..(705): a, c, t, g, unknown or other
  misc_feature (705)..(705): n is a, c, g, or t
tcagagctcacgtacacgaccggtgctcgatttagctgcgtcacgatctctcttgggggcaggagtcagacccagtcaggacacagcatggacatgagggtccccgctcagctccgtggggctcctgttgctctggttcccaggttccagatgcgacatccagatcgacccagtctccattcttctgtcgtctgtcttcgtggtaggacgacaggacgtccacctatcctacgttggtccggggacgtagtaccgtagggtattacggactaacgtggttacgccgtggtactacaacgacgaaaccggaacgggtaaacccgtacccccttaacctccctctaacttccgttacctaactcgacctactcctaccgtttagaccgtaaacgggttccggtacccagttaccgtaaggttccgacggtccggacgtagggtcggtataccggtggggaactagtttccttacctacgttcctactactacgtcgtacgcgtacgccttcggactacgtcgtaggtaaagttgttttaacggactttagttacgttagtaccgtaagtaacgggtaccttaccggttcccacttaccgtccggtccgggaacgggtccgggtaaacctaaggggtagggaattaagggaaaccgtaaaggttaccggtgggttacggacctaccggtacctacccttaccgggttnttcccgg

SEQ ID NO: 230842 - DNA, 686 bp, Homo sapiens
  misc_feature: GYAE6OF01DIV4D.47.36.D03.1.454.CMB.1.raw
  modified_base (674)..(674): a, c, t, g, unknown or other
  misc_feature (674)..(674): n is a, c, g, or t
  modified_base (680)..(680): a, c, t, g, unknown or other
  misc_feature (680)..(680): n is a, c, g, or t
tcagagctcacgtacacgaccggtgctcgatttagctgcgtcacgatctctcgttgggggcaggagtcagacccagtcaggacacagcatggacatggacgggtcccgctcagctccgtggggcctcgtgttgctcgtcggttccaggttccagatcgcgacatccagactcgaccctagtcctcctatcttctgtgtctgtcttcgtgtacgagactagacgtcacactcgtacgttggtcggactagtacgagggttattacgactaacgttggttacgtccgtaggtactacgaaacgaacgaaaccggaagggaaccctacccccgttaacctcctaccgtaactccgttacctacgtacgccttaacttaccccgtttacgttttaaccgaaacgggttccggttaacctaacgttaccgtaacggttacgaacggtcgacgtaagggtcgtacgtacggtagggaactagttacttaccgtaccttcgtactaacgtactacgacgcgtacgtccgtacgacgtagaccgtaagtaagtttagtttacgtaactttagttactagtaacgtaacgtacggtaacgtccgttacccgtactccgtaccggttgggaaccggtaggaccagggtagaagtaagaacgaagtacgtcgagcacaccgactntccgtntacccg

SEQ ID NO: 230843 - DNA, 698 bp, Homo sapiens
  misc_feature: GYAE6OF01A9OW4.47.36.D03.1.454.CMB.1.raw
  modified_base (302)..(302): a, c, t, g, unknown or other
  misc_feature (302)..(302): n is a, c, g, or t
  modified_base (372)..(372): a, c, t, g, unknown or other
  misc_feature (372)..(372): n is a, c, g, or t
  modified_base (503)..(503): a, c, t, g, unknown or other
  misc_feature (503)..(503): n is a, c, g, or t
tcagagctcacgtacacgaccggtgctcgatttagctgcgtcacgatctctcttgggggcaggagtcagacccagtcaggacacagcatggacatgacgggtcccgctcagctccgtggggctcctgttcgctctcggttcccaggttccagatgcgacatccagatcgacctagtcctccattcgttctgtcgtctcgtactttctggtaaggacacgagtacgtccaacctataccgttacgtttcggcgggtacgtacgtaccggtaagggttacttacgacctaagtttggttaaccnccgttaggtactacgaaacgaacgaaaccgtacgggaaccctacccctaactcctatacctcgtactacngacctacggtccttacgttacgaacgttaagggtccggtaccagttacgtaaacgtcgacgcgagtacgtagacgtaggtacgggattagttacctttacccagtacctaccacctaactcggacgttacncgtactcgaccaacgttagttacgtactttacaccggtttaacttactatacgtacaacgtttaacgtaccgtttaacccgtccgttaacgttaccgttacgaaccggtacgggttaaaccaggacttaacgaacctaacgtaaacgtcggtacgtcggtactacggtaaccaccgtttaactgtaactttcccg

SEQ ID NO: 230844 - DNA, 764 bp, Homo sapiens
  misc_feature: GYAE6OF01DG63A.47.36.D03.1.454.CMB.1.raw
tcagagctcacgtacacgaccggtgctcgatttagctgcgtcacgatctctcttgggggcaggagtcagacccagtcaggacacagcatggacatgagggtccccgctcagctcctggggctctgttgctctggttcccaggttccagatgcgacactccagactcgaccctagtcctccattcttctgtgtctgtcttctagtaggacacaggtacgtaccactactccgtacgttcgggtccgggcgtaacggtcgtaagggttattacggaccttaacgttgggttacgccgtttaggtaactaccgaaaacgaaacggtaaaacccggtaacggggtaaacccgtaccccccttaaaccttcctacctaccgttctaccttacgtcgacctacgttcctaacgttgaaccggtaacggttcgggtaccctagtaccgaaggttcgacggcgtgtacgggtacgtacgtcggtagggactacggtttactttaccgaccttacgtacctacttacgtacgtacgtacgaccgtaccgtacgacgtaccgtacgttaaggttaacgtttaacgttttagttaacgttttagtttacttacggtaagtaacggttaaccggttaaccgtttaccgttacccgtaccgtttacccgtaccggttacgggtaccgggtacgggaaccggtaagggtacggtaaaggtaaggaagtaaaacggtcgttaggtccggtacgtacgaccgtacttacgttcgttaccg

SEQ ID NO: 230845 - DNA, 840 bp, Homo sapiens
  misc_feature: GYAE6OF01E0QK0.47.36.D03.1.454.CMB.1.raw
  modified_base (652)..(652): a, c, t, g, unknown or other
  misc_feature (652)..(652): n is a, c, g, or t
tcagagctcacgtacacgaccggtgctcgatttagctgcgtcacgatctctcgttgggggcaggagtcagacccagtcaggacacagcatggacatggacgggtccccgctcagcctccgtgggggcctccttgttcgcctcgttcggttcccaggttccagatggcgactatccgagactcgaaccctagttcctaccctatttcctttcgtaggttcgtcgttcggtccttttacggtaggtaacgggaagaaccgtaaggtaaccgttaccaaacccgtattacccgtaacgtttcggggtcccgggacgtacggttacggtaaaggggttacttaaggaccttaaacggttcgggttacgtaccgttaggtaactaacgaaaacgaaacggaaaccggaacggggaaacccttacccccctaaccgttccctacgtaactttccgtaccttaacgtcgactaaccttcgttaactttacgaacggtaacgggttccggtaccctaagttaccgtaaaggttcgacgggtaccggacgttaaggttcggaacgttacccgggtaacgggtaaacttacgtttaaactttcccgaacctttctacccgttaatacacggacgtaacgaccgtcgtaacggcctaccggtnttaaacggtaacggttttcgtttaaacggtatttttacgttacttacggaacgtaaacggtaccggttacctaccggttccgtacctacgtaccggtcgggaacggtacgggtacgtagggttaacgagttaaagaacggtaaacggtcgttaacgcgttacgaccgtaccaccgttcgttgtacccg

SEQ ID NO: 230846 - DNA, 721 bp, Homo sapiens
  misc_feature: GYAE6OF01CI6DW.47.36.D03.1.454.CMB.1.raw
tcagagctcacgtacacgaccggtgctcgatttagctgcgtcacgagtctctcttggggagctctgggagaagagccccagccccagaattcccaggagtttccattcggtgatcagcactgaacacaggaggactcaccagtggtagtttgggctgagcgttgggttttcctgttgctattagtaaagtgtcagtgtcgaggtgcagcgtgggtggagtcggtgggggatacgttggtaccaaggcccgtggggacggtccctaggacgtacctcgtccgtgtacgacacgtccttcgtaggtactttccgaacctttgacggttcgaaccttaccgtacgtagtcgaagcgttacggaactcccggacgacggtccctacggaaggggaacggtcgtgggtacgtggtagtttcgtacttaacgagttcggtaagttaggtagtacggtaacttacgaatttacaccgtacgacgtacgtacgtcgtaggtaacggacgggtactacttaccgtaccggttcctaaccggacggtaacccaaccgtacgtaaacggtacgtcgtaagttcggaacttccgaaggtacgtaaagttacgaacgtacggtaaccgtgggaaccggaccgggaccggaacgggtaacccgttacgggtaactttttacggacctagggtacccgtagggaccggtaccggcccttccgtccccgttaaccgg

SEQ ID NO: 230847 - DNA, 709 bp, Homo sapiens
  misc_feature: GYAE6OF01B7SJA.47.36.D03.1.454.CMB.1.raw
  modified_base (471)..(471): a, c, t, g, unknown or other
  misc_feature (471)..(471): n is a, c, g, or t
tcagagctcacgtacacgaccggtgctcgatttagctgcgtcacgatctctcttggggagctcgtgggagaagagccccagccccagaattcccaggagtttccattcggtgatcagcactgaacacagaggactcaccagtggtagtttgggcgtgagtcgttgggttttccttgttgcttaattaataaaaggtgtccagtggtcgaggtgcagcgttgggtggaggttcggtaggggggagtaccgtttggtacgaaacggtcccgtaggggtaccgggttccccgtaggaacgtaccgttcgttcccgtggtcgtaccgacggtccccttgtcgggttactttaccctacccgtttcgaacgttcgtacccttaacgtaccaagttggacgtcgtagggccgtcccggccgacggtccgtaccggaggggaaggtcgtagggtaggtagtagttacgtacttaacgngttacgaaggtagttaggtagtaacttacatactacgtacgactagctcgtggtacggacggtctacgtccacgtcctacgacggaccacgacgtaaagagtacagttgacttcgacgtacgtagtacgactacgcgacggacgtacggacccggaaggcccgttaaccgggttcggttttaaccgacgggtcggacgggaccggtaacggtaccggtcccttcgtcccgttaccccg

SEQ ID NO: 230848 - DNA, 758 bp, Homo sapiens
  misc_feature: GYAE6OF01AE3FN.47.36.D03.1.454.CMB.1.raw
tcagagctcacgtacacgaccggtgctcgatttagctgcgtcacgatctctcttgggggcaggagtcagacccagtcaggacacagcatggacatgagggtcccgctcagctcctggggctcctgttgctctggttcccaggttccagatgcgacatccagatgacccagtctccatcttctgtgtctgcttctgtaggagactagagtcaccatctacgttggtcgggcgagtcgagggttattagacaacgttggttacgtccgtggttaactacaaacgaacgaaaaccgaacggggaaacccgaccccccttaaacccgtccctacctaacttcctactaacctcgacctaactttccccgtaacttttcggaaccgtaaaacgggttccggggtaccctaacggttacgtaaacggttcccgaaggtcggactagggtggtaacgttccgggtaggggaacgtaggtactttcctaccttacttacctaacttactcgacgccaacggtcctcgacgacgtaccgtaggtaagttaacgttttcggtaaactttaatttacgttaacgttaaccgaaacggttaacgggttaaccgttacccggtttacccgttaccgttaacccttaccggttaccggggtaccgggacgggtaaaccggtacgggtaagggaacgtaaaggtaacgggaaaagttacccgggttagggtacgggtacctacgaaccccgtactaccgttccgtttaccggg

SEQ ID NO: 230849 - DNA, 806 bp, Homo sapiens
  misc_feature: GYAE6OF01B8PXI.47.36.D03.1.454.CMB.1.raw
  modified_base (363)..(363): a, c, t, g, unknown or other
  misc_feature (363)..(363): n is a, c, g, or t
tcagagctcacgtacacgaccggtgctcgatttagctgcgtcacgatctctcgttgggggcaggagtcagacccagtcaggacacagcagtggacatggacgggtcccgctcagctcctggggctctgtgctcgtcggttccaggttccagatgcgacatcagatcgaccagtctccatcttcgtgtgtctgtacttcgtagtacggagacaggtactccaacctatccacgttggaccgggacgtagtacgagggtcttagactaaagtcgtcgttcggtaccgttggttacaagactaacgaaccgaaccggaagggaaaccgtcccctaacggtccttaccaggtaactttccgaaacgngttacggacctaacgtacccgtaaaagtttacggaaaccggtcgggtaaccctaaggtacccgtaaagggtttaccgaagggtttaagggaaacggttcggtaacgttaccggtaggggtaaacttacgggttttaactttttacctaccgtaacctacgttaccgaggtacctaacgtccgttaacggccgtaacggtaccgtaaagggtaaacttaagttaaccggttagtaaacctaacggttaaacttttacctttaacgggttaaccctaaacgttaaaccggtaagttaacccttaaacgttaacttacccgttacccgttaaacccccgttacgggttttaaccccggacggtttaaacccgggaaccggttaaaagttcccggtaaagtaaccctaacgtaaacgtacggacgtcggaactacgtaccgtaaccg

SEQ ID NO: 230850 - DNA, 747 bp, Homo sapiens
  misc_feature: GYAE6OF01EKK13.47.36.D03.1.454.CMB.1.raw
tcagagctcacgtacacgaccggtgctcgatttagctgcgtcacgatctctcttgggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagcgtgggtggaggtcgtggggggagtacttggtacaaggtcccgtggggacggggtccctggacgaccttctccgtgtcgcgacgccctctggtacttcctacccttcgagttacgaaccttaactaacgattggacgtcgtgggactcccggccgagggcctaccggaaggggaagggacgtagggaggtggtagttcggtacttacagtcgtaaggttaggtaggttacgggttaactttaaccgtaatttaacgttaacctaacggtactaacgtaccttcgtaggtacgggaaacggggtcccgtaacgtttcccgaaccccggttacccgtacccggaacggggtaaacccaacccggacccgaaaggtaacggttactaaggttcggaattccggtaggacgtaataaccggaaacgtacggaccgtaggaacgggacggacccgggtaacgggtaccgggtttaccgttttaagttaccggacggtacggacggtacgggtacccgggtaccccttccgtccccgtcccgtaccgg

SEQ ID NO: 230851 - DNA, 709 bp, Homo sapiens
  misc_feature: GYAE6OF01BL1P3.47.36.D03.1.454.CMB.1.raw
  modified_base (128)..(128): a, c, t, g, unknown or other
  misc_feature (128)..(128): n is a, c, g, or t
  modified_base (607)..(607): a, c, t, g, unknown or other
  misc_feature (607)..(607): n is a, c, g, or t
  modified_base (652)..(652): a, c, t, g, unknown or other
  misc_feature (652)..(652): n is a, c, g, or t
  modified_base (686)..(686): a, c, t, g, unknown or other
  misc_feature (686)..(686): n is a, c, g, or t
tcagagctcacgtacacgaccggtgctcgatttagctgcgtcacgatctctcttgggggcaggagtcagacccagtcaggacacagcatggacatgacgggtcccgctcagctcctggggctcctgtnctctggtcccaggttccagatgcgacatccagatcgacccagtctccatctctgtgtctgtcttcgtggtaggagacaggtacgtacactaactcgtaaccgtttggtaccgggacgtaagttccggaaggggtttaaccttaggtaccctaaaggttccgggttacgaccgttagggtaactaccgaaacgaaacggtaaaacccgaaggggtaaaacccctcccccgtaaaccgtcctaccaactccctacttaagccgtactaactcctaacgttacgacgtaaagggtccgggtacccagtacgaacggttcaagggtcgacgtagtacgaacttcggacgggtaacacggtatttacccgaacttccgtacgtaactactaccggaactcgaaacgtcctacgtacacgtacgtgtaacgttcgttacgaatttctacgtaggtaaccaacggtacgttacgtcggtttacccncttaccggaccgttgggaccggaccgtaccggtaaaggcggtaanaacggtagggaaactcggttaaggccgtacggtnaacccgtacgtgtttccgtaccg

SEQ ID NO: 230852 - DNA, 713 bp, Homo sapiens
  misc_feature: GYAE6OF01BKQL0.47.36.D03.1.454.CMB.1.raw
  modified_base (181)..(181): a, c, t, g, unknown or other
  misc_feature (181)..(181): n is a, c, g, or t
  modified_base (249)..(249): a, c, t, g, unknown or other
  misc_feature (249)..(249): n is a, c, g, or t
  modified_base (431)..(431): a, c, t, g, unknown or other
  misc_feature (431)..(431): n is a, c, g, or t
  modified_base (502)..(502): a, c, t, g, unknown or other
  misc_feature (502)..(502): n is a, c, g, or t
tcagagctcacgtacacgaccggtgctcgatttagctgcgtcacgatctctcgtgggggcaggagtcagacccagtcaggacacagcatggacatggacgggtccccgctcagctccgtggggctccgtgttgctcgtggtcccaggttccagatgcgacatccgagatcgacctagtccnctatcttcgtgtgtctgtcttcgtagtaggagacgagtgtaccacctatccgtacgttcggtacgggngtacgtacgtagggttacttaggaccgtaagttggttacgcgttaggtaataccaaacggaacgtaaaccgaacggggtaaaccctacccccttaaccgttcctaatcgttaccctaactagaccgtactactacctacggttacgtaagtaacgggtccgggtacctagtacgtaggtacncggacgtacgaggtacgtacttacgggtaacgtcgaagttacgtttccaccgttcctactactagtaccgngtaccgtcgacgtacgataccgacgttagttacgttaagtttagtaactttataaggttactagtaaacgttaacggttaaccgttacgttacccgttacgtaccgtacccgggtggaaccggggaacggttaccggaaggggtacggtaaagttcgaaaagggtaacgtacggtacggtcggacggtacaacggttactagtccgttacg

SEQ ID NO: 230853 - DNA, 506 bp, Homo sapiens
  misc_feature: GYAE6OF02JAS50.47.36.D03.1.454.CMB.1.raw
tcagagctcacgtacacgaccggtgctcgatttagctgcgtcacgatctctcttggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaagcccctaacctcctcatctctactgcatccactttgcaaagtggggtcccatcaaggttcagcggcagtggatctgggacagatttcactctcactatcagcagcctgccagcctgaagattttggaactttattattgtacaacagggttaacagtttcccgcttcaccttcggacggagggaccaaggtggaagataggaaaagacgtgtggctgcacctatctcg

SEQ ID NO: 230854 - DNA, 562 bp, Homo sapiens
  misc_feature: GYAE6OF02GWG83.47.36.D03.1.454.CMB.1.raw
tcagagctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaacgcccctaacctcctcatctctactgcatccactttgcaaagtcgggtccatcaaggttcagcggcagtggatcgtgggacagatttcactctcactatcagcagcctgcagcctagaagtattttaggaactttaattattagtacaaacgtagggttaaactacggttttcccgacttccgtaccgttcgggaccggtacgggtaccgtaagggtcgggtaagaacgttaaggaaaacgtaacgttggtacggtctacggaccaaccgtactacgttacgg

SEQ ID NO: 230855 - DNA, 535 bp, Homo sapiens
  misc_feature: GYAE6OF02GHINZ.47.36.D03.1.454.CMB.1.raw
tcagagctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgcgggcagtcagggtattagcaactggttagcctggtatcaacagaaaccagggaaacgcccctaacctcctcatctctactgcatccactttgacaagtcgggtccatcaaggttcagcgcagtggatcgtgggacagatttcactctcactatcagcagcctgcagcctgaagtattttggaactttattattgtacaacgtagggttaactacggttttcccgcttacctacccgtttcgggacgggtagggaccaagggtggaagaagtaaggaaaacgtacgtggtcggactggacctacgtatcttacg

SEQ ID NO: 230856 - DNA, 568 bp, Homo sapiens
  misc_feature: GYAE6OF02F2XQ9.47.36.D03.1.454.CMB.1.raw
  modified_base (388)..(388): a, c, t, g, unknown or other
  misc_feature (388)..(388): n is a, c, g, or t
tcagagctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaacgcccctaacctcctcatctctactgcatccactttgcaaagtgggtcccatcaaggttcagcgcagtggatcgtggacagatttcactctcactatcagcagcctgcngcctgaagtattttaggaactttatttattgtacaaacgtagggtaaacctacggttttccccgcttaccgtacccgtttcggccgggtaacgggtacccaaggggtcggaaggtaacgttaggaaaaacggtaaccgttagggttacggacttacggacctaaccctagttccgttacg

SEQ ID NO: 230857 - DNA, 561 bp, Homo sapiens
  misc_feature: GYAE6OF02HHACP.47.36.D03.1.454.CMB.1.raw
tcagagctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttggtcgggcgagtcagggtattagcaactggttagcctggtatcaacagaaaccagggaaacgcccctaacctcctcatctctactgcatccactttgacaaagtcgggtccatcaaggttcagcggcagtggatcgtagggacagtactttcactctcactatcagcagcctgcagcctagaatacttcgtgactaactttattacttcgttcctaccgtagttagttgattcggtaccctttacccgtacggtaccgtttccggaccgaaacggggtaccgtaaagggtaacggtaaactaccgtaaaacggtacgtggtacgggtctacggacctaacg

SEQ ID NO: 230858 - DNA, 502 bp, Homo sapiens
  misc_feature: GYAE6OF02IOSOB.47.36.D03.1.454.CMB.1.raw
  modified_base (334)..(334): a, c, t, g, unknown or other
  misc_feature (334)..(334): n is a, c, g, or t
  modified_base (363)..(363): a, c, t, g, unknown or other
  misc_feature (363)..(363): n is a, c, g, or t
  modified_base (414)..(414): a, c, t, g, unknown or other
  misc_feature (414)..(414): n is a, c, g, or t
  modified_base (437)..(437): a, c, t, g, unknown or other
  misc_feature (437)..(437): n is a, c, g, or t
  modified_base (445)..(445): a, c, t, g, unknown or other
  misc_feature (445)..(445): n is a, c, g, or t
  modified_base (494)..(494): a, c, t, g, unknown or other
  misc_feature (494)..(494): n is a, c, g, or t
tcagagctcacgtacacgaccggtgctcgatttagctgcgtcacgatctctcttggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggagtctgggggagacttggtcaagcctggagggtccctgagattctcctgtgcagcctctggattcaccttcagtgactactacatgagctggatccgcaggctcaggagctgagtgatgctanatcagtagtagtgtattacatatacacgnagactcgtgtgaagggccattcaccgtctcgagggacaacgcaagaacgtnaatggattcgtgacgaatgaacngcctgagngccgaggactaccgggcgtttaatacgtgacggacgacgacggccttcnccgtaccc

SEQ ID NO: 230859 - DNA, 573 bp, Homo sapiens
  misc_feature: GYAE6OF02IUWBD.47.36.D03.1.454.CMB.1.raw
  modified_base (271)..(271): a, c, t, g, unknown or other
  misc_feature (271)..(271): n is a, c, g, or t
  modified_base (488)..(488): a, c, t, g, unknown or other
  misc_feature (488)..(488): n is a, c, g, or t
tcagagctcacgtacacgaccggtgctcgatttagctgcgtcacgatctctcttggggagctctgggagaagagccccagccccagaattcccaggagtttccattcggtgatcagcactgaacacagaggactcaccatggagtttgggctgagctgggttttccttgttgctattataaaggtgtccagtgtcaggtgcagctggtggagtcgtgggggagacttggtcaagcctgggacgggtccctgagactctcctgtgcagcctntggattcaccttcagtgaactactacatgagctggactccgcaggctccgagggaggactgggagtggattcgacttacatcagtagtagtgtacttaccatatactacgcagtactgtggtaggaacgggccgaattccgaccgttcctaccggaaggggaccaaaccgaccgaaagtacgtactaagttgggattccgtagacgtaatggaaacngaccgtagagacgaccggagggtaacaccgggttaccgtttaattaccgtggaccggcggaagtccggcccttcgtccctacccg

SEQ ID NO: 230860 - DNA, 541 bp, Homo sapiens
  misc_feature: GYAE6OF02GYMOS.47.36.D03.1.454.CMB.1.raw
  modified_base (202)..(202): a, c, t, g, unknown or other
  misc_feature (202)..(202): n is a, c, g, or t
tcagagctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtagganacagagtcaccatcacttgtcgggcgagtcagggcgttgcaaatgctttggcctggtttcagcagacaccagggaaggcccctaagcgcctgatctatggtgcatacactttgactaaaggtcggggtacccagtcaaggtttcagcggcagtaggtcgtggacagtagtcactctcactatcagcggcctgcacgcctgaacgtattctgtactaactttattactgtctctagtatgtatcgtaccttacccgtcgtaccgtttccggaccggtaacggtaccgtaaaggtacggtaaactaccggaaaccgtacgtacggtacggtactggtaccc

SEQ ID NO: 230861 - DNA, 835 bp, Homo sapiens
  misc_feature: GYAE6OF02I4H64.47.36.D03.1.454.CMB.1.raw
  modified_base (309)..(309): a, c, t, g, unknown or other
  misc_feature (309)..(309): n is a, c, g, or t
tcagagctcacgtacacgaccggtgctcgatttagctgcgtcacgatctctcttgggggcaggagtcagacccagtcaggacacagcatggacatgagggtccccgctcagctcctgggctcctgttgctctggttcccaggttccagatgcgacatccagatgacccagtctccatcttctgtgtctgcttctgtaggagacagagtcaccatcacttggtcggcgagtcagggtattaggacaacgtggttacgcctggtatcgaacagaaaccaagggaaacgcccctaactcctcaatctctacncgacatccctactttgacgtaaaggttcggggtacccctaagtaccgtaaagggtttaccacggtccgggacgtaaggttacggtaacgttccgtaagggggaactaacggttaacttttccgaaccttccttaacctaaccttaattacccgtaagacccgtaaggcccgttacggaccgtaaccgttcccggttaagtaaaaccgggttagtttttttaaacgggaaaacccgttttttaaagttttaaccgttttaggttaaacccgtaaaaccgggttaaacgggggtttaaaaccccgtttaaccgggttttttacccccggtaccggttttaaacccgtaacccccgggtttttaaccgggggtaacccgggggtaaacggggggtaaccccggttaaaagggggtttacggggaaaccggttaaaaggttaacggggtaaaaaaacggttaaccggtttacggggtaacggttaccggtttaccgggaccccttaaactaccggtttacccgtttacgg

SEQ ID NO: 230862 - DNA, 565 bp, Homo sapiens
  misc_feature: GYAE6OF02G2DD5.47.36.D03.1.454.CMB.1.raw
tcagagctcacgtacacgaccggtgctcgatttagctgcgtcacgatctctcttgggggcaggagtcagacccagtcaggacacagcatggacatgagggtccccgctcagctcctgggctcctgttgctctggttcccaggttccagatgcgacatccagatgacccagtctccatcttctgtgtctgcttctgtaggagacagagtcaccatcacttgcgggcgagtcagggtattagcaactggttagcctggtatcaacagaaaccagggaaacgcccctaacctcctcatctctactgcatccactttgcaaagtgggtcccatcaaggttcagcggcagtggatcgtaggggacagtatttcactctcactatcagcagcctgcagcctgaacgtatttggaacttattatgtacaacgtagggtaactagtttcccgcttaccgtaaccgtttcgggaccgggaacgggtacccgtaagggtacgggtaaggtacgttaaggaaaacggtaacgtggttacgggtaccttcggaccgtaaccgtacgtccgttaccgg

SEQ ID NO: 230863 - DNA, 530 bp, Homo sapiens
  misc_feature: GYAE6OF02GUG2F.47.36.D03.1.454.CMB.1.raw
  modified_base (281)..(281): a, c, t, g, unknown or other
  misc_feature (281)..(281): n is a, c, g, or t
  modified_base (399)..(399): a, c, t, g, unknown or other
  misc_feature (399)..(399): n is a, c, g, or t
tcagagctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaacncccctaacctcctcatctctactgcatccactttgcaaagtgggtcccatcaaggttcagcgcagtgatcgtggacagatttcactctcactatcagcagcctgcacgcctagaagtnttctgactaactttattactgtcctccagttatgaatcgtaccttacccgtcggtaccttttcggaccgaacgggtaccaagggtagaaacttacgaaaccggtacgttggtaggtcctaggacctaaccg

SEQ ID NO: 230864 - DNA, 537 bp, Homo sapiens
  misc_feature: GYAE6OF02GGDJO.47.36.D03.1.454.CMB.1.raw
tcagagctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcagtcagggtattagcaactggttagcctggtatcaacagaaaccaggaaacgcccctaacctcctcatctctactgcatccactttgcaaagtcgggtcccatcaaggttcagcggcagtggatctgggacagtatttcactctacactatcagcagcctgcagcctgaagtattttggaactttatattgtacaaacgagggtaactaggtttcccgcttccaccgtttcggccggagggtaccgaagggttggaagtagtacggaaaagtacgttggtacggtacgtcgaccaaccgtagtcttacgg

SEQ ID NO: 230865 - DNA, 487 bp, Homo sapiens
  misc_feature: GYAE6OF02GEY2X.47.36.D03.1.454.CMB.1.raw
tcagagctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgccgggcagtcagggcgttgcaaatgctttggcctggtttcagcagacaccagggaaggcccctaagcgcctgatctatgtgcatacactttgcaaagtggggtcccatcaaggttcagcggcagtaggtctgggacagagttcactctcactatcagcggcctgcagcctgaagattctgcaacttattactgtctcagtatgatgcttacctcgactttcggcctaagggaccaaggtgaaatacaacgaacgtgtcggctgacc

SEQ ID NO: 230866 - DNA, 524 bp, Homo sapiens
  misc_feature: GYAE6OF02IGQAH.47.36.D03.1.454.CMB.1.raw
  modified_base (376)..(376): a, c, t, g, unknown or other
  misc_feature (376)..(376): n is a, c, g, or t
  modified_base (383)..(383): a, c, t, g, unknown or other
  misc_feature (383)..(383): n is a, c, g, or t
tcagagctcacgtacacgaccggtgctcgatttagctgcgtcacgatctctcttggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggagtcgtggggggagacttgggtcaagcctgggagggtccctggagactctcctgtgcagcctctggattcaccttcagtgactactacatgagctggatccgcaggctcgagggaggactggagtggatgcttacatcagtagtagtgtattaccatatactacncagactntgtagaacgggccattcacgtctcgaggacaacgcaagatcattggatcgtagcgaatgaaacagcctagagacgccggaaggaccgaccggtacgttttacgtaagtcggcggacgacgggacggccttacgcctacccg

SEQ ID NO: 230867 - DNA, 611 bp, Homo sapiens
  misc_feature: GYAE6OF02I0XRR.47.36.D03.1.454.CMB.1.raw
  modified_base (264)..(264): a, c, t, g, unknown or other
  misc_feature (264)..(264): n is a, c, g, or t
  modified_base (278)..(278): a, c, t, g, unknown or other
  misc_feature (278)..(278): n is a, c, g, or t
tcagagctcacgtacacgaccggtgctcgatttagctgcgtcacgatctctcttgggggcaggagtcagacccagtcaggacacagcatggacatgagggtcccgctcagctcctggggctcctgttgctctggttcccaggttccagatgcgacatccagatgacccagtctccatcttctgtgtctgctttctgtaggagacagacgtcaccatcacttggtcgggcagtcaggtattagcaactggtagcctggtatcaanagaaccagggaacncccctaactcctcatctctactgcactccactttgacaaagtgggtccatcaagttcagcgcagtgactcgtggacagtactttcactctcgtaactatacagcaggcctgaccagtcctagaacgtagttttagggaactttattagtttacgtaacctaacgtaacgggttaacgttacggttttaccccgacgttacccttaacccggtttccgggaccgggtaacgggtacccgtaaggggttaccgggtaaggtaaccgttagggaaaaaacgtaccggttaggttacgggtaccttacggtaccgaacccgttagttacgttaccgg

SEQ ID NO: 230868 - DNA, 580 bp, Homo sapiens
  misc_feature: GYAE6OF02GLXQ3.47.36.D03.1.454.CMB.1.raw
  modified_base (332)..(332): a, c, t, g, unknown or other
  misc_feature (332)..(332): n is a, c, g, or t
  modified_base (390)..(390): a, c, t, g, unknown or other
  misc_feature (390)..(390): n is a, c, g, or t
  modified_base (440)..(440): a, c, t, g, unknown or other
  misc_feature (440)..(440): n is a, c, g, or t
  modified_base (468)..(468): a, c, t, g, unknown or other
  misc_feature (468)..(468): n is a, c, g, or t
tcagagctcacgtacacgaccggtgctcgatttagctgcgtcacgatctctcttggggagctctgggagaagagccccagccccagaattcccaggagtttccattcggtgatcagcactgaacacagaggactcaccatggagtttgggctgagctgggtttccttgttgctattataaaggtgtccagtgtcaggtgcagctggtggagtcgtgggggagacgttggtcaagcctgggacgggtccctgagactctcctgtgcagcctctggattccaccttcagtcgactactacatgagctggactccgcaggctccgagggaaggcnggagtggattggacttacatcgagtagtagtggtattaccatatactacgcagactcngtaggaaggccgtattccaccgtctaccgagggacaacgccaaagacgtnattggactcgtagacgtaagtcgaaacngtccctaggacgtacggcccggaagggtaaccgtaccgggttacccgttttaagtaaccgttgggaccggtacggacggggtaacggtccccttacgtcccgttaacccccg

SEQ ID NO: 230869 - DNA, 676 bp, Homo sapiens
  misc_feature: GYAE6OF02IRB60.47.36.D03.1.454.CMB.1.raw
tcagagctcacgtacacgaccggtgctcgatttagctgcgtcacgatctctcttggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctgggtggagtcgtggggggagacgttggtcaagccgtgggacgggtccctggagactctcctgtgcagcctctggattcaccttcagtgaactactacagtgacgcgtggactcccgcgaggcctacgaggggaacggctggagtggattgcttacatcgagtagtagtgtaataccatactactacgctagactgtaggtcggaaacggggtccctaattccgaaccccggttctaccggaacggggtaaccaaacccggacccaaaggtaacgttacaagtttcgggaattccggtaggaccgtaaagttcggaaaacctcggtaacccgttagggaacgacgggtacccggaaagggtaccccggttaaaccggggttaccgttttttaaactacccgggttacgggacccggttacggggaaaccggtaccggggtaccccctttaccgttccccgttaacccccgg

SEQ ID NO: 230870 - DNA, 512 bp, Homo sapiens
  misc_feature: GYAE6OF02FV6FA.47.36.D03.1.454.CMB.1.raw
  modified_base (223)..(223): a, c, t, g, unknown or other
  misc_feature (223)..(223): n is a, c, g, or t
  modified_base (452)..(452): a, c, t, g, unknown or other
  misc_feature (452)..(452): n is a, c, g, or t
tcagagctcacgtacacgaccggtgctcgatttagctgcgtcacgatctctcttggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggagtctggggganacttggtcaagcctggagggtccctgagactctcctgtgcagcctctggattcaccttcagtgactactacatgagctggatccgccaggctccgagggaggactgggagtggattgcttacatcagtagtagtgtataccatatactacgcagactctgtgaagggcctattcgaccgtctccgagggacaacggccaaagacgtcagttggatctgacgaatgaacngcctgagagccggaggccggtccgtttatacgtgacgcggagacggcctctcctccctag

SEQ ID NO: 230871 - DNA, 599 bp, Homo sapiens
  misc_feature: GYAE6OF02I7KK4.47.36.D03.1.454.CMB.1.raw
  modified_base (355)..(355): a, c, t, g, unknown or other
  misc_feature (355)..(355): n is a, c, g, or t
tcagagctcacgtacacgaccggtgctcgatttagctgcgtcacgatctctcttggggagctctgggagaagagcccccagccccagaattcccaggagtttccattcggtgatcagcactgaacacagaggactcaccatggagtttgggctgagctgggttttccttgttgctattttaaaggtgtccagtgtggggtgcacctgatggagtcgtgggggaggcctcataaaggccggggggtcccttaaactctcctgcgcagcgtctggatttccttcagtcaagtctggataagctgggtccgccaggctccgagggagtgggcctgggagtgggttggccgtgtcaagngcagaactgagtggtgcgacatctagaatcgctgaccacccgtagaaacggcaagtattccaccatcctaccagacattagattacaaattaaatatgtacaattactactaactaaagtcggtaattaacggtacctaaggtaaactcggaagtactaacggtaggtttagttttaacttacgttacgttacccgtaacggtaggggtaacttcgggtaccggtttacgtcgggttacggggg

SEQ ID NO: 230872 - DNA, 640 bp, Homo sapiens
  misc_feature: GYAE6OF02G2HAS.47.36.D03.1.454.CMB.1.raw
tcagagctcacgtacacgaccggtgctcgatttagctgcgtcacgatctctcttggggagctctgggagaagagccccagccccagaattcccaggagtttccattcggtgatcagcactgaacacagaggactcaccatggagtttgggctgagctgggttttccttgttgctattataaaggtgtccagtgtcaggtgcagctggtggagtcgtggggggagacgttggtcaagccgtgggacgggtccctgacgactctcctgtgcagcctctggattccaccttcagtgactactacatgagctggactccgccaggcctccgaggggaggcgtgggagtggattgcttacatcgagtagtaggtgtacttaccatatactacgcaagtacttcgtaggtacggaacgggtcccgtaattcccgacccggttctacccggaaaggggaccctaaaccgggacccaaaagggtaacgtccgtaagttcggggtaacttcggtagacgtaattccggaaactcggccgtaggacggacgggccggaagggaacccgtaccgggtttcccttttaagtacccgtgggtacccgggacggtaacgggaccgggttcccccttaccgtccccgtacccccg

SEQ ID NO: 230873 - DNA, 563 bp, Homo sapiens
  misc_feature: GYAE6OF02GLMIG.47.36.D03.1.454.CMB.1.raw
tcagagctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttggcgggcagtcagggtattagcaactggttagcctggtatcaacagaaaccagggaaacgcccctaacctcctcatctctactgcatccactttgactaaaggtcgggtcccatcaaggttcagcggcagtggatctgggacagtactttcactctacactatcagcagcctagccagcctagaagttagttttaggaactttattagttgtactaaacgtagggttaaccttcggtttacccgacttacccgtaccgttcgggacgggtacgggaccgaagggtcggaaggtagtaacggaaacgtaacgtaggtggacgtacgtaccacgtacgtcttacg

SEQ ID NO: 230874 - DNA, 526 bp, Homo sapiens
  misc_feature: GYAE6OF02HDFP2.47.36.D03.1.454.CMB.1.raw
  modified_base (453)..(453): a, c, t, g, unknown or other
  misc_feature (453)..(453): n is a, c, g, or t
  modified_base (458)..(458): a, c, t, g, unknown or other
  misc_feature (458)..(458): n is a, c, g, or t
tcagagctcacgtacacgaccggtgctcgatttagctgcgtcacgatctctcttggggagctctgggagaagagccccagccccagaattcccaggagtttccattcggtgatcagcactgaacacagaggactcaccatggagtttgggctgagctgggttttccttgttgctattataaaggtgtccagtgtcaggtgcagctggtggagtcgtggggggagacttggtcaagccgtggagggtccctgagactctcctgtgcagcctctggacttcaccttcagtgactactacatgagctggactccgcaggctcgagggaggctggagtgattgcttacatcagtagtgtgtatacatatactacgcagtactgtggtaggaacgggcctattccaccgtctaccgagggaccaacgccaaagactcagttggacttcgagacgtaangaacngcctagacgagccggagggccgttaccgtttatacgtcgcggcgaggaccggtcctcgtcctccctag

SEQ ID NO: 230875 - DNA, 637 bp, Homo sapiens
  misc_feature: GYAE6OF02JU7ZT.47.36.D03.1.454.CMB.1.raw
  modified_base (290)..(290): a, c, t, g, unknown or other
  misc_feature (290)..(290): n is a, c, g, or t
  modified_base (404)..(404): a, c, t, g, unknown or other
  misc_feature (404)..(404): n is a, c, g, or t
tcagagctcacgtacacgaccggtgctcgatttagctgcgtcacgatctctcttgggggcaggagtcagacccagtcaggacacagcatggacatgagggtccccgctcagctcctggggctcctggttgctctggttcccaggttccagatgcgacatccagatgacccagtctccatcttctgtgtctgcttctgtaggagacagagtcaccatccacttggtcgggcgagtcgaggggtattagctaacgtggttacgcctggtactcaacagaaaccgagggaacncccctacctcctacactctctactgcactcctacttgactaaggtcgggtaccatacgaaggttccaggccggcgaggtggatcgtaggactagtacgtttcactctacacttntacagcctagcctgaccgtacgccgttaggtaaacgtttacgttttacggaactttaacgtttagttacgtaaacgtaaaccggttaacggggttaaacccttaccggttttccccgacttcccggttaacccggttcgggaaccgggtaccgggtacgtacgggtagaaccgggtaagtaacggtaaaacgtacgtaggtacggtacgtacgaccgtacgtacgttactccg

SEQ ID NO: 230876 - DNA, 572 bp, Homo sapiens
  misc_feature: GYAE6OF02HXXE8.47.36.D03.1.454.CMB.1.raw
  modified_base (388)..(388): a, c, t, g, unknown or other
  misc_feature (388)..(388): n is a, c, g, or t
tcagagctcacgtacacgaccggtgctcgatttagctgcgtcacgatctctcttggggagctctgggagaagagccccagccccagaattcccaggagtttccattcggtgatcagcactgaacacagaggactcaccatggagtttgggctgagctgggttttccttgttgctattataaaggtgtccagtgtcaggtgcagctgggtggagtcgtgggggagacgttggtcaagcctgggagggtccctgacgactctcctgtgcagcctcgtggtacttcaccttcagtgacttactacatgagctggactccgccaggctaccgagggaacggactgggagtggattgcttacatcagtagtagtgtacttacatatactacgnagactcgtgtaggagggccgtattccgaccgtctaccgaagggacaacgaccaaagacgtcagttcggatcgtagacgtaagtacgaacagccgtaggacggacgccgggaacggaccgtaccgggttaccgttttaacgttacgtcggcggacggacggtaccggtccctcgtcccgtacccg

SEQ ID NO: 230877 - DNA, 661 bp, Homo sapiens
  misc_feature: GYAE6OF02IDKUW.47.36.D03.1.454.CMB.1.raw
  modified_base (184)..(184): a, c, t, g, unknown or other
  misc_feature (184)..(184): n is a, c, g, or t
  modified_base (203)..(203): a, c, t, g, unknown or other
  misc_feature (203)..(203): n is a, c, g, or t
  modified_base (217)..(217): a, c, t, g, unknown or other
  misc_feature (217)..(217): n is a, c, g, or t
  modified_base (303)..(303): a, c, t, g, unknown or other
  misc_feature (303)..(303): n is a, c, g, or t
  modified_base (329)..(329): a, c, t, g, unknown or other
  misc_feature (329)..(329): n is a, c, g, or t
tcagagctcacgtacacgaccggtgctcgatttagctgcgtcacgatctctcttgggggcaggagtcagacccagtcaggacacagcatggacatgagggtcccgctcagctcctggggctcctgttgctctggttcccaggttccagatgcgacatccagatcgacccagtctccatcttcgngtgtctgcttctgtagganagagagtcacatcncttgtcggggcaggtcaggggtattaaggctaaacgtggtagtccgtaggtactacgaaacaagaaaccaagggggtaaaaacccnccccgttaactcctcactactctacnggactactacctacttacgacgtaaaggtccgggtaccaatacgtaacggtttacacggcgggactaacggtaggtactcggtacgggaactaggttactttaccacgttactactaactacgtcacgacgacgtcgtcacgcgacgtagtaagttacgtttaagttaacttagttacgttagtaacctaggtaacgggtaaacgttaccgttcccgtacgttacccgaccggttacgggtaccgggaacggacggttaagggaggtaaacgaggttaaacgaaaacgttaacgggtgttccggtaacgtcgtaccacctaagtccgttacg

SEQ ID NO: 230878 - DNA, 631 bp, Homo sapiens
  misc_feature: GYAE6OF02JEJXB.47.36.D03.1.454.CMB.1.raw
  modified_base (170)..(170): a, c, t, g, unknown or other
  misc_feature (170)..(170): n is a, c, g, or t
  modified_base (529)..(529): a, c, t, g, unknown or other
  misc_feature (529)..(529): n is a, c, g, or t
tcagagctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccngtctccatcttctgtgtctgcttctaggtaggagacagacgtcaccatcacttggtcgggcagtcagggtattacgcactggtagctggtactcaacagaaaccagggaaacgcccctaacctcctccatcctactactcgcactcctatttgacgtaaaacggtcggggtacccagttactaacgggttcaggcgggtactacggtggaactcgttacggggaacacgtatttcaacgtcctacgtactactacgtacgactacggcctcggacacgtcccttaggtaaacgttacgttttaacgtaaactttatttagttacggtaacaacgtaacgggtactaacggtttcccgtntaccgtaccgttaccgggacgggtacggggtactaagggtaggtaacgtaacgttacggaaaagttcgtaggtacggcgtacgacgaccttagtcgttacgg

SEQ ID NO: 230879 - DNA, 704 bp, Homo sapiens
  misc_feature: GYAE6OF02H3R7R.47.36.D03.1.454.CMB.1.raw
  modified_base (281)..(281): a, c, t, g, unknown or other
  misc_feature (281)..(281): n is a, c, g, or t
tcagagctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctcatcttctgtgtctgcttctgtaggagacagagtcaccatcacttgtcgggcagtcagggtattagcaactggttagcctggtatcaacgagaaaccgagggaaacncccctaacctcctcactctctactcgctactccctactttgactaaaggtcggggtacccacttacgtaaaggttcacggccggtacaaggtgggaacttcggtagggggaacctaaggtactttttaccaaccgttcttacctaacttacgttaccaggtacctacggtccccgtaggaccgtaacggtacccgttaggttaaacgttaggttttttaacgggaaacctttttagttaagttttacgtaacccaaacggttacgggtttaaaccttacggttttcccccgacgttcccgtacccggtttacgggaccgggtaagggtaccccgtaaaggggtcgggaaacgtaacggttaaggaaaacgtacgtagggttacggaccgttaaccgggccctaaacgtccgtttaccttacgg

SEQ ID NO: 230880 - DNA, 644 bp, Homo sapiens
  misc_feature: GYAE6OF02I7NM7.47.36.D03.1.454.CMB.1.raw
  modified_base (200)..(200): a, c, t, g, unknown or other
  misc_feature (200)..(200): n is a, c, g, or t
tcagagctcacgtacacgaccggtgctcgatttagctgcgtcacgatctctcttgggggcaggagtcagacccagtcaggacacagcatggacatgagggtccccgctcagctctggggctcctgttgctctggttcccaggttccagatgcgacatccagatgacccagtctccatcctcctgtctgcatctgtagganacagagtcaccatcacgttcggccgggcgagtcgagggcgttgcaaatcgtctttcggccttggtttccagtcagaccaccgaaggggaacggcccctaaggccgcctgacttctagttggtgacatacctacttttaggactaaaggttcggggtaccctaagtaccgtaaggtttccgaaggccggacgtaggttaagggttccgtacggggtaacaaggtacgttaccaactttacctacgaacttagtaccgtacgggccggtccgtgaccgtacggccctagaacggttattccgtaggtaccttaaacgtttacttacgttcgtccttacgtagttacgtagtacttcgtacctttaccgtccggttacgtttaccggaccgtaacggaccgtaaggtacgtaaacgtacgaaacgtacgtaggtcggctagtacccg

SEQ ID NO: 230881 - DNA, 685 bp, Homo sapiens
  misc_feature: GYAE6OF02JE2XA.47.36.D03.1.454.CMB.1.raw
  modified_base (227)..(227): a, c, t, g, unknown or other
  misc_feature (227)..(227): n is a, c, g, or t
tcagagctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcctcctgtctgcatctgtaggagacagagtcaccatcacttggccgggngagtcagggcgttgcaaatcgactttggccttggtttcagcagacaccgagggaacggcccctaagccgccgtgactctagtaggtcgctatactactttgactaaaggtcgggtaccatcgaaggttcagcggacgagttaggtcgtacggacgagtagttcactcgtcacgtactacacggcggtacctggacctagtacccgtagaacgttacgttcttacgaccgttaactttaacgttaccgttaccggtacgttacccgtaaggtttacttacgttaacgttaccgttcccgtttaaccccggtaccggtttaacccggttttacccgggtaaacccggttaaaccgggttaacccggtaaacgggttaacgggttaaaaacccgttaccgggtaaaaacccggttaaaccgttacggggttaaccggttaccggttacggttaacccccgg

SEQ ID NO: 230882 - DNA, 543 bp, Homo sapiens
  misc_feature: GYAE6OF02HMSTB.47.36.D03.1.454.CMB.1.raw
  modified_base (251)..(251): a, c, t, g, unknown or other
  misc_feature (251)..(251): n is a, c, g, or t
  modified_base (380)..(380): a, c, t, g, unknown or other
  misc_feature (380)..(380): n is a, c, g, or t
  modified_base (410)..(410): a, c, t, g, unknown or other
  misc_feature (410)..(410): n is a, c, g, or t
  modified_base (473)..(473): a, c, t, g, unknown or other
  misc_feature (473)..(473): n is a, c, g, or t
  modified_base (509)..(509): a, c, t, g, unknown or other
  misc_feature (509)..(509): n is a, c, g, or t
  modified_base (527)..(527): a, c, t, g, unknown or other
  misc_feature (527)..(527): n is a, c, g, or t
tcagagctcacgtacacgaccggtgctcgatttagctgcgtcacgatctctcttgggggcaggagtcagacccagtcaggacacagcatggacatgagggtccccgctcagctcctgggctcctgttgctctggttcccaggttccagatgcgacatccagatgacccagtctccatcttctgtgtctgcttctgtaggagacagagtcacatcacttggcgggcagtcagggtattagcaactgggttanccttggtactacaaacagaaaaccgagggaaacgtacccctaacctcctcatcctctactgacctatacctactttgacgaaaggttcggggtcccatacgtaacggttcagcggcaaggtggactcgngggacagtatttcactctcactatcagccngactgacacgccgtgaacgttgtttagaactttgtattgtacaacgtaggtactggttacccnctacgtacgttcgcgggagaccgaaggtgaacgtanagtaaagccgtggtacgntacgacactatctacg

SEQ ID NO: 230883 - DNA, 706 bp, Homo sapiens
  misc_feature: GYAE6OF02JU0LL.47.36.D03.1.454.CMB.1.raw
  modified_base (614)..(614): a, c, t, g, unknown or other
  misc_feature (614)..(614): n is a, c, g, or t
tcagagctcacgtacacgaccggtgctcgatttagctgcgtcacgatctctcttgggagctctgggagaagagccccagccccagaattcccaggagtttccattcggtgatcagcactgaacacagaggactcaccatggtagtttgggctgagctgggttttccttgttgctattaataaacggtgtccagtgtcaggtgcagctggtggagtcgtgggggagacttggtcaagccgtgggaggtccctgagactctcctgtgcagcctctggtacttctaccgttctaggtcgtaccttaacgtactagtcgacgtcgtggtactcccggaccgacggtacgtaccggaaggggaaacggggtaccgtagggtaggttcggtaacgttgtaccgttaacacgtttaccgtaaggttaaggttacggttacggggtttaacttaacctaacgttaacgttaaccgttacgtacgtacgtacctttacgttggtaagggtacgggtaccgtaactttcgaaccccggttcctacccgggaaggtaacccaaacggacccgtaaaggaaccgtaccgttaagttacggtactcgacgtacgtaagtaccgaaanacgcgtaggacgacggaccggtacggaccggtaccggttacgtttacgttacgcggtacggacgtacggacgggtccctcgtaccctacccg

SEQ ID NO: 230884 - DNA, 605 bp, Homo sapiens
  misc_feature: GYAE6OF02H16Y7.47.36.D03.1.454.CMB.1.raw
  modified_base (225)..(225): a, c, t, g, unknown or other
  misc_feature (225)..(225): n is a, c, g, or t
  modified_base (360)..(360): a, c, t, g, unknown or other
  misc_feature (360)..(360): n is a, c, g, or t
  modified_base (376)..(376): a, c, t, g, unknown or other
  misc_feature (376)..(376): n is a, c, g, or t
  modified_base (394)..(394): a, c, t, g, unknown or other
  misc_feature (394)..(394): n is a, c, g, or t
  modified_base (397)..(397): a, c, t, g, unknown or other
  misc_feature (397)..(397): n is a, c, g, or t
  modified_base (432)..(432): a, c, t, g, unknown or other
  misc_feature (432)..(432): n is a, c, g, or t
  modified_base (458)..(458): a, c, t, g, unknown or other
  misc_feature (458)..(458): n is a, c, g, or t
tcagagctcacgtacacgaccggtgctcgatttagctgcgtcacgatctctcttggggagctctgggagaagagccccagccccagaattcccaggagtttccattcggtgatcagcactgaacacagaggactcaccatggagtttgggctgagctgggttttccttgttgctattaataaaggtgtccagtgtcaggtgcagcgtggtggagtcgtggggganacgttgggtcaagccgtgggacgggtccccgtgacgactctcctgtgcacgcctcgtcggctcctaccttacgctaacttctcgttccagtcgggtcgtcgggtccgcgacggccggtcgggggagggcgtgggngtcgggtctagagttnttgatgagagtggtagancanattcgacgtgaccgtcgtaggacggtccgtcaccntccacagacgtactagttcgagtacnccgacgtctagtactacctaaacgtaagtacgaacgacgtacctggaaagtaccggacgaacggaccgtacggtaccggttaattacgtttcgttaggagtaccgttaaagtcgttaagaccggtctaccggtacccgtacccccgg

SEQ ID NO: 230885 - DNA, 565 bp, Homo sapiens
  misc_feature: GYAE6OF02G5KJD.47.36.D03.1.454.CMB.1.raw
  modified_base (283)..(283): a, c, t, g, unknown or other
  misc_feature (283)..(283): n is a, c, g, or t
tcagagctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatccacttgccgggacaagtcagagcattaacagcgtatttaaattggtatcacagaaaccagggaaacncccctaacctcctgatctatgctgcatccagtttgctagttaggtcggggtccctagttccttagggttccaggtcgggactaggtggagttcgtagggactaggtatttctacctctacacctagtcagctacgtcgtgacctaacgtagaacgtagtttcgacctaacttactacgtagtacaacacgtacgttaccggtacccgtactacgtttacgaccgtacgggaaccaacgtacgactaacgtacaacgtactggtacgcgtacgacaccgtacg

SEQ ID NO: 230886 - DNA, 811 bp, Homo sapiens
  misc_feature: GYAE6OF02I656N.47.36.D03.1.454.CMB.1.raw
tcagagctcacgtacacgaccggtgctcgatttagctgcgtcacgatctctcttggggagctctgggagaagagccccagccccagaattcccaggagtttccattcggtgatcagcactgaacacagaggactcaccatggagtttgggctgagcttgggttttccttgttgctattataaaggtgtcctagtgtcaggtgcagtctgggtggagtcgtagggggagtacgttggtcaagccgtgggagggtccctagagactctccgtgtcgcgacgtccgttcgtggtacttccaccttgagtgtaacctacgtacagtggaacgtcgtaggactcccggactacggcctaccggaaggggtaacggaccgtggggaacggtcggtagttacgtccttaacgagttacgtaaggttaggtagttaacgttaacttttaacccgaagtttattaaccgttaacgacgtaaaccggtcttaccgggttaaggttaccggaaaacggggtcccgttaactttcccgggaaacccgttttccgaaccgggtaacgggtaaacccgaaaccggtacccgtaaaagtaacgtttccgtaaaggttttcgggaaacccttacgttacggggaaataaaccgggttcgtaaaacccggggtacgtacccgttaacggggaagggtacccggacccgggtaaaagggtaaccccccgggttaagggtttaacccggttttaccgttaaccggacgggtaccgggtaacggttaacccgggaaccggtcccccgtttacgtaccccgttaaccccggg

SEQ ID NO: 230887 - DNA, 687 bp, Homo sapiens
  misc_feature: GYAE6OF02GGXVL.47.36.D03.1.454.CMB.1.raw
tcagagctcacgtacacgaccggtgctcgatttagctgcgtcacgatctctcttggggagctctgggagaagagccccagccccagaattcccaggagtttccattcggtgatcagcactgaacacagaggactcaccatggagtttgggctgagcgtgggttttcctgttgctattaataaaggtgtccagtgtcgaggtgcagcgtgggtggagtcgtgggggagacgttggtcaagccgtgggacgggtccctggacgacctctccgtggtcgcacgtcctcgtaggtactttccaccttcgagttcgaacctacgtacagtgacgtcgtacggaccttcccgaccgtacgggcctaccgggaagggggaacggggacgtaggggacggtggtattcggtacttaacgatacgaaggttacggtaggtttacgttaaacttaccgaatttaacgtacctacgacgtaaagtccttcggtaggtacggaacgggtccctattccgacccggttctaccgggaaggaccctaacgaccaaaggtacgtactagttcggaacttcgagtacaagtcgaaaccgtgtaccgaaggacgtaccggtacggaacgggtaaccctacgggtttaccctttagttacggacggtcggacggtaccggccggtcccttaccgtaccctaccgg

SEQ ID NO: 230888 - DNA, 749 bp, Homo sapiens
  misc_feature: GYAE6OF02FFZ9F.47.36.D03.1.454.CMB.1.raw
  modified_base (203)..(203): a, c, t, g, unknown or other
  misc_feature (203)..(203): n is a, c, g, or t
tcagagctcacgtacacgaccggtgctcgatttagctgcgtcacgatctctcttgggggcaggagtcagacccagtcaggacacagcatggacatgagggtccccgctcagcctcctggggctcctgctgctctggttcccaggtgccaggtgtgacatccagatgacccagtctccatcctccctgtctgcatctgtagganacagacgtcaccatctacgttggccgggcgagtcgagggtcgtgcaaagtgctttggcctggttcagtcagaccacgagggacgccctaagcgcctgatctgtggtgcatacacgtttagacgtaaggtcggggtaccagtacgaacggttcacggcggacgtaggtacgggtccgttacggggacgtaacggtacggttttaacaccgttaccgtaacctaaccgtttaactaccggtaacgggtcccggacccgttcgggacccgtacggtaccccgttaaggtaaaaccgtacgttttaccgtaccggttaaacctttaaaccgtttactttaacccgttacgttaaccccgtttacgtaacggttaacttaggtaacctttaacccggtaccctttaccccggttaacggggttaccccgttttaacccggggaaccggtaaaccgggggtaaacccgttaaacgggggtaaaccggtaaaacgttaaccccggtaaaaaccggtaacccggttacgggttacccgggtacgttaacccggg

SEQ ID NO: 230889 - DNA, 697 bp, Homo sapiens
  misc_feature: GYAE6OF02HHCB3.47.36.D03.1.454.CMB.1.raw
  modified_base (233)..(233): a, c, t, g, unknown or other
  misc_feature (233)..(233): n is a, c, g, or t
tcagagctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatcgacccagtctccatcttctgtgtctgcttctggtaggagacagacgtcaccatcacgttggccggganaagtcagagactaattaacgaggtactaattttaaagttggtactaccaaccgaacggaaacccgaagggaaacccgaccccctaacctcctagactctagtcgctcgactactcctagttgactagtacggtccgggtaccctagttcgtacggtttacgaggtcggtactaggttacggtacgttccggtagggaactagttactttaccgtaccttccgtacctaacctactaccgtacgtacgtaccgttacgtacgaacccttaaccgtaggtaaacgttacgtttacgtaaccgtttaaacctttaaccgtacttaacgtacaaccgttaacggttaccgttaacccggttacccgttacgtttaccggtttaccggaccggtaacgggtaacctaacggtcgtaacctaacgtaaccgaacgtacgttcggtaccgtaccgtacgtacctacctacg

SEQ ID NO: 230890 - DNA, 660 bp, Homo sapiens
  misc_feature: GYAE6OF02GZLSU.47.36.D03.1.454.CMB.1.raw
  modified_base (619)..(619): a, c, t, g, unknown or other
  misc_feature (619)..(619): n is a, c, g, or t
tcagagctcacgtacacgaccggtgctcgatttagctgcgtcacgatctctcttggggagctctgggagaagagccccagccccagaattcccaggagtttccattcggtgatcagcactgaacacagaggactcaccatggagtttgggctgagcgtgggttttccttgttgcttattaataaaaggtgtccagtgtcaggtgcagcgtgggtggagtcggtgggggagtacgttgggtacaagccgtgggacgggttccctaggacgacctcgtcctgtcgcagccttgtgattcaccttcgagtgactaactacatggagcgtggactcccgaccgaggcctccggaaggggaaggggtacctgggagtggtagttacgcttacagttacgaaggttagttacggttggttaaacttacctaattaacgtacgtaacggctaacgtactcgtaggtaggaacggggtaccctagttcccgaaccgttccctacgaacgggaacaaccggaccaaagaacgtcgagttggaacttcgagacgtaattaccggaaacaccgtcgacgaggaccggtaccggaaggtaaccggtaaccgggttacctttaagttaccgnggtaccggacggtaccggaccgtcctccgttacgtaccccg

SEQ ID NO: 230891 - DNA, 573 bp, Homo sapiens
  misc_feature: GYAE6OF02H8AE1.47.36.D03.1.454.CMB.1.raw
  modified_base (200)..(200): a, c, t, g, unknown or other
  misc_feature (200)..(200): n is a, c, g, or t
  modified_base (297)..(297): a, c, t, g, unknown or other
  misc_feature (297)..(297): n is a, c, g, or t
  modified_base (309)..(309): a, c, t, g, unknown or other
  misc_feature (309)..(309): n is a, c, g, or t
  modified_base (371)..(371): a, c, t, g, unknown or other
  misc_feature (371)..(371): n is a, c, g, or t
  modified_base (382)..(382): a, c, t, g, unknown or other
  misc_feature (382)..(382): n is a, c, g, or t
  modified_base (385)..(385): a, c, t, g, unknown or other
  misc_feature (385)..(385): n is a, c, g, or t
tcagagctcacgtacacgaccggtgctcgatttagctgcgtcacgatctctcttgggggcaggagtcagacccagtcaggacacagcatggacatgagggtcccgctcagctcctgggctcctgttgctctggttcccaggttccagatgcgacatccagatgacccagtctccatcctccctgtctgcatctgtagganacagagtcaccatcacttgccgggcgatcgaggcgttgcaaatgctttggctggtttcagcagacacagggaaggccctaagcgctgatctatggtncatacactttgnaaagtcggggtccatcaaggttcagcgcgagtagtctgggacagagttcaactctcgatacncagtcgccgtncancccgttgaaagtacttcgtcgtactaactttaactttaaccgttgtacctttacccaggttactagtaacgttcgtccgtttaccctacgggttaaccgttttcgggtaaccgaaacggggtaaccgtaacgggttaaggtaaaccgttacgaaaacggtaaccttacggtacggtccgtagtacccg

SEQ ID NO: 230892 - DNA, 646 bp, Homo sapiens
  misc_feature: GYAE6OF02IEUSV.47.36.D03.1.454.CMB.1.raw
  modified_base (434)..(434): a, c, t, g, unknown or other
  misc_feature (434)..(434): n is a, c, g, or t
  modified_base (449)..(449): a, c, t, g, unknown or other
  misc_feature (449)..(449): n is a, c, g, or t
tcagagctcacgtacacgaccggtgctcgatttagctgcgtcacgatctctcgttgggggcaggagtcagacccagtcaggacacagcatggacatgagggtcccgctcagctcctggggctcctgttgctctggttcccaggttccagatgcgacatccagatgacccagtctccatcttctgtgtctgccttctgtaggagacaggagttcaacctatctacgttggtcgggcgagtcgaagggttattacgctaacgttggttacgcgtaggtactacaacgacgaaaccgaagggaactaccccctaaccttcctactactcctcttactcgactactcctacgtttcgacgtaaacggttcgggtaccctagtaccgtaaggttcgaggcgtacgaggtacggtactcgtaggggactagtactttccnctacgtactacttanacgacgcacgtcctacggactcgtaccgttaagtaagttagttttaacggttacttttagtacttgtaacgtaacggtacggttaaaccgttcggttaccctctaccgtacggtcgggacggaccggtagtacgggtaggaacgtaaggtaaggaaacgtacgttggacgtacgtaccgaccgtacttatcgttacg

SEQ ID NO: 230893 - DNA, 675 bp, Homo sapiens
  misc_feature: GYAE6OF02I6JCY.47.36.D03.1.454.CMB.1.raw
tcagagctcacgtacacgaccggtgctcgatttagctgcgtcacgatctctcttgggggcaggagtcagacccagtcaggacacagcatggacatgacgggtccccgctcagctcctggggctcctgttgctctggttcccaggttccagatgcgacatccagatgacccagtctcatcttcctgtgtctgcttctgtaggagacagagtcaccatccacttcgtcgggcagtcgagggtattagctaatggttacgcctggtatacaacaacggaaacacgggaaacgacccctaacctcctacactctacctactcgacacctcctacgttcgaccgtaacgggtcgggtaccctaagtacgtaacggtttacgacggtcgggactaggttaggtatcgggtacggatacgttacgttcctacttaccgtactactactacgtacgtacgacgtacctacgaccgaccgtccgttaggtaacgttaagttttacggtaacttttacgttagtttacgtaacctaacggttaaacggttaaccgtttaccgtttacccgcttaacccgtacccggttacggtacggggtaaccggtacggtaacgggtaggtaaggaacgtaaggaaacgttacggtaggccggtacgtacgaccgtaccgtacgttccgtacg

SEQ ID NO: 230894 - DNA, 843 bp, Homo sapiens
  misc_feature: GYAE6OF02H27RF.47.36.D03.1.454.CMB.1.raw
tcagagctcacgtacacgaccggtgctcgatttagctgcgtcacgatctctcttgggggcaggagtcagacccagtcaggacacagcatggacatgagggtccccgctcagctcctgggctcctgttgctctggttccaggttccagatgcgacatccagatcgacccagtctccatcttctgtgtctgtcttcgtgtaggagacgagacgtcaaccatcctacgttggtcgggctagtcgtaaggggtacttaggaccgtaaacgttggttacgtccgttaggtaactacaaaccgaaaggtaaaccccgaaggggtaaaaccgtaccccccttaaaccgttcccgtactactaccttacgtaaccgtgacctactcctacgtttacgaacgtaaacggtccgggtaccctaagtaccgtaaacgggtttaccacgggtaccggtacgtaagggtttaacggtcggttaacgggaaccgtaaggttacggtttaacctacgttaccgttaccgtaaacgttaacgtaccggtaacgggtcccgggtacccgttcgggaccgtaccggtaacccggttagtaaaggtttaccgtttaccgtaccggtaaccgtttaaacttttacgtttaacccgttcgttacccgttaccgtaaggtttaaccgtagttacgttacccggttaacccgttttaaccccggacgggtttaacccgttacccggggtacccggttaaaagggtaacccgttaaagggtaaaccggtaaaaccttaaaccggtaaaccggttaacgttcggttaacggacccgttaggaaccccgttaaccgtcggtttaacccg

SEQ ID NO: 230895 - DNA, 995 bp, Homo sapiens
  misc_feature: GYAE6OF02JQK6J.47.36.D03.1.454.CMB.1.raw
tcagagctcacgtacacgaccggtgctcgatttagctgcgtcacgatctctcttggggagctctgggagaagagccccagccccagaattcccaggagtttccattcggtgatcagcactgaacacagaggactcaccatggagttgggctgagcgttgggttttccttgttgctattagtaaaggtgtccagtgtcgaggtgcagcgtgggtggacgtcggtgggggacgtacgttggtacgaacggccggtagggtacgggttcccgtaggaacgtaccttccgttcccgttggtacggaccgacgtccccgttcgtcgggtacttttacccgaccccttttccgaaggtttaccggtaacccttaaccgttaaccgtagttacggaacggtccgttacggggtaaccccttccccgggacccggtaaccggggtccccgttaccccggggaaagggggggtaaacccggggggtaaaccgtggggggtaacgggttcggggttaacggtttaccgggtttaaccgtttaaaccggtaacgtttaacccggttaaaacggggtttaaccggtttaaaggggtaacggggtttttaaacccttaaacccggtaagtttaaccgttaaacccgttaccgggaccgtaaacgggtacctttaacggttacgggtaacggggttaaaaccccggggtccgttaaaacgtttcccggtaaaccccggttccggaacccggtaaccgggggttaaaccccaaccgggtaaaccccggtaaaggtaaccgggtaaccgttacggtttaccgggtaaaccgtcggtttaacggtaaccggtaagttaccgtaaaccgggtacctaccgggtaggtaacgggaccgaacccgggtaaccgggtaacgggttaaccccgggttaacttttaacggttacccggacggtacgggtaaccggtaccgggtacccggttcccgtttacccgccccgtttaacccgg

SEQ ID NO: 230896 - DNA, 608 bp, Homo sapiens
  misc_feature: GYAE6OF02GD9F8.47.36.D03.1.454.CMB.1.raw
  modified_base (202)..(202): a, c, t, g, unknown or other
  misc_feature (202)..(202): n is a, c, g, or t
  modified_base (205)..(205): a, c, t, g, unknown or other
  misc_feature (205)..(205): n is a, c, g, or t
  modified_base (302)..(302): a, c, t, g, unknown or other
  misc_feature (302)..(302): n is a, c, g, or t
tcagagctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatccctcctgtctgcatctgtagganacngagtcaccatcacttgccgggcgagtcgaggtcgttgactaaagtgtctttggccgttggttcagcagacaccgagggacgccctaagcgcctgatntagtggagcatactacgttgactaaggtcgggtccatacgtaacggttcgagtcggtacgaggtacggtcggtagggaactaggtacgttacctacgtcctaactacttacgtcgaacggtccgcgtacgcaccgtcgtagtaacgtcttcgtacgtactaacgtttacttactcgttcctagttacgtagtacgtactacgttaccgttaccgttacggtacccgtttcgggaaccgtaaaccgggaaccgtaagggtaacgtaacgtaccggaaacgtacggttcggtaggtaccgtggaaccc

SEQ ID NO: 230897 - DNA, 785 bp, Homo sapiens
  misc_feature: GYAE6OF02IHN3U.47.36.D03.1.454.CMB.1.raw
  modified_base (205)..(205): a, c, t, g, unknown or other
  misc_feature (205)..(205): n is a, c, g, or t
tcagagctcacgtacacgaccggtgctcgatttagctgcgtcacgatctctcttgggggcaggagtcagacccagtcaggacacagcatggacatgagggtccccgctcagctcctggggctctgttgctctgttcccaggttccagatgcgacatccagatcgacccagtctccatcttctgtcgtctgtcttctaggtagganacagtacgtccaaccatcctaacgttggtccgggacgtacggtcgaagggggttattacgactaaaccgttgggttacgccgttaggtaactaccgaacgtaacggaaaacccgaacggggaaaacccgtccccctaaacccctccctactacgttccttacctaaccgtggacctaaccgttacccctacgttttaccgaacgtaaaacgggttccggggtaccctaagttccgtaaaacggtttccgaacggtaccggtacgtacggtacggtactacggtacgggaactagtacttttcccgacttaccctactaaccgtataccgtacgacgtacgtcccgtgaccgtagtccgttaagaacgtttacgtttaacgtaccttttaagtacgtttagaaccgttaaacggtacgggttaaacgtaccggtttcccgaccgttacccgttacccggttaccgggaaccggggtagtaaccccggtaaggggttaacgggaacgtaacgtaaaggtaaaaccgttaccggacggttaccggcggttaacccgacccgtaacgttcccggttgttaccgg

SEQ ID NO: 230898 - DNA, 796 bp, Homo sapiens
  misc_feature: GYAE6OF02I42HD.47.36.D03.1.454.CMB.1.raw
  modified_base (173)..(173): a, c, t, g, unknown or other
  misc_feature (173)..(173): n is a, c, g, or t
  modified_base (211)..(211): a, c, t, g, unknown or other
  misc_feature (211)..(211): n is a, c, g, or t
tcagagctcacgtacacgaccggtgctcgatttagctgcgtcacgatctctcttgggggcaggagtcagacccagtcaggacacagcatggacatgagggtcccgctcagctcctggggctccgtgttgctctggttcccaggttccagatgcgacatccgagatcgaacccngtcctccatcttctgtgtctgtctctgtagagtacagngtacactatcacgttgtcgggcagtcgagggtattcgactacgttggttacgccgttaggtactaccgaaaacgaacggaaaacccgaagggggtaaaccctacccccttaaacctccctacgtaacctacccgttctaactcgcctaaccgttaccctacgtttacggaaactaacggggttccggtaccctagttaacgtaacggtttaccgaaggtccgggtaccgaggttacggacgtaccggtagggtaacctacgtttaacgtttcgtaacccttagtacccctaattacgtcgtaaacgtccgtaacgtccggtcgtaactaccgttacgttaaagggtacttttaacggtttaccggtaaacttttaactttaagtttaccgaaaccgttaaggtttaaacccggggttaaccttttaccggttaccccgaccgtttaaccgaccgggtttaacgggaccggggttaaccggggtaaccttacgggggtaaacgtaacggtaaaggttaacgaaaccgggttacgtacgggttaccggtcgttaccggaacccgttaacctacggttacgttacccg

SEQ ID NO: 230899 - DNA, 791 bp, Homo sapiens
  misc_feature: GYAE6OF02ILVOA.47.36.D03.1.454.CMB.1.raw
tcagagctcacgtacacgaccggtgctcgatttagctgcgtcacgagtctctcttggggagctctgggagaagagccccagccccagaattcccaggagtttccattcggtgatcagcactgaacacagaggactcaccatggagttgggctgagcttgggttttccttgttgtctattataaaaggtgtccagtgtcaggtgcagctgggtggagtcgtgggggatacgttggtacaaggcccgttgggacgggtcccctggacgacctcgtcctggtcgcgacgtccgtcgtggacttccgtacccttctagtcgtaacctacgtactagtggacgtccgtaggacgtcccgaccgaggtcccgtaccggaaggggaacggtcgtagggacggtggtacttcggtaccttacgtacgtacgtaaggttaggttacggttacggttaacttaacccgtaagtttaaccgtaacccggttaaccgtacgtaaccggtaaccgttcggtacggttaacgggaaccggggtacccgtaacgtttcccgaacccggtttccgtacccgggtaacgggtaacccgaaaccggtacccgaaaacggtaacgtacgtagttcgggtaacttcggtacgacgtaacgtacgaaaccgtacgccgtaggacggtacggacccggaacgggtaacccggtaacccggggttaccgtttttaaacgtacccggtacgggtacccggaacccgggtaaccgggtacccgggttaccccttcccgttaccccgtaacccccgg

SEQ ID NO: 230900 - DNA, 782 bp, Homo sapiens
  misc_feature: GYAE6OF02JT87M.47.36.D03.1.454.CMB.1.raw
  modified_base (218)..(218): a, c, t, g, unknown or other
  misc_feature (218)..(218): n is a, c, g, or t
tcagagctcacgtacacgaccggtgctcgatttagctgcgtcacgatctctcttgggggcaggagtcagacccagtcaggacacagcatggacatgagggtccccgctcagctcctggggctcctgctgctctggttcccaggtgccaggtgtgacatccagatcgacccagtctccatcctccctgtctgcatctagtaggagacagtagccaaccntcacttggccgggcgagtcgagggcgttgactaatcgtacgtttcggccttaggttcagtacgacgtaaccaaccggaggggtaaccgccccgtaacggtccgtacccgtagtacgttacgtagttcgggtactaccgttaacgtaaccgttaacgttttacggaaccggtaaacggggttccgggggttacctaaaccggttacggttaaacggttcccggaacgggtaccggtaacgtaacggttacggggttacgtacgggtaacgtacgtacgttacccgacgtttacctaacgtaaccttaacgtcgtaacgggtcccgaccggttacacgtaacgtaccgtaagaacggttacttacgtacggtaacctttaacgtttaaccggttactaccgttcgtaacgttaacgttactacggttacttacccgttacccttaccccggttagttacccgggtacccggtaaacggtaacccgggtaaaccgttaaacgggtacgtaaaacccgttaacgggtaaaaccgtaccggttcggggtaacccgtacgttaaacccgg

SEQ ID NO: 230901 - DNA, 668 bp, Homo sapiens
  misc_feature: GYAE6OF02IKYDP.47.36.D03.1.454.CMB.1.raw
tcagagctcacgtacacgaccggtgctcgatttagctgcgtcacgatctctcttggggagctctgggagaagagccccacgccccagaattccccaggagtttccattcggtgatcagcactgaacacagaggactcaccatggtagttgggctgagcgttgggtttccttgttgctattagtaaaggtgtccagtgtcgaggtgactacgtggtggagtcgtagggggtagtacgttacggtaccgtacccggtcggggggtccctaggacgtaccttcctccgtggtcgctacgtcctcgtggtacctcctacctttagacctactctcgtctaggtcggtcggtcggtacccgcgtacggccggtaccggggacgggtcgtgggtacggtcgggtactacggtaagtcgttgacgtagaagtacggtaggtaggaacgactaagtcgttcgtacggtcggtaccggttaccggtagggtacccgggtccggttaccacgtactccgacgtagaaacgtacgtaacgttcgaagtcacgacgtctagtactagaactaagagaactgtccaggtacgacgacggaagaccgtacgtaccgttatcgttcgtgtacgtacgtaagttactacggtacacggtaccgtccgtacccgtacggcgttcc

SEQ ID NO: 230902 - DNA, 818 bp, Homo sapiens
  misc_feature: GYAE6OF02IKGLL.47.36.D03.1.454.CMB.1.raw
tcagagctcacgtacacgaccggtgctcgatttagctgcgtcacgatctctcttggggagctctgggagaagagccccagcccccagaattcccaggagtttccattcggtgatcagcactgaacacagaggactcaccatggagttgggctgacctggtctttttcttgtggcttaattttaaaaagtgtcctagtgtgaggtgcagctggtggagtcgtgggggaggtcttagtacgagtccggttcgggggtccctggacgtactcctaccgtgccgccgagtcccgtcgttcggtacttcctttaccgtttaagttaacgtttatcgtacctagtacggttaccgttcggggtccccgaccggaacggtccgtaccgggaaggggaacggggtcgtaggggtaggttcgggtacctaggacggtacgtaaggtttcgggtagggttacggtacgggtcgaccgaaggtaaccacgtaacgtttaacggtaaaccgtcccgtaggaccggtacgggtacccgttagttttacctttaccgttaccgtacccgaagtaaaccgtaacctaaacgttacccgaaacggaactaaccgtttacgtagttaacttccgtagtacgtacggttacaaccgtacgtacgtaggtaagtaccggtaaggtacggaacccgttaccgggtaacgttaacgttaacgttttaggttaacggttttaacggttaaaggttacggggtaagttcgggttacgggtacctttaaccggggttaccgtttaccggggttacccggggggaacccggtttaaccccggg

SEQ ID NO: 230903 - DNA, 766 bp, Homo sapiens
  misc_feature: GYAE6OF02I1A5J.47.36.D03.1.454.CMB.1.raw
  modified_base (357)..(357): a, c, t, g, unknown or other
  misc_feature (357)..(357): n is a, c, g, or t
tcagagctcacgtacacgaccggtgctcgatttagctgcgtcacgatctctcttggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggagtcgtgggggagacttagtacacccgtggggggtccctgagactctcctgtgcagcctctggactcacctttagcaactctgtcagtcgggctgggtccgcctagacctccgaggggaaggggctgggaggttggggttgacaanaacgtaaacgtccgaagactagggaacgtcgaaacgtaaaaacctgtaggtacggaccttaccgtacgtacggaaaggggcccgtaactttaccgaacccgaacttccctacccgtaaggaaccggaaacccgtaaaccgaacccgtaaaacgtaaaccctttacccgtaccgtttacgggttttaccctacggtaacccgttaaaaagttccgggaaaccgttacgtacccgtaacgggtaaacgtaacgggtaacccggaaacggttaacccgtaaccggggtacccttagggtttaacggttttaaaccttaaccggtttaggttacgggttccgtttaccgtttaccgttacgggtacccggtacccggttcccggggtaccccgggttacccgttttaccgggg

SEQ ID NO: 230904 - DNA, 859 bp, Homo sapiens
  misc_feature: GYAE6OF02HFK4U.47.36.D03.1.454.CMB.1.raw
tcagagctcacgtacacgaccggtgctcgatttagctgcgtcacgagtcgtctcttggggagctctgggagaagagccccagccccagaattcccaaggagtttccattcggtgatcagcactgaacacagaggactcaccatggagtttgggctgagctgggttttccttgttgctattataaaaggtgtcagtgtcaggtgcagctggtggagtcgtggggggagacctttgggtaccaaacggcccttagggacggggttccccttggacggtaccttctcccgttgttgcctaggccctacgtgggtacttccctaaccgtttccgaaggttcgaaccgttaacttaaccgtagttcggaagtccgttagggaactttcccccgggacccaacgggtcccttaccccgaaaggggggtaacggggtaaccgtaggggtacggttaacgggtggttttaccggaccgtttaaccgtaagtttaccgtaaaggtttaaggttacggtttaggttaaaacttttacccgtaaatttaactttaaaccgttaaccggaaccttaacggtaaccctttcccgtaagggttagggtaaaaccgggggcccgtttaaaggtttacccgaacccgggtttaccttaccccggtaaagggggaacccctaaaaccgggtccccgaaaaggttaaaccggtaccttaagttttacgggggaacttccgttacgacgtaaacgttacgttaaaaccgccgtccgttagaccggaacgccccggtaaggggtacccggtaaccgtttttaacgaacgttcgggccgtaagggtcggaacggtcccgttccgttaccgcccgtaacgg

SEQ ID NO: 230905 - DNA, 834 bp, Homo sapiens
  misc_feature: GYAE6OF02GLJNJ.47.36.D03.1.454.CMB.1.raw
tcagagctcacgtacacgaccggtgctcgatttagctgcgtcacgatctctcttggggagctctgggagaagagccccagccccagaattcccaggagtttccattcggtgatcagcactgaacacagaggactcaccatggagtttgggctgagcttgggttttccttgttgctattaataaaggtgtccagtgtcaggtgcagcgtggtggagtcgtgggggagacgttggtacaacgtccgtgggacgggtccctggacgaccttcgtcctggtcgcagtcccttcgtcggtactttccaccttcgacgttcgaaccttactaactagtacgaggtctaggacttcccggccgaggcccgttaccggaagggggaacggggtaaccgttcggggtaaggttacggtaagtttcggtactttaactagttccgtaaaggtttacggttaacggtttagggtttaactttaacccgtaaatttaacgttaacgttaaccggacctaaacggtaccttccggttaagggttacgggaaaacggggtcccgttaaacgtttacccgaaccccggtttcgtacccggtaaacgggggtacccaaaacccgggtaccaaaacggttaacgtaaccgttaggtttaccgggactttacgtcgggtaaacgtaaacgtacggaaacctcggtaaccgtaggtaacgaccggtacccgggaacgggtaacccggttaaaccggggtttccgttttaaacggtttacccgaacggggtcccggtaacccgggtttaccgggaacccgggttacccctttcccggttacccttaacccccgg

SEQ ID NO: 230906 - DNA, 755 bp, Homo sapiens
  misc_feature: GYAE6OF02G5KN9.47.36.D03.1.454.CMB.1.raw
  modified_base (226)..(226): a, c, t, g, unknown or other
  misc_feature (226)..(226): n is a, c, g, or t
  modified_base (298)..(298): a, c, t, g, unknown or other
  misc_feature (298)..(298): n is a, c, g, or t
  modified_base (406)..(406): a, c, t, g, unknown or other
  misc_feature (406)..(406): n is a, c, g, or t
tcagagctcacgtacacgaccggtgctcgatttagctgcgtcacgatctctcttggggagctctgggagaagagccccagccccagaattcccaggagtttccattcggtgatcagcactgaacacagaggactcaccatggagtttgggctgagctgggttttccttgttgctattataaaaggtgtaccagtgtcaggtgcagcgtggtggagtcgtggggganacgttggtcaagccgtggacgggtccctgacgactctccgtgtcgctagccctcgtggacttcgtaccgttnagtcgaactacgtacattcggacgtcgtaggacctccggacgtaacggcctaccgaaggggggtaacggggtctggggtaacgtgggtaactttcggactttaaccgngttacgaaggtttacggttaggttaaggttaacttaaccgactttaaagttaaccgtccggtaactaacggtacctttacgggtacggttaaccgggaacggggtacccgtaagttttccccggaaccccgtttccgaacccgggtaacggggaaaccctaaacccggaccgaaaagggttaacgtaccgtaaggttcggtaacttcggtacggtaccgaaagttaccgaaacggtacggccgttaggaacggtaccggaccggaacggtaacccggtaaccgggtttccgttttaatacccggtggcccggttacggacggtaaccggtcttcgttcccttaacccgg

SEQ ID NO: 230907 - DNA, 785 bp, Homo sapiens
  misc_feature: GYAE6OF02GCT6S.47.36.D03.1.454.CMB.1.raw
tcagagctcacgtacacgaccggtgctcgatttagctgcgtcacgatctctcttggggagctctgggagaagagcccccagccccagaaacttcccaggagtttccattcggtgatcagcactgaacacagaggactcacagtggagttggctgagtcttgggttttccttggttgtctattaagtaaaaggtcgtccagtgtcgaggtgcagcgtggtggtagtcggtagggggacgtacgttcggtacgaacgtccgttagggacgggtccctaggaacgtaccttccgttccgtggtcgaccgcgtcccgttcgtacggtacttccctaacccttcgacggttacgtaccttaaactacgtagtagacgtcggtacggaccgtcccggacccgtaacgggtccgtaaccgggaagggtaaacggggacgtacggggtggttacggttagttcggtaaccttacgactttacgtaacggtttagttaaggtttacggttaacttttaaccgatttaaccttacgtaaccgtacgtaacgtaccgttacgttagggtaacgggtaaccgggttccgtaacgtttcccgtacccgtacccggtaacccggtaaccgggaaccaaccggtaacccgaaaagtaacggttacgtaaggttacgtacgttagtaccgtaacgtaagactaaacgcgtacgtagaacggacggacggtacgggtaccggttactttacgtaccgtacggcggtaccgaggtcccggtcctccgttaccgtaccctacgg

SEQ ID NO: 230908 - DNA, 944 bp, Homo sapiens
  misc_feature: GYAE6OF02J2FL0.47.36.D03.1.454.CMB.1.raw
tcagagctcacgtacacgaccggtgctcgatttagctgcgtcacgatctctcttgggggcaggagtcagacccagtcaggacacagcatggacatgagggtccccgctcacgctccgtggggcctcctgttgctcttcggtcccaggtccagatgacgacatccagactcgaccccagtcctacccattcctttccgtggttctccgtgtcctttacgttaggtaacggagaacgacggtactaccaaccctataccgtacgttcgggtaccggggacgtacggttaccggtaagggggttaattaaccggacttaaaccgggttgggtttaccggtaccgttaggttaaccaacaaaaccgtaaacgggaaaaaccccggaaaggggtaaaaccccgtccccccttaaaaccgttcccttaaacggtacgttaccctaccgtaactccggacctactacccttacggttttaagaccgggttaaaaggtccggggtcctaaaacgtccggtaaacggtttaccacgggaccgggtacctaaggggttacgggtacttccgggtaaggggtaactaaccggtactttttaccggaaccttacctaactaaccgtttacgtaaccaccggtacgtaacccgtccgtaaacgcccgtaacgtacccggttaacggtaaaaggtttttcgttaaaccgttaaaagttttcccgtttaaggttaaccgtaaccgttaaacgggtacgtttaaaacccggttaccggtttacccgtaaccgttaaccccggttaacggtaccccggggttaagggacccggggttacgtaacggggtaaccgggtaaaacggtaacgttaaacggggtaaaacccacggggttttaacccggacggttaaacggttacccccgggacttaccggttaaacgttcccgttttaacccggg

SEQ ID NO: 230909 - DNA, 871 bp, Homo sapiens
  misc_feature: GYAE6OF02GPJSO.47.36.D03.1.454.CMB.1.raw
tcagagctcacgtacacgaccggtgctcgatttagctgcgtcacgatctctcttgggggcaggagtcagacccagtcaggacacagcatggacatgagggtccccgctcagctccgtgggctcctgttgctctggttcccaggttccagatgcgacatccagatcgacccagtcctccatcttcgtgtcgtctgtccttctggtacggagacgagacgtccaaccactccgtacgttcggtcgggacgtaggtacggtaaggggttacttacggacctaaacggttggtttaacgtcccggttaggtaactaaccgtaaaaccgaaaacggaaaaccccggtaacggggtaaaacccgtacccccccgttaaaccgtccccttacgtaaccgtttcccgttaccgttaacgttaccgtacctaaccgttacccgttaaccgttttacggaaccggtaaaacggggttccggggtaaccccttaacgtttaacccggtaaacggtttaccgaacggtaccgggtacccgtaagggttacggtaacgttaccggttaacggggtaaccgtaaacggttaccgtttttaccgaaacctttccgtaacccgttaacgttaaccgtaccgtaacggtaccgtaacgtccgtacgaccgtaccgtacgttaacggtaaagtttacgtttaacggttaactttaacgtttagttaccgtaacgtaacggttaacggttaccgttacggttcccgtacttccgttaaccggtaccgggtacgggtaaccggtacggtacggttacggaacgtaaaccggttaaggaaaacggttccgtaggttacgccggtaaccgaccttaacgtaccgttcgttacg

SEQ ID NO: 230910 - DNA, 808 bp, Homo sapiens
  misc_feature: GYAE6OF02H9JZF.47.36.D03.1.454.CMB.1.raw
tcagagctcacgtacacgaccggtgctcgatttagctgcgtcacgatctctcttggggagctctgggagaagacgccccagccccagaattcccaggagtttccattcggtgatcagcactgaacacagaggactcaccatggtagttgggctgagcgttgggtttccttgttgctattataaaggtgtccagtgtcaggtgcagcgtggtggagtcggtgggggagtacgttgggtacaagtccgtagggtacgggttccctaggacgtaccttccgtcccgtggtcgacgacgtcccgttcgtggtactttccctaaccctttcgtaacgttacgtaaccttaaccttaacctaagttcggaacgtccgtttacgggaaccgttccccggacccggtacgggtacccgttacccgggaaacggggggtaacgggtaaccggtgggtaaggttacggtacgtttcggtaccttaacgtatacgtaaggttaggttaggttaggttaacctttaccgtaattaacgttaacccgtacgtacgtaacgtaccgttacggttagggtaacgggtaaccgggtacccgtaacggttacccgttaacccggttaccgtaacccggtaaacggggtaacccctaaacgggtaaccccgtaaaacgtaacgtaaccgtagtttacggaacgttccggtaacgaacggtaacgtagtaacccgagtacccgtagaccggtacgacgtaacggaccgtaccggttctttaacgtactccggagtccggtaggaaccgttcctaccttccgtacccg

SEQ ID NO: 230911 - DNA, 136 bp, Homo sapiens
  misc_feature: GYAE6OF01EPXDY.25.10.A10.1.454.CMB.1.raw
  modified_base (136)..(136): a, c, t, g, unknown or other
  misc_feature (136)..(136): n is a, c, g, or t
tcagactgtacagtcacgaccggtgctcgatttagcgtcgatctcagggtccgggagatcatgagggtgtccctgggctgcctggtcaaggactacttccactgtacagtctgagcgggctggcaaggcgcatagn

SEQ ID NO: 230912 - DNA, 137 bp, Homo sapiens
  misc_feature: GYAE6OF01CIGTF.25.10.A10.1.454.CMB.1.raw
  modified_base (136)..(137): a, c, t, g, unknown or other
  misc_feature (136)..(137): n is a, c, g, or t
tcagactgtacagtcacgaccggtgctcgatttagcgtcgatctcagggtccgggagatcatgagggtgtccctgggctgcctggtcaaggactacttccactgtacagtctgagcgggctggcaaggcgcatagnn

SEQ ID NO: 230913 - DNA, 527 bp, Homo sapiens
  misc_feature: GYAE6OF01B0YO1.25.10.A10.1.454.CMB.1.raw
  modified_base (443)..(443): a, c, t, g, unknown or other
  misc_feature (443)..(443): n is a, c, g, or t
  modified_base (514)..(514): a, c, t, g, unknown or other
  misc_feature (514)..(514): n is a, c, g, or t
tcagactgtacagtcacgaccggtgctcgatttagcgtcgatctcagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatttcctgcactggactcagcactgatgttgcaggttattactttgtctcctggtaccaacaacacccaggcaaacgcccccaaacttatcatttatgaggccactaagcggccctcaggagtttctaatcgcttctctggctccaagtctggcagcacggcctcctgacatctctggctcgaggctgaggacgaggctgattatactgctactcatatgacactatacaacaactcccgtnttccggaccgtcgggacccagggtccacccggttccgtcgggtaccacggaccccaacggacccaaccccnctcgtcctacccg

SEQ ID NO: 230914 - DNA, 503 bp, Homo sapiens
  misc_feature: GYAE6OF01A7CBC.25.10.A10.1.454.CMB.1.raw
  modified_base (399)..(399): a, c, t, g, unknown or other
  misc_feature (399)..(399): n is a, c, g, or t
  modified_base (409)..(409): a, c, t, g, unknown or other
  misc_feature (409)..(409): n is a, c, g, or t
tcagactgtacagtcacgaccggtgctcgatttagcgtcgatctcagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaatcaccactgatgttgcatttcatgaccttgtctcctggtaccaacaacaccccgacaaacgcccccaaactcatgattatgaggcactaagcggccctcaggggtttctgctcgcttctctggctcaagtctggcaatcgcctcctgacatctctggtctcgagctgaggcgagctgatttntactgcttcnactatgtcgcagtacgcgtacgttgggtgttcggcgaggacgggacctaaaggtcgaccgttcgtggtccacgcccaaggcctcgccccgtcgg

SEQ ID NO: 230915 - DNA, 581 bp, Homo sapiens
  misc_feature: GYAE6OF01EQXIQ.25.10.A10.1.454.CMB.1.raw
  modified_base (361)..(361): a, c, t, g, unknown or other
  misc_feature (361)..(361): n is a, c, g, or t
tcagactgtacagtcacgaccggtgctcgatttagcgtcgatctcagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaatcaccactgatgttgcatttcatgaccttgtctcctgtaccaacaacaccccgacaaacgcccccaaatcatgattatgaggcactaagcgcctgtagggtttctaatcgcttctctgctccaagtctggcagcacggcctccngacatctcgtgggcctcgaggctaggaggacgaggctaggtatttagttactgtctactactatagtacggactactactacaacctaaacttccccgtacgttaccggacccgttacggggaacccgtacgggtaccctaacccggttcccgtacggggtacccaacccgggaccccgaaaccggaccccctaaacccccgtaccgttccggtaacccc

SEQ ID NO: 230916 - DNA, 622 bp, Homo sapiens
  misc_feature: GYAE6OF01D4KMN.25.10.A10.1.454.CMB.1.raw
  modified_base (383)..(383): a, c, t, g, unknown or other
  misc_feature (383)..(383): n is a, c, g, or t
tcagactgtacagtcacgaccggtgctcgatttagcgtcgatctcgaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatcctcctgcactggaactccacctactgattgttcgactatttcattcgtaccttcgtctcctagtaaccaacaaccacccgacaaaccgaccccaaactcatgtattagtgaggacaacgtaacgccgtccctcgtacgggttctcgtcctccgtcttctcgtcggcctaccaagtcncggacaacgtccggccctacctagtaacacgttcctcgttcggtcctaccgaggtcgtaggaacggtacgaggtcttagtactttacgtacttgtcctttcacaccttagtccggtcgtactaaggttcgtacgtacggttcggtacgttcggacgaagggtaccggaaccgtaagtccggtacccgtcggtggtaccgaccggtacccgaacggtccgtcccgtccccggttacccgg

SEQ ID NO: 230917 - DNA, 566 bp, Homo sapiens
  misc_feature: GYAE6OF01D82Z7.25.10.A10.1.454.CMB.1.raw
  modified_base (315)..(315): a, c, t, g, unknown or other
  misc_feature (315)..(315): n is a, c, g, or t
  modified_base (394)..(394): a, c, t, g, unknown or other
  misc_feature (394)..(394): n is a, c, g, or t
tcagactgtacagtcacgaccggtgctcgatttagcgtcgatctcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaatcaccactgatgttgcatttcatgaccttgtctcctgtaccaacaacaccccgacaaacgccccaaactcatgatttatgaggcactaagcgccctnaggagtttcaatcgcttctctggctcaagtctggcagcacggcctccctgacaatctcgtggctcaggctggaggacgnggctgtatttattactgtactactcattagtggaacactataccaacaaaccttcccgttacttaccgggacccgttcggggaacccgtaggggttacccgacccggttacccgtcggggtacctaacgggtaccccgaaaccgggacccccaaacccccgtacgttacccg

SEQ ID NO: 230918 - DNA, 637 bp, Homo sapiens
  misc_feature: GYAE6OF01CLPSK.25.10.A10.1.454.CMB.1.raw
tcagactgtacagtcacgaccggtgctcgatttagcgtcgatctcgaggggggggtcacaagaggcagcgctctcgggacgtctccaccatggcctgggctctgctgctcctcactctcctcactcagaacacgagggtcctgggcccagtctgccctgactcagcctgcctccgtgtctgggtctccgtggacagtcgatcaccatccgtcctgcactgaactcaccactgatgttgctatttcatgtaccttgtctcctacggtaaccaaaccaaccaaccccgaaccaaaccgacccccaaactcatgtatttagtgaggacacgtaacgccggcctcggtacgggtttctgcctcggtccttctcgtcggtcctacgaagtcgtcggactacgtaccggtcctccgtagacctaactctccgtcggtccgtccgaggtacgtggtaacgggacggacgtcgttaataacgtttacttacgttcgtacttcgtacctaagtacgttacggtaccgacgtacgtacgtacgttacggttcgggttcgttcggtacgaggtaccggaaacgtaagtccggtacccgtcggtaccggaccgtaccggacccgtaggcccgtccgtcccccgttacgg

SEQ ID NO: 230919 - DNA, 568 bp, Homo sapiens
  misc_feature: GYAE6OF01AZUIH.25.10.A10.1.454.CMB.1.raw
  modified_base (335)..(335): a, c, t, g, unknown or other
  misc_feature (335)..(335): n is a, c, g, or t
  modified_base (361)..(361): a, c, t, g, unknown or other
  misc_feature (361)..(361): n is a, c, g, or t
tcagactgtacagtcacgaccggtgctcgatttagcgtcgatctcaggggggggtcacgaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaatcaccactgatgttgcatttcatgaccttgtctcctggtaccaacaacaccccgacaaaacgcccccaaaatccaatagatttatgaggcactaaagcggcctcaaggggttttcngctcgcttctctggacctcaaagtcnggtcaaactacggccctcctgacaatctactggtcctcagctgagggacaagggcctagtattattactgtcttcctacacagtcgttgggactaacggttaagctaaccgttggggtcgtttcgggccaggtaacggggaccaaaagttggaccccgttaccggtgggtcccaaggacccctaaagggcttccgccccctaccggg

SEQ ID NO: 230920 - DNA, 758 bp, Homo sapiens
  misc_feature: GYAE6OF01C7TIY.25.10.A10.1.454.CMB.1.raw
  modified_base (387)..(387): a, c, t, g, unknown or other
  misc_feature (387)..(387): n is a, c, g, or t
tcagactgtacagtcacgaccggtgctcgatttagcgtcgatctcgaggggggggtcacaagaggcagcgctctcgggacgtctccaccatggcctgggctctgctgctcctcactctcctcactcaggacacgagggtcctgggcccagtctgccctgactcagcctgcctccgtgtcgtgggtcctccgtggacagtcgatcaccatctcctgcactggaactcaccactgatgttgctatttcatcgtaccttgtcctcctaggtaacccaaccaaccaccccgaacaaaaccgacccccaaaactcaattagtaatttaacgtaggaacgggtacctaaaccgttaacggcccggtaccccgttacggttaacggggttttcncggtccgttccggtcctttcgtcgtcggtacctaccgtaacggtcgttacgggaacctaacggttacccggcccttacccgtacgtaacctaactccgttacgtcggttaccgaccgtagggtacgtacgggaaacgggacggtaacgtcgttaggtactttaacgtttacgtcgtactttacctactaacgtaacgttcggtaaccggtacgtaacggtacgtacgttacgggtttcgggggtagttccgggaacgtaagggaaccgggtaaaccggtaaaggtccggtaacccggttccggtacggggtaaccctaaccgggaccccggtaagggtccccgttaccccgggtccccggtttaacccggg

SEQ ID NO: 230921 - DNA, 565 bp, Homo sapiens
  misc_feature: GYAE6OF01BXBV2.25.10.A10.1.454.CMB.1.raw
tcagactgtacagtcacgaccggtgctcgatttagcgtcgatctcagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaatcaccactgatgttgctatttcatgtaccttgtctcctggtaaccaacaacacccgacaaacgcccccaaactcatgtatttatgagggcactaagccggccctcgtagggtttctgctcgtcttctcgtgcctccgaagtctaggacaacgtacggccctcctgacaatcgtctgtcccccccctgacgctggaggacgaggctagtactttattacgtcgtcttacgtcactacttagtcggtactacgtagtctacggttgggtcgttcgacgtaaggacgggaacctaaggtcgtacccgtcgtacggtcgtacggcccgaaggtccgtccgtcccccgttcgg

SEQ ID NO: 230922 - DNA, 551 bp, Homo sapiens
  misc_feature: GYAE6OF01B89TL.25.10.A10.1.454.CMB.1.raw
  modified_base (338)..(338): a, c, t, g, unknown or other
  misc_feature (338)..(338): n is a, c, g, or t
  modified_base (413)..(413): a, c, t, g, unknown or other
  misc_feature (413)..(413): n is a, c, g, or t
tcagactgtacagtcacgaccggtgctcgatttagcgtcgatctcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaactcaccactgatgttgctatttcatgtaccttgtctcctgtaccaacaaccacccgacaaacgaccccaaactcatgtaatttagcgaggacaacgtaagccggccctcgtagggtttcngtctcgtctctcgtgctcaagtctgacaagtccgctcctagactattctcgtcgtctcgagtctaggacgacggngtcgtagtacttatactcgtcttcactacgtagtgtcggactagtacgacgttacgttgggtgtcggtacgaaggtacgggaacgtaaagtcggtcccgtcggtcggacgaccgaccgacgctcccggtccccgtcgg

SEQ ID NO: 230923 - DNA, 676 bp, Homo sapiens
  misc_feature: GYAE6OF01EQJGD.25.10.A10.1.454.CMB.1.raw
tcagactgtacagtcacgaccggtgctcgatttagcgtcgatctcaggggggggtcacaagaggcagcgctctcgggacgtctccaccatggcctgggctctgctgctcctcactctcctcactcaggacacagggtcctgggcccagtctgccctgactcagcctgcctcgtgtctgggtctctggacagtcatcacatctcctgcactggaatccaccatgatgttgctatttcatgaccttgtcctctgtaaccaacaaccacccgacaaacgcccccaaactcacttgtaatttagtgacgggcctaacgtaacgcccggtacccttcggtaaggggttttcctgtacctcgtccgtttctcgtcggctaccgtaacgtcgtcgtacaacttaccggtccttaccctaggaacctaacgttcttaccgttggtcctaccgacggtactagggacgggtaaccgagggtcttaggttatttaacgttacgttcggtactttacctactacgtaacgttcggtaccgggtacttaaggttacgtcgtacggtttcggggttcggttaccggcgtaaacgggacgggtaaaccgtaaacggtacggttacccggtaccgttaggggtacctaaccggacccgaaacgggtccctccccggtccccggttacccgg

SEQ ID NO: 230924 - DNA, 546 bp, Homo sapiens
  misc_feature: GYAE6OF01DHFBN.25.10.A10.1.454.CMB.1.raw
  modified_base (209)..(209): a, c, t, g, unknown or other
  misc_feature (209)..(209): n is a, c, g, or t
  modified_base (233)..(233): a, c, t, g, unknown or other
  misc_feature (233)..(233): n is a, c, g, or t
  modified_base (294)..(294): a, c, t, g, unknown or other
  misc_feature (294)..(294): n is a, c, g, or t
tcagactgtacagtcacgaccggtgctcgatttagcgtcgatctcgaggggggggtcacaagaggcagcgctctcgggacgtctccaccatggcctgggctctgctgctcctcactctcctcactcaggacacagggtcctgggcccagtctgccctgactcagcctgcctcgtgtctgggtctctggacagtcgatcacctatttccngcactggactcagcactgatgttnctagttattactttgtctctgtaccaacaacaccaggcaaagcccccaaattatcatttangacggccactaagcgccctcaggtcttacaatcgtcttctctggctcaagtctggcagcacggcctcctgacatctctgggctccgaggctggaggacgaggctgattatctgtctactctatatggacatatacaactaaacgttccccgtacgttccggaaccgtcgggaacctacggggtacctacccggttccggttacgggtaccacggaccccgaacgggtaccccaaccccgctcgtcctacccg

SEQ ID NO: 230925 - DNA, 591 bp, Homo sapiens
  misc_feature: GYAE6OF01D1YQ0.25.10.A10.1.454.CMB.1.raw
  modified_base (294)..(294): a, c, t, g, unknown or other
  misc_feature (294)..(294): n is a, c, g, or t
tcagactgtacagtcacgaccggtgctcgatttagcgtcgatctcaggggggggtcacaagaggcagcgctctcgggacgtctccaccatggcctgggctctgctgctcctcattctcctcactcaggacacagggtcctgggcccagtctgccctgactcagcctgcctccgtgtctgggtctcctggacagtcgatcaccatctcctgcactgaactcaccactgatgttgctactttgaccttgtctcttgtaccaacaacaccgacaaagctaccaactcatattttganacagtaagcggcctcgtgggttctagtcgtattcactggctactaagtctggacaacgaccggccctaccctaaacaactactcgtcggcctccaggctagaagacggagtcttagtttacttctgtcttgttgtcttagtgtagtactagtaaactagtttggtgtaccgtcgggacgggtacgggaccctaagttacgtaccgttacgttaagtccgacgacccgaaacggtccgtacccgtcccccgttacggtccctaccgttcccttaccgttcccccgtccccttaccccg

SEQ ID NO: 230926 - DNA, 595 bp, Homo sapiens
  misc_feature: GYAE6OF01ECIUN.25.10.A10.1.454.CMB.1.raw
  modified_base (135)..(135): a, c, t, g, unknown or other
  misc_feature (135)..(135): n is a, c, g, or t
  modified_base (348)..(348): a, c, t, g, unknown or other
  misc_feature (348)..(348): n is a, c, g, or t
  modified_base (361)..(361): a, c, t, g, unknown or other
  misc_feature (361)..(361): n is a, c, g, or t
  modified_base (364)..(364): a, c, t, g, unknown or other
  misc_feature (364)..(364): n is a, c, g, or t
tcagactgtacagtcacgaccggtgctcgatttagcgtcgatctcgagggggggggtcacaagaggcagcgctctcgggacgtctccaccatggcctgggctctgctgctcctcactctcctcactcaggacacngggtcctgggcccagtctgccctgactcagcctgcctcgtgtctggtctcctgacagtcgatcaccatcctcctgcactggaactccaccactgatgttgctatttcatgtaccttgtctcctggtaccaacaacaccccgacaaaccgccccaaactcatagtatttagtaggaggcaactaagcggcctcgtagggttactaatcgcttcnctgctacagtcgngcncgcgaccgcctccgtagactactctcgtcggccttccgaggtcgtaggaggacggacggtctagtactttacgttactcgtacttactactaatagtcgaactactacgtaccaactaccgttcccgtacgttaccggaccgtaccgggacccggtacggtacccaccggttcccgtggggtacccaaccggacccgaacccggaccccaaaccccgtcgtcgttaccccg

SEQ ID NO: 230927 - DNA, 656 bp, Homo sapiens
  misc_feature: GYAE6OF01EOLIS.25.10.A10.1.454.CMB.1.raw
  modified_base (136)..(136): a, c, t, g, unknown or other
  misc_feature (136)..(136): n is a, c, g, or t
  modified_base (249)..(249): a, c, t, g, unknown or other
  misc_feature (249)..(249): n is a, c, g, or t
  modified_base (370)..(370): a, c, t, g, unknown or other
  misc_feature (370)..(370): n is a, c, g, or t
  modified_base (404)..(404): a, c, t, g, unknown or other
  misc_feature (404)..(404): n is a, c, g, or t
  modified_base (648)..(648): a, c, t, g, unknown or other
  misc_feature (648)..(648): n is a, c, g, or t
tcagactgtacagtcacgaccggtgctcgatttagcgtcgatctcgagggggggtcacaagaggcagcgctcgtcgggacgtctccacatggcctgggctctgctgctcctcactctcctcactcgacggacacgngggtcctggccctagtctgccctgactcagcctgcctcgtgtcgtggtctcgtggactgtcactccactactccttccgtgctacgtcgaactccgacctatgtattggttanctatttcatcgtaccttcgtacctcgtacgtaaccaaccaaccaacccgtaacaacccgacccctaaatcgacttagtaattacgaggacgacaacgtacgccgtcttaggtacgggttcnctcctcgtcttcgctcggactcgagtcgtcgacncgaccgcgtccctacgcgtaactcgttccgacgggtccgtacgaccgtagggctaagggaaccgtagggtcgtacttaagttacttactacgttcaccgtatacgaatacggaccaaactccgaacttaaccgaactttacccggtcctacccggttacggaccgtaccgggacggttacggcccctttcgggaccggttacaacccgtaccggtaaaccccggaacccttccccgtaaccgtnttacccgg

SEQ ID NO: 230928 - DNA, 661 bp, Homo sapiens
  misc_feature: GYAE6OF01CGQ65.25.10.A10.1.454.CMB.1.raw
  modified_base (300)..(300): a, c, t, g, unknown or other
  misc_feature (300)..(300): n is a, c, g, or t
tcagactgtacagtcacgaccggtgctcgatttagcgtcgatctcagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaatccaccactgatgtgacattcatgaccttgtctcgtgaccacaaccaccccgacaaacgcccccaaactcatgtatttagngtagggacacgtaacgcggtccccgtgtacgggtttcctgtaccgtccgtcttcgtctcgggtcctacgtacgtctcggactaacgtcccggtacctcccgtagacctaatcctcgtcggtacctcccgtaggtcgtacggacggaccggtacggtaccgtgttaacttaagttacttcggtacctttccgtactaaccgtacgttacggtcggtacgtacgtacggtacgtccggtttacgggtcggttacgggacggtaacggaacggggtaaccgtaaccgggtacgggttacccgtccgggttacgggtacccgaacgtccccggaaagggtccccgtccgtccccccgttacccgg

SEQ ID NO: 230929 - DNA, 582 bp, Homo sapiens
  misc_feature: GYAE6OF01ASFUP.25.10.A10.1.454.CMB.1.raw
  modified_base (204)..(204): a, c, t, g, unknown or other
  misc_feature (204)..(204): n is a, c, g, or t
  modified_base (215)..(215): a, c, t, g, unknown or other
  misc_feature (215)..(215): n is a, c, g, or t
  modified_base (236)..(236): a, c, t, g, unknown or other
  misc_feature (236)..(236): n is a, c, g, or t
  modified_base (240)..(240): a, c, t, g, unknown or other
  misc_feature (240)..(240): n is a, c, g, or t
  modified_base (244)..(244): a, c, t, g, unknown or other
  misc_feature (244)..(244): n is a, c, g, or t
  modified_base (316)..(316): a, c, t, g, unknown or other
  misc_feature (316)..(316): n is a, c, g, or t
  modified_base (360)..(360): a, c, t, g, unknown or other
  misc_feature (360)..(360): n is a, c, g, or t
  modified_base (486)..(486): a, c, t, g, unknown or other
  misc_feature (486)..(486): n is a, c, g, or t
  modified_base (556)..(556): a, c, t, g, unknown or other
  misc_feature (556)..(556): n is a, c, g, or t
  modified_base (570)..(570): a, c, t, g, unknown or other
  misc_feature (570)..(570): n is a, c, g, or t
tcagactgtacagtcacgaccggtgctcgatttagcgtcgatctcgaggggggggtcacaagaggcagcgctctcgggacgtctccaccatggcctgggctctgctgcctcctcacctctcctcacgtccaggacacgtagggtcctgggcccagtctcgccctagacctcacgcctgccctcgtgtcgtgggtctcgtggacngtcgatcaccnctctctagcagtgactcaccntgtntgtnctatttcatcgtacttgtccttcgtacgtaccaacctaaccgacccaactaaaccgacccctaactcacgtntagttagcgaggacctactaacggcgtaccgtacggtgggttcncggtcctccgtacttcgtccgtcggtcctacgtacgtcgtcgactacgtccgcctcgacgactactctcgttcgtcacgcgcgtagtacggagcggtacttgtacttacgtactcgtcttctacgntagtcgactagtacgtacgcgttacgtggtcgtgacgtggaacgcggaagtcgtaccggtccgagtaccncggactcggacccnccgtcccgtacg

SEQ ID NO: 230930 - DNA, 716 bp, Homo sapiens
  misc_feature: GYAE6OF01CQ5CO.25.10.A10.1.454.CMB.1.raw
  modified_base (233)..(233): a, c, t, g, unknown or other
  misc_feature (233)..(233): n is a, c, g, or t
  modified_base (288)..(288): a, c, t, g, unknown or other
  misc_feature (288)..(288): n is a, c, g, or t
  modified_base (621)..(621): a, c, t, g, unknown or other
  misc_feature (621)..(621): n is a, c, g, or t
tcagactgtacagtcacgaccggtgctcgatttagcgtcgatctcgagggggggggtcacaaggaggcagcgctctcgggacgtctccaccatggcctgggctctgctgctcctcactctcctcactcgaggacacgacgggtcctgggcccaggtctcgcccgtgactcacgccttcgcccttccgtgtcctgggtctccgtggacctagtccatccaacgctcctccgtcncacgtggaacttccaacctagtgagttgttcgcttaattctattacgtaccgttnttccgtacttaccggaaccaaaccaaaccaacccccgaacaaaccgtacccccaaatccgtaattacggtatttagacggaacggtcctaacggtaacgtcccggccgttacggtacggggtttcctcggtccttcggtccttcgtaacgtcggtacctaacgtcgtcgtaggtacacgtaccggtcctacctagtacactcgtacgtcgtccacgacgcgtacggacggagtaccgtgtaacttacgtactttacggtctaaccgttctaccgaattccggtgtaaccgggtcttaaagtcggtccggttaggttaccgggtggttacccgngggtaaacgtacggggaacctttaaagggccccggttacggaccggttcaacggaccggaaccggtaccgtaccggtccccgttcccgggtaccg

SEQ ID NO: 230931 - DNA, 679 bp, Homo sapiens
  misc_feature: GYAE6OF01BRJHT.25.10.A10.1.454.CMB.1.raw
  modified_base (484)..(484): a, c, t, g, unknown or other
  misc_feature (484)..(484): n is a, c, g, or t
tcagactgtacagtcacgaccggtgctcgatttagcgtcgatctcaggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggactgtcgatcacctatcctctgctacgtgaactcaccactgtatgttgctattcagttcgtacctttgtcctaccgttcggtaaccaaacctaaacccgaacccccgaaaccaaaaccccgaacccccctaaaactaccaacgttacgttaatttacgtacggacgggtaccaacgtaccggcccggtcccgttacggttacgggtttctcgtctccgtcttctcgtcgtcctacgagttcgtacgtactaacgtcccgtcccgtcctagtaactactctcgtcgtcctacggngtcgagggagtacggagtcttagtacttactcgtcttacttcctaagtcgtacgttcggccgtagttacgtcgtacgttcggttcggggttacgtacgacggtaacgggaacggtaaccgtagggtaccggtcccggtacgggtaccggaccgtaccggaccggtaaccgtccggtccccgttcccggtacccgg

SEQ ID NO: 230932 - DNA, 719 bp, Homo sapiens
  misc_feature: GYAE6OF01BOHHR.25.10.A10.1.454.CMB.1.raw
  modified_base (507)..(507): a, c, t, g, unknown or other
  misc_feature (507)..(507): n is a, c, g, or t
tcagactgtacagtcacgaccggtgctcgatttagcgtcgatctcagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcacctatctcctgcactaggaactccaccactgtatgttgctatttcattcgttacctttcgtttccgtacggtaacccaaccaacccgtaaccccgaaaccaaaccgacccccaaactctagtgttaacttatcgggacggacctaacgtaacgccggtacccgtacggttacgggtttctcgtccgtcgtcttccgtacgtcgaccttacgtacgtcgtacgactacgtaccgtccctcgtacgtactacgtccgttacgtccgtcctaccggtcggtacggtaacgggaacgggtacgacggttntaacggtttaatttaccgttacgtcttaccgtttcctaactacggtcgttcggtaccgggtacttaagggtaccggttaacgtcgggttttggggtacggttcggaacggttaggggaaacccggtaacgtacggttccggaacccggttcggttaaccggacccggtaccggccggtaaccggtccttacccccggcccggttcggtaccc

SEQ ID NO: 230933 - DNA, 764 bp, Homo sapiens
  misc_feature: GYAE6OF01BLAUQ.25.10.A10.1.454.CMB.1.raw
  modified_base (227)..(227): a, c, t, g, unknown or other
  misc_feature (227)..(227): n is a, c, g, or t
tcagactgtacagtcacgaccggtgctcgatttagcgtcgatctcgaggggggggtcacaagaggcagcgctcgtcgggacgtctccaccatggcctgggctctgctgctcctcactctcctcactcgaggacacgagggtccgtcgggcccagtctggccgtgacctcacgtcctcgccgtcgtgtcgtgggttcctccgtggactagtcgatccactactttccngcacgtcggactcgagcctacgtgtacgttggttcgacgttagtttactttactttcgtccttaccgtacggtaaccaaccgaacccgtaaccgaacggacccaaaccccgtaaccccctaaatttacctacttacttacggtacggaccgaccgtaacgtaccggccgtacctaggtaacgggttacttacgttacgtccgtcttaccgtgtccgtacctacgtacgttcgacggaccacgtaccgaccgtacctaccgtacaacgtacgtcggtacgccggtccgtacggacggtcctagggaacggtaccgagggttaccttacggtttaacttaccgtttactaccgttaccgtttaacgtacttaacgtacgtaacgtacctaacctaactaaccgtaaaccctaaccggttccccggtaaccgtaccggggtacctcgggaaccgttccgggtacccttacccgggtagggtcccgaaaccgacccggaaccggtacccctaacccgtaacctcttaccggtcttaccccg

SEQ ID NO: 230934 - DNA, 638 bp, Homo sapiens
  misc_feature: GYAE6OF02GGQU9.25.10.A10.1.454.CMB.1.raw
  modified_base (154)..(154): a, c, t, g, unknown or other
  misc_feature (154)..(154): n is a, c, g, or t
  modified_base (157)..(158): a, c, t, g, unknown or other
  misc_feature (157)..(158): n is a, c, g, or t
  modified_base (165)..(166): a, c, t, g, unknown or other
  misc_feature (165)..(166): n is a, c, g, or t
  modified_base (170)..(170): a, c, t, g, unknown or other
  misc_feature (170)..(170): n is a, c, g, or t
  modified_base (174)..(174): a, c, t, g, unknown or other
  misc_feature (174)..(174): n is a, c, g, or t
  modified_base (176)..(176): a, c, t, g, unknown or other
  misc_feature (176)..(176): n is a, c, g, or t
  modified_base (178)..(178): a, c, t, g, unknown or other
  misc_feature (178)..(178): n is a, c, g, or t
  modified_base (183)..(183): a, c, t, g, unknown or other
  misc_feature (183)..(183): n is a, c, g, or t
  modified_base (186)..(186): a, c, t, g, unknown or other
  misc_feature (186)..(186): n is a, c, g, or t
  modified_base (198)..(198): a, c, t, g, unknown or other
  misc_feature (198)..(198): n is a, c, g, or t
  modified_base (200)..(200): a, c, t, g, unknown or other
  misc_feature (200)..(200): n is a, c, g, or t
  modified_base (213)..(213): a, c, t, g, unknown or other
  misc_feature (213)..(213): n is a, c, g, or t
  modified_base (216)..(216): a, c, t, g, unknown or other
  misc_feature (216)..(216): n is a, c, g, or t
  modified_base (222)..(222): a, c, t, g, unknown or other
  misc_feature (222)..(222): n is a, c, g, or t
  modified_base (225)..(225): a, c, t, g, unknown or other
  misc_feature (225)..(225): n is a, c, g, or t
  modified_base (231)..(231): a, c, t, g, unknown or other
  misc_feature (231)..(231): n is a, c, g, or t
  modified_base (635)..(635): a, c, t, g, unknown or other
  misc_feature (635)..(635): n is a, c, g, or t
  modified_base (637)..(637): a, c, t, g, unknown or other
  misc_feature (637)..(637): n is a, c, g, or t
tcagactgtacagtcacgaccggtgctcgatttagcgtcgatctcagggggtcccggagatcatcgagggtgtccctgggcctgcctggtctaaggacttacttccacttagtacagtctggacgccgggctcggccaagggcggcagtagggngcnnatacagnngacnaatnangngactntgngaggcatcgcancncagagacacacanacncactgngcngcacanagacgctgagaggacgacgacgacgcgtgtgtacttctgtcgcgacgacgccccgtacgtacggacggtacgtacgaggtacgggtacgtacgtacgtacgttacgtacgtacggtcggggaccggaaccgggtaacccggtacggtaccgtacccgtaccgtcccgtaccgaccgtacccgtacccgaacccgaaccggacccgtaccgtcccggttccccgttcccccgtaccggtacccgtacccctacccgtacccgaacgacgaccgtaccgtaccggtcgggaccgacgacggccggccgtccggtcgtcgtccgtcggtacgtaacgtaccgtaccgtaccgtacgtacgtacgtacgtacgtcggacggcggtcgtacgacgacggcgacgagagngnc

SEQ ID NO: 230935 - DNA, 138 bp, Homo sapiens
  misc_feature: GYAE6OF02IJD06.25.10.A10.1.454.CMB.1.raw
  modified_base (137)..(138): a, c, t, g, unknown or other
  misc_feature (137)..(138): n is a, c, g, or t
tcagactgtacagtcacgaccggtgctcgatttagcgtcgatctcaggggtccgggagatcatgagggtgtccctgggctgcctggtcaaggactacttccactgtacagtctgagcgggctggcaaggcgcatagnn

SEQ ID NO: 230936 - DNA, 499 bp, Homo sapiens
  misc_feature: GYAE6OF02IBLF2.25.10.A10.1.454.CMB.1.raw
  modified_base (442)..(442): a, c, t, g, unknown or other
  misc_feature (442)..(442): n is a, c, g, or t
tcagactgtacagtcacgaccggtgctcgatttagcgtcgatctcaggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaatcaccactgatgttgcatttcatgaccttgtctctggtaccaacaacaccccgacaaacgccccaaactcatgatttatgaggcactaagcggccctcaggggtttctgctcgcttctctggctccaagtctggcaatacggcctcctgacaatctctgtctccaggctgaggacgaggctgattattactgcttctcacattgtcggcagtagctacgttgggtnttcggcagagggaccaaagtgacccgtcgtgggtcacggcccaaggctcgccctcgg

SEQ ID NO: 230937 - DNA, 137 bp, Homo sapiens; identical to SEQ ID NO: 230912
  misc_feature: GYAE6OF02HTVX4.25.10.A10.1.454.CMB.1.raw
  modified_base (136)..(137): a, c, t, g, unknown or other
  misc_feature (136)..(137): n is a, c, g, or t

SEQ ID NO: 230938 - DNA, 610 bp, Homo sapiens
  misc_feature: GYAE6OF02HQHWI.25.10.A10.1.454.CMB.1.raw
  modified_base (272)..(272): a, c, t, g, unknown or other
  misc_feature (272)..(272): n is a, c, g, or t
  modified_base (317)..(317): a, c, t, g, unknown or other
  misc_feature (317)..(317): n is a, c, g, or t
  modified_base (327)..(327): a, c, t, g, unknown or other
  misc_feature (327)..(327): n is a, c, g, or t
tcagactgtacagtcacgaccggtgctcgatttagcgtcgatctcaggggggtcacaagaggcagcgctctcgggacgtctccaccatggcctgggctctgctgctcctcactctcctcactcagaacacagggtcctgggcccagtctgccctgactcagcctgcctccgtgtctgggtctcctggacagtcgatcaccatctcctgcactggaatcaccactgatgttgcatttcatgaccttgtctcctggtaccaacaacaccccganaaaacgcccccaaactcatgatttatgaggcactaagcggacctnaggggtttcngtctcgtcttctctcgtctactaagtctacggactaaacgtaccggcctcctagaactaacttcctcgtcggttcctccgaggtctacggacggacggaggtcttagttactttacttacgtgtctttactactaacgtagttcggtaccgacgtaagttacgtcgttacggtttggggttcgttaccggacgaacgggtacgggtaaacctaaaggtcggtaccccggttaccgtggggtaccaccggacccgtaacggtccgtcccggtcccccgttcggg

SEQ ID NO: 230939 - DNA, 138 bp, Homo sapiens
  misc_feature: GYAE6OF02GHCYW.25.10.A10.1.454.CMB.1.raw
  modified_base (137)..(138): a, c, t, g, unknown or other
  misc_feature (137)..(138): n is a, c, g, or t
tcagactgtacagtcacgaccggtgctcgatttagcgtcgatctcaggggtccgggagatcatgagggtgtccctgggatgcctggtcaaggactacttccactgtacagtctgagcgggctggcaaggcgcatagnn

SEQ ID NO: 230940 - DNA, 542 bp, Homo sapiens
  misc_feature: GYAE6OF02JNLFU.25.10.A10.1.454.CMB.1.raw
  modified_base (234)..(234): a, c, t, g, unknown or other
  misc_feature (234)..(234): n is a, c, g, or t
  modified_base (298)..(298): a, c, t, g, unknown or other
  misc_feature (298)..(298): n is a, c, g, or t
  modified_base (346)..(346): a, c, t, g, unknown or other
  misc_feature (346)..(346): n is a, c, g, or t
  modified_base (363)..(363): a, c, t, g, unknown or other
  misc_feature (363)..(363): n is a, c, g, or t
tcagactgtacagtcacgaccggtgctcgatttagcgtcgatctcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaactcaccactgatgttnctatttcatgaccttgtctctggtaccaacaacaccccgacaacgccccaaatcatgtacttangaggcactaagcgcctcgtagggttctgctcgcttctctgctcagtcngacactcgcctccgtanactaatctctcgtctcgagtctgacggacgaggtcttgtaacttattacgtgtaccttctacacgtagtacgtggacctagtactcgtacgttcgggtcgttcggcgtaacggacggtaaccaaggttcgacccgtcggtacggtacgaccgtacccgaggtccgttccgccccgtcgg

SEQ ID NO: 230941 - DNA, 643 bp, Homo sapiens
  misc_feature: GYAE6OF02I1S4B.25.10.A10.1.454.CMB.1.raw
  modified_base (240)..(240): a, c, t, g, unknown or other
  misc_feature (240)..(240): n is a, c, g, or t
  modified_base (513)..(513): a, c, t, g, unknown or other
  misc_feature (513)..(513): n is a, c, g, or t
tcagactgtacagtcacgaccggtgctcgatttagcgtcgatctcagggggggggtcacaagaggcagcgctctcgggacgtctccaccatggcctgggctctgctgctcctcactctcctcactcaggacacagggtcctgggcccagtctcgccctgactcagcctgcctccgtgtcgtgggtctcctggacagtcgatcaccatctcctgcactggaactcaccactgatgttgctnaattttcgaacttgaccttcgtcgccctaggtaaccaaccgaacaaccccggcccaaaagtcccccaaaacttcaattcgatttaagtcgaacgggtacacgtaacgtcgggacccgttcgtaggggtttcctcggcttccgtctttcgtccttcggactccaaggtctaggtaccgtaacgtacccgtcctaccctagtacctaactccgtctcgggcgtccgaggcgtacggaggacgtaggtcttagtactttactggtctaccgttacncgtaactagtacgtaaccaacttacttccgaaactaaccgtaccttccggtaccgtaggtaccgacggtaccgtaccggtcccgtacggtccgtacggcccaaccggaccgtaccccgtaccctacgtcg

SEQ ID NO: 230942 - DNA, 803 bp, Homo sapiens
  misc_feature: GYAE6OF02JBDSR.25.10.A10.1.454.CMB.1.raw
  modified_base (214)..(214): a, c, t, g, unknown or other
  misc_feature (214)..(214): n is a, c, g, or t
  modified_base (306)..(306): a, c, t, g, unknown or other
  misc_feature (306)..(306): n is a, c, g, or t
tcagactgtacagtcacgaccggtgctcgatttagcgtcgatctcgagggggggggtcacaagaggcagcgctctcgggacgtctccaccatggcctgggctctgctgctcctcactctcctcactcaggacacgagggtcctgggcccagtctgccgtgactcagcctgcctccgtgtctgggtctccgtggacagtcgatcacctatttccngacacgtggactcagccactgattgttgctaggtttattactttgtctcctggttaaccaacaacaccaggacaaacgaccccctaaattanactatttatgaacggccaacgtaacgccggtaccctacgaggtacgttttactaagtccgtaccttcgtcgtcggaccttaccgaacggttctacggactacggaccgtacccgggtacccttcccgtagaacctaacgttccgtccggtacgggtccctaccggtaacgggtccgttagggaacggggtaaccggaggttacccgttagggtaaacgtttttaaccttaccgttaaccggttaccttttaaaccgtaccgtaaagttaacggttaaccgggtaacctaaaccttaaccggttaacctaaaaccccgttaaaaccgtttcccccggtttaccgtttacccggggtaacccggttccggggtaaacccggtaacccggggttaccctacccggggtttacccggtaccgggttacccaacccgggttacccggaaaccccggttccccgtaaaaccccccgacggtttcccggtaacccttaccccgg

SEQ ID NO: 230943 - DNA, 548 bp, Homo sapiens
  misc_feature: GYAE6OF02I5U81.25.10.A10.1.454.CMB.1.raw
  modified_base (431)..(431): a, c, t, g, unknown or other
  misc_feature (431)..(431): n is a, c, g, or t
  modified_base (462)..(462): a, c, t, g, unknown or other
  misc_feature (462)..(462): n is a, c, g, or t
  modified_base (523)..(523): a, c, t, g, unknown or other
  misc_feature (523)..(523): n is a, c, g, or t
tcagactgtacagtcacgaccggtgctcgatttagcgtcgatctcagggggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcacctatttcctgcactggaaccagcactgatgttgctactttgaccttgtctcttgtaccaacaaccacccggaacaaacggctaccaaactacaattaattttgacgacagtaacgcgcctcgtcgggtttctagtcgtattcacgtcggctaccaagtctggacaacgacgccctacctaaacactctcgtcggctaccgaggctagaagacgagtcttgtttatttcntctgttgcttatgtgctaagaaactagttgngtcgtgggcgtacggtacaagttcgacgtcgttagcacgccacggctccgccccgtgtccnctctccgttcccaccctctcactcg

SEQ ID NO: 230944 - DNA, 596 bp, Homo sapiens
  misc_feature: GYAE6OF02IC4TX.25.10.A10.1.454.CMB.1.raw
  modified_base (382)..(382): a, c, t, g, unknown or other
  misc_feature (382)..(382): n is a, c, g, or t
  modified_base (395)..(395): a, c, t, g, unknown or other
  misc_feature (395)..(395): n is a, c, g, or t
tcagactgtacagtcacgaccggtgctcgatttagcgtcgatctcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatcctcctgcactggaatccaccactgatgttgcatttcatgaccttgtctctggtaccaacacaccccgacaaacgcccccaaactcatgatttatgagggcacgtaagccgccctgaggggtttctgctcgcttctctggctcagtctggcaatcgcctcctgacatctctgtctcgngtctggaggacgnggctgtatttacttacgtgtccttctactactacgttcggtaccggtcgtaggtacgtaccgttacggtttcggggtcggtttccgggcgtaacgggaacggggtaaccctaaaggttccgggtaacccgttcccggttaggggtccgaaccggtccccggtaaagggtccccgtttacccgggcccccccgttacccggg

SEQ ID NO: 230945 - DNA, 508 bp, Homo sapiens
  misc_feature: GYAE6OF02IV4RI.25.10.A10.1.454.CMB.1.raw
tcagactgtacagtcacgaccggtgctcgatttagcgtcgatctcagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaatcaccactgatgttgcatttcatgaccttgtctcctggtaccaacaacaccccgacaaacgcccccaaactcatgatttatgaggcactaagcggccctcaggggtttctgctcgcttctctggctcagtctgcatcgctcctgacaatctctgtctcagctgaggacgaggctagatttatactgtcttctacacattgtcgctagtacgctacgttggggtgttcggcgtaaggacggaaccaagtcggaccgttcgtgggtcacggcccaaggcctcgcccctcgg

SEQ ID NO: 230946 - DNA, 630 bp, Homo sapiens
  misc_feature: GYAE6OF02F872S.25.10.A10.1.454.CMB.1.raw
  modified_base (299)..(299): a, c, t, g, unknown or other
  misc_feature (299)..(299): n is a, c, g, or t
tcagactgtacagtcacgaccggtgctcgatttagcgtcgatctcagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaatcaccactgatgttgctatttcatgaccttgtctcctgtaccaacaaccacccgacaaacgcccccaaactcatgattanagaggcactaagcgcctgtacgggttctgctcgtcttctcgtggtcctctagtctcgactaacgtccggccctcctgaacctatcctcgtcggtcctcgacggccttaggacgggacgaggcgttagtacttttacgttacctcggtctttcctacctacgtacgttacggttccggtacgtacgttacgaccgttacggtttggggttaccggttcggaccggtaagggtaaccgggtaaccgaaaggttccggtaaccccggttccgttaggggtacccaccggtacccggtaacgggtcccgttacccggtaccccccggttaccggg

SEQ ID NO: 230947 - DNA, 592 bp, Homo sapiens
  misc_feature: GYAE6OF02IF5FW.25.10.A10.1.454.CMB.1.raw
  modified_base (280)..(280): a, c, t, g, unknown or other
  misc_feature (280)..(280): n is a, c, g, or t
  modified_base (306)..(306): a, c, t, g, unknown or other
  misc_feature (306)..(306): n is a, c, g, or t
  modified_base (338)..(338): a, c, t, g, unknown or other
  misc_feature (338)..(338): n is a, c, g, or t
  modified_base (588)..(588): a, c, t, g, unknown or other
  misc_feature (588)..(588): n is a, c, g, or t
tcagactgtacagtcacgaccggtgctcgatttagcgtcgatctcgagggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcacatctctgcactggactcaccactgattgtgctattcatcgtaccttgtctcctcgtaaccaacaaccaaccccganaaacccgaccccaaatcatgtattancgagcagtaacgcgtcctacgtacgggtttcncgcgtctcgttctcgtggcctacgtaagtcgtcggactacgccgaccggtccttccgtagaactactctcgtcggcctacgacggtctacgggacggacggtacgcgttaagtactttaacttgtctacgttacactagtacgtacgactaactacgtaacctaaacgtaaccgtccgttacgtaccggacgtacggaccgtacgggcctaccggtcgtacggacaccgaccgtaaccgaccctaccgtntacg

SEQ ID NO: 230948 - DNA, 687 bp, Homo sapiens
  misc_feature: GYAE6OF02G84SZ.25.10.A10.1.454.CMB.1.raw
  modified_base (194)..(194): a, c, t, g, unknown or other
  misc_feature (194)..(194): n is a, c, g, or t
  modified_base (221)..(221): a, c, t, g, unknown or other
  misc_feature (221)..(221): n is a, c, g, or t
  modified_base (357)..(357): a, c, t, g, unknown or other
  misc_feature (357)..(357): n is a, c, g, or t
  modified_base (369)..(369): a, c, t, g, unknown or other
  misc_feature (369)..(369): n is a, c, g, or t
tcagactgtacagtcacgaccggtgctcgatttagcgtcgatctcaggggggggggtcacaagaggcagcgctctcgggacgtctccaccatggcctgggctctgctgctcctcactctcctcactcaggacacagggtcctgggcccagtctgtgctgactcagccaccctcagtgtcgtcgggacccccggnaggaggtctccatctcttgtctgggancagtcctccgacgtacggaaattagtttgtactacgtcggtacctagcacgcctaccgaacgaaacccggcccccaagcctacctcacttctagtaaggaatagtactcgacgtccggccctaggaggactaccgngaccattctcgnggtctacgtagtcgtcgtctccgtcggcctacccgtgccctatccgtagggtccggtccgtccgggtaccggaggtcgtacggtacggacgtagtaaacttacgttacgtggttcgtacggttagggttcggaatccgggacctagttcggacggtacgggttcgggtacccggtacgggttcggttaccggggacggtaaacggtaccgtaagggttcccgtacggtacccggttacggtaccgtacccgtaccggtacccgtaacggtcccgtccccggtaccccgtccggtaaccttcccgttcccgttccccgg

SEQ ID NO: 230949 - DNA, 663 bp, Homo sapiens
  misc_feature: GYAE6OF02GKJ7C.25.10.A10.1.454.CMB.1.raw
  modified_base (318)..(318): a, c, t, g, unknown or other
  misc_feature (318)..(318): n is a, c, g, or t
  modified_base (452)..(452): a, c, t, g, unknown or other
  misc_feature (452)..(452): n is a, c, g, or t
tcagactgtacagtcacgaccggtgctcgatttagcgtcgatctcagggggggggtcacaagaggcagcgctctcgggacgtctccaccatggcctgggctctgctgctcctcactctcctcactcaggacacgagggtcctgggcccagtctgccctgactcagcctgcctccgtgtcgtgggtctccgtggacagtcgatcaccatctccgtgcacgtgaatccaccactgattgtgctatttcatcgtaccttgtctccgtaggtaccaacaaccacccccgaacaaaccacccccgaaactcatacgtatttanggacggactaacgtaacgccggtcccgtaggttacggggtttctcgtcctcgtcttctcgtcgcctacgtacgtctgacaacgtcgtcctccgtagactactctgtcgtctcgagtcgtaggacggtacgacgngttagtactttacgtagttcttcttactacgtactagtacgtcggactacggtacgtaccggttacggttcggggttcgttaccggaggtacggtaacggggtaaccgttaaacgggttccggtaaccccggtttaccgggtacggtaccggtacccgggtaaccccgggttaaccggcccgggtttaccccggacccccggtttacccgg

SEQ ID NO: 230950 - DNA, 676 bp, Homo sapiens
  misc_feature: GYAE6OF02FN0KM.25.10.A10.1.454.CMB.1.raw
  modified_base (252)..(252): a, c, t, g, unknown or other
  misc_feature (252)..(252): n is a, c, g, or t
  modified_base (533)..(533): a, c, t, g, unknown or other
  misc_feature (533)..(533): n is a, c, g, or t
tcagactgtacagtcacgaccggtgctcgatttagcgtcgatctctagggggggggttcgacaagtagggcagcgctctcgggacgtcgtccaccatggcctgggctctggctgactcctcgactctccgttcactcaggactacgagggtacctgggcccagttcctagccctcgaactccagccttgcctaccgtgtctgggtcctccgtggaccagtcgatccaccatcctactgcactgaactcaccntgatcgtagcctaatttcgatcgaccgttcgtctccgtggtaccaacgtaacacccccgtaacaaaccgcccccaaacgtcctacgtagtactttaatggacgggccaacgtaacgcggtcccgttacgtagggggtttctacggtccgtccgtcccgttacgtctaccggtcctaccgtaacgtcgttcggtacctaacgtacccggtccctacccgtacgactacttctaccgtcggtacctcgtcggctacggacggcgacggtctcgattacgttcngtcctactcgaactagtgtcggtatacgtagtacgtacgttggtcgttcgacgtacgggacgggtaaccgaacggttccggtaacccggttaccggtaggtacccgacggcccgtaacgggccgtcccggtccccgtacccgg

SEQ ID NO: 230951 - DNA, 660 bp, Homo sapiens
  misc_feature: GYAE6OF02G9WPJ.25.10.A10.1.454.CMB.1.raw
  modified_base (209)..(209): a, c, t, g, unknown or other
  misc_feature (209)..(209): n is a, c, g, or t
  modified_base (239)..(239): a, c, t, g, unknown or other
  misc_feature (239)..(239): n is a, c, g, or t
  modified_base (556)..(556): a, c, t, g, unknown or other
  misc_feature (556)..(556): n is a, c, g, or t
tcagactgtacagtcacgaccggtgctcgatttagcgtcgatctcgagggggggggtcacaagaggcagcgctctcgggacgtctccaccatggcctgggctctgctgctcctcactctcctcactcaggacacgagggtcctgggcccagtctgccctgactcagcctgcctccgtgtcgtgggtctccgtggacagtcgactcaccntctctgacacgtgaactccaccatgatgtnctattcatgtacttgtcctaccgtagtaaccaacaacccacccgaacaacccgaccccaaagtccattacgtaagttgacggacggacctaacggtaacggccggtccgttacgggttacgggttctcgtccgtacgttcttcgtcgtcgtactacgaacgtcgtacgtacgtaaccgtccggtcctaccgtagaacctacgttcgttaccgtcggttcctacccggtaggtacgtaacgggaacggacggtagttacttaggttaactttacgtacgtcgttctacgtactaagtcgtggtaccgtgtaagttacncggttgttcgggtgtacggacgaggtaaccggtaagtacggtaccgtcggttacccgtaggacccgtacgaccggtccggttacctccccggtaccgttaccgg

SEQ ID NO: 230952 - DNA, 679 bp, Homo sapiens
  misc_feature: GYAE6OF02JBD4K.25.10.A10.1.454.CMB.1.raw
tcagactgtacagtcacgaccggtgctcgatttagcgtcgatctcagggggggggtcacaagaggcagcgctctcgggacgtctccaccatggcctgggctctgctgctcctcactctcctcactcaggacacagggtcctgggcccagtctcgccctgactcagcctgcctccgtgtctgggtctcctggacagtcgatcaccatctcctgcactggaactcaccactgatgttgctatttcatcgacttgtctctggtaccaacaaccacccgtacaaacgccccaactcactagtattaactcgacgggacacgtaacgccggtccctacggtaggggtttacctgcctcgtaccttcttcgtcgtaccttcgaacgttcgtaggacgtaacgtaccggtcccctaccgtacgtactaacttccgtcgttcggtcctacgcgggtaccttcgggaaaggtaccgacgggtacttaggttaactttaacgttaccgtcgttaccttaccgtactaccgtagttacggtaccgaccgtaggttaccgtcgttaacggttggggttacgttccgggtacgtacggtaacgggtaaaccgtaacgtaccgggtaacccggttcggtacgggtccgaacggtaccccggtaaggtaccctcccgggttaccccctaccggg

SEQ ID NO: 230953 - DNA, 694 bp, Homo sapiens
  misc_feature: GYAE6OF02JESJC.25.10.A10.1.454.CMB.1.raw
  modified_base (212)..(212): a, c, t, g, unknown or other
  misc_feature (212)..(212): n is a, c, g, or t
  modified_base (237)..(237): a, c, t, g, unknown or other
  misc_feature (237)..(237): n is a, c, g, or t
  modified_base (293)..(293): a, c, t, g, unknown or other
  misc_feature (293)..(293): n is a, c, g, or t
  modified_base (300)..(300): a, c, t, g, unknown or other
  misc_feature (300)..(300): n is a, c, g, or t
tcagactgtacagtcacgaccggtgctcgatttagcgtcgatctcaggggggggtcacaagaggcagcgctctcgggacgtctccaccatggcctgggctctgctgctcctcactctcctcactcaggacacagggtcctgggcccagtctgccgtgactcagcctgcctccgtgtctgggtctccgtggacagtcgatccacctatttccngcacgtggactcagcactgatgttnctagttattacttgtctcctggtaccaacaccacccaggccaaacgccccaaattncatttangagccactaagccggcctcgaggtacgtttactaactcgtcttctacgtcggacctcaagtctggactacgcctaccggcccttccgtagactactccgtcgtcgggtcctcggacgggtctcgggaacggtacggtacggtccttaggttaacttttacgttacggtcgtacccttaaccgtctaagttacgtacgggaaacctactaacgtaccctaaacgttaaacccgttcccgttacccgtttaccgggaaccccggttacggggtaacccgtaccgggttaacccgtaccccggttaccggttccgggttaacccgaacccggttaaccccgaaccgggttaccccccaaacccccggttaggttaccccggtaccctttaaccccgg

SEQ ID NO: 230954 - DNA, 886 bp, Homo sapiens
  misc_feature: GYAE6OF02GBCHS.25.10.A10.1.454.CMB.1.raw
  modified_base (133)..(133): a, c, t, g, unknown or other
  misc_feature (133)..(133): n is a, c, g, or t
tcagactgtacagtcacgaccggtgctcgatttagcgtcgatctcgagggggggggtcacaagaggcagcgctctcgggacgtctccaccgatcggcctggggcctctgctgctccgtcactctcctcacctnacggacacagggtcctgggcccagtctgccctgactcgagcctgccttccgtgtcgtgggtctccgtggtacagtcgtactccgacctattcgtaccttgcctaacttgggaaactccgaaccgtagtagtacgttcgtttacgacttagttttaccgaattcggtaacccttttcggttccttacccgtttacgggtaaaacccctaaaccctaaaacccgttaaacccccccggaaaccttaaaaaccggaccccccccgtaaaaaactacccggtaaactttaccggtaaacgtttttaaccgttacgggaacggggtacccgtaaaccgtaacgggtaccccggggtacccccttaacggttaacggggggttttaccctacggttccgttccggtacctttaccggtcgttccgggtacccttaacccggtaaacggttcggtaccggtaaacgtaaccgttaacccgggtacccgttacccgtaacggtaaccctaacggttacccgtaccccggttacggttacccgtacccggtacggtacccggtgggtaaccgggaacgtacgggtaacccttagtaactttaacgttaccgtacgtaccttaccgtactactacggttacggtacgtacgtacgtacgtacgttaacgttcgggtagtccggacgtaacggtacggaaacctaaggttccgaccgttcggtacgtacgtaccggccgtacgccggtcgttacccccggtacg

SEQ ID NO: 230955 - DNA, 688 bp, Homo sapiens
  misc_feature: GYAE6OF02G5PDE.25.10.A10.1.454.CMB.1.raw
  modified_base (249)..(249): a, c, t, g, unknown or other
  misc_feature (249)..(249): n is a, c, g, or t
  modified_base (498)..(498): a, c, t, g, unknown or other
  misc_feature (498)..(498): n is a, c, g, or t
tcagactgtacagtcacgaccggtgctcgatttagcgtcgatctcgagggggggggtcacaagaggcagcgctctcgggacgtctccaccatggcctgggctctgctgctcctcactctcctcactcaggacacgagggtcctgggcccagtctcgccctgacctcacgcctcgccctcgtgtcgtggtctccgtggacagtcgatccaccgatcctctgcacgtgaactccacctatgtactgttacncttaattacgacgttacgtacctttcgttacctccgttacgtaacccaaaccaaccccgaaccccgaaacaaacccgaccccctaaactcgtaacgttacgtaactttaacggacggtaacggacctaacgttaacggcccggtaccgttacggttacgggtttcctcggtctccgttccttacgtcgtcgtctacgacgttcgtcgtaacctacgtaccgcctccgtacgactactcgttcgtcgtcncgagtcgtaggacggtacgacgtcgttagttacgttacgtactcgttcttacactacgtacgttcgacgtagtacgttactacggttgttcgggttcgtacggacgaacggaacgggtaactaacggtccgtaaccggttaccgttacgggacctaccgggccgtaccggtcctaccccggtaccgtccg

SEQ ID NO: 230956 - DNA, 733 bp, Homo sapiens
  misc_feature: GYAE6OF02FI6I6.25.10.A10.1.454.CMB.1.raw
  modified_base (170)..(170): a, c, t, g, unknown or other
  misc_feature (170)..(170): n is a, c, g, or t
  modified_base (211)..(211): a, c, t, g, unknown or other
  misc_feature (211)..(211): n is a, c, g, or t
  modified_base (222)..(222): a, c, t, g, unknown or other
  misc_feature (222)..(222): n is a, c, g, or t
  modified_base (516)..(516): a, c, t, g, unknown or other
  misc_feature (516)..(516): n is a, c, g, or t
  modified_base (525)..(525): a, c, t, g, unknown or other
  misc_feature (525)..(525): n is a, c, g, or t
tcagactgtacagtcacgaccggtgctcgatttagcgtcgatctcagggggggggtcacaagaggcagcgctctcgggacgtctccaccatggcctgggctctgctgctcctcactctcctcactcaggtacacagggtcctgggcccagtcctgccctgactcacgccngccctcgtgtcgtgggtctccgtggactagtcgatccaccntctccgtgacncgtggaacctccgcctagtgtattcggttcgtacttatttcactcgtacccgttcttcgtccgttacgtaaccccaaccgaacccacccccggaactaaacccaccccctaaacgtcaacgttcgttaacgttacacggtaacgggccttaaacgtaaccggtccgtcccgtacggttacggggttctcggtctcgtcttcgtacgtcgtcctcgtaacgtcgtacgacgtaaccgtaccggtcctccgacgtactacttccgtctcgtaccgtcgacgcgtacgacggacggngttaccttntacgttacttacgtcttaccgttcctacagtcgtagtaccggtctaaagggtcgtaacgtttacgggtcgggtaccgttacggacgtaacggggacccggttaaaaacgggttccggttaaacccgtaccggggtttcccggtaggggtacccgtacccgggtaacccggtacccgggcccgtttaaccccggcccccggttacccgg

SEQ ID NO: 230957 - DNA, 375 bp, Homo sapiens
  misc_feature: GYAE6OF01ETFEV.13.11.A11.1.454.CMB.1.raw
  modified_base (372)..(375): a, c, t, g, unknown or other
  misc_feature (372)..(375): n is a, c, g, or t
tcagtcacgtactacacgaccggtgctcgatttagctacgactgcaggccagtcagattgtcagcagcaactacttagcctggtaccagcagaagcctggccaggcccaggctcctcatctacgatgtattcaggaggaccactgacatcccagacaggttcagtggcagtgggtctgggacagacttcactctcaccatcagcagactggaacctgaagactttgcactttattctgtcaccagtatggtagtcaccgtacactttggccagggaccaagctggagatcaagcgaactgtggctgcaccatctgtcttcatcttccgccatctgatagtacgtgactgagcgggctggcaaggcgcatagnnnn

SEQ ID NO: 230958 - DNA, 334 bp, Homo sapiens
  misc_feature: GYAE6OF01DQ81A.13.11.A11.1.454.CMB.1.raw
  modified_base (241)..(241): a, c, t, g, unknown or other
  misc_feature (241)..(241): n is a, c, g, or t
  modified_base (331)..(334): a, c, t, g, unknown or other
  misc_feature (331)..(334): n is a, c, g, or t
tcagtcacgtactacacgaccggtgctcgatttagctacgactgcagggccagtcagattgtcagcagcaactacttagcctggtaccagcagaagcctggccaggccccaggctcctcatctacgatgtattcaggaggaccactgacatcccagacaggttcagtggcagtgggtctgggacagacttcactctcaccatcagcagactggaacctgaagactttgctactttatttcngtcaccagtatggaactgtggctgcaccatctgtcttcatcttcccgcatctgatagtacgtgactgagcgggctggcaaggcgcatagnnnn

SEQ ID NO: 230959 - DNA, 383 bp, Homo sapiens
  misc_feature: GYAE6OF01EGFO9.13.11.A11.1.454.CMB.1.raw
  modified_base (380)..(383): a, c, t, g, unknown or other
  misc_feature (380)..(383): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcacttttattctgtcaccagtatggtaggtcaccgtacacttttggccaggggaccaagctggagatcaagcgaactgtggctgcaccatctgtcttcatcttcccgccatctgatagtacgtgactgagcgggctggcaaggcgcatagnnnn

SEQ ID NO: 230960 - DNA, 380 bp, Homo sapiens
  misc_feature: GYAE6OF01EQGY7.13.11.A11.1.454.CMB.1.raw
  modified_base (377)..(380): a, c, t, g, unknown or other
  misc_feature (377)..(380): n is a, c, g, or t
tcagtcacgtactacacgaccggtgctcgatttagctacgactgcagggccagtcagattgtcagcagcaactacttagcctggtaccagcagaagcctggccaggccccaggctcctcatctacgatgtattcaggaggaccactgacatcccagacaggttcagtggcagtgggtctgggacagacttcactctcaccatcagcagactggaacctgaagactttgcactttattctgtcaccagtatggtaggtcaccgtacacttttggccaggggaccaagctggagatcaagcgaactgtggctgcaccatctgtcttcatcttcccgcatctgatagtacgtgactgagcgggctggcaaggcgcatagnnnn

SEQ ID NO: 230961 - DNA, 385 bp, Homo sapiens
  misc_feature: GYAE6OF01BDUTG.13.11.A11.1.454.CMB.1.raw
  modified_base (379)..(385): a, c, t, g, unknown or other
  misc_feature (379)..(385): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttattctgtcaccagtatggtaggtcaccgtacacttttggccaggggaccaagctggagatcaagcgaactgtggctgcaccatctgtcttcatcttcccgccatctgatagtacgtgactgagcgggctggcaaggcgcatagnnnnnnn

SEQ ID NO: 230962 - DNA, 384 bp, Homo sapiens
  misc_feature: GYAE6OF01CGVQA.13.11.A11.1.454.CMB.1.raw
  modified_base (379)..(384): a, c, t, g, unknown or other
  misc_feature (379)..(384): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttatttctgtcaccagtatggtaggtcaccgtacacttttggccaggggaccaagctggagatcaagcgaactgtggctgcaccatctgtcttcatcttcccgcatctgatagtacgtgactgagcgggctggcaaggcgcatagnnnnnn

SEQ ID NO: 230963 - DNA, 381 bp, Homo sapiens
  misc_feature: GYAE6OF01D2E1D.13.11.A11.1.454.CMB.1.raw
  modified_base (378)..(381): a, c, t, g, unknown or other
  misc_feature (378)..(381): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttattctgtcaccagtatggtaggtcaccgtacactttggccaggggaccaagctggagatcaagcgaactgtggctgcaccatctgtcttcattttcccgccatctgatagtacgtgactgagcgggctggcaaggcgcatagnnnn

SEQ ID NO: 230964 - DNA, 385 bp, Homo sapiens
  misc_feature: GYAE6OF01DNKKQ.13.11.A11.1.454.CMB.1.raw
  modified_base (241)..(241): a, c, t, g, unknown or other
  misc_feature (241)..(241): n is a, c, g, or t
  modified_base (380)..(385): a, c, t, g, unknown or other
  misc_feature (380)..(385): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttatttcngtcaccagtatggtaggtcaccgtacacttttggccaggggaccaagctggagatcaagcgaactgtggctgcaccatctgtcttcatcttcccgccatctgatagtacgtgactgagcgggctggcaaggcgcatagnnnnnn

SEQ ID NO: 230965 - DNA, 389 bp, Homo sapiens
  misc_feature: GYAE6OF01AF5CU.13.11.A11.1.454.CMB.1.raw
  modified_base (383)..(389): a, c, t, g, unknown or other
  misc_feature (383)..(389): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtggtctggacagacttcactctcaccatcagcagactggaacctgaagtactttgctacttttatttctgtcaccagtatggtaggtcaccgtactacttttggccaggggaccaagctggagatcaagcgaactgtggctgcaccatctgtcttcatccttcccgccatctgatagtacgtgactgagcgggctggcaaggcgcatagnnnnnnn

SEQ ID NO: 230966 - DNA, 386 bp, Homo sapiens
  misc_feature: GYAE6OF01BT8TE.13.11.A11.1.454.CMB.1.raw
  modified_base (380)..(386): a, c, t, g, unknown or other
  misc_feature (380)..(386): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttattctgtcaccagtatggtaggtcaccgtacacttttggccaggggaccaagctggagatcaagcgaactgtggctgcaccatctgtcttcatcttctcgccatctgatagtacgtgactgagcgggctggcaaggcgcatagnnnnnnn

SEQ ID NO: 230967 - DNA, 384 bp, Homo sapiens
  misc_feature: GYAE6OF01EB2Q0.13.11.A11.1.454.CMB.1.raw
  modified_base (379)..(384): a, c, t, g, unknown or other
  misc_feature (379)..(384): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttattctgtcaccagtatggtaggtcaccgtacacttttggccaggggaccaagctggagatcaagcgaactgtggctgcaccatctgtcttcatcttcccgccatctgatagtacgtgactgagcgggctggcaaggcgcatagnnnnnn

SEQ ID NO: 230968 - DNA, 386 bp, Homo sapiens
  misc_feature: GYAE6OF01B14A6.13.11.A11.1.454.CMB.1.raw
  modified_base (383)..(386): a, c, t, g, unknown or other
  misc_feature (383)..(386): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcacactggagcctgaagattttgcagtgtattactgtcagcagtatggtagctcacctcggacgttcggccaagggacccaaggtggaaaatcaaacgaactgtaggctgcaccatctgtcttcatcttcccgccatctgatagtacgtgactgagcgggctggcaaggcgcatagnnnn

SEQ ID NO: 230969 - DNA, 386 bp, Homo sapiens
  misc_feature: GYAE6OF01DCVK5.13.11.A11.1.454.CMB.1.raw
  modified_base (224)..(224): a, c, t, g, unknown or other
  misc_feature (224)..(224): n is a, c, g, or t
  modified_base (382)..(386): a, c, t, g, unknown or other
  misc_feature (382)..(386): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagcctgcaggctgaagntgtggcagtttattactgtcagcaatattatagtactctccgaggctcactttcggcggaggaccaaggtggagatcaaacgaactgtggctgcaccatctgtcttcatctcccgcatctgatagtacgtgactgagcgggctggcaaggcgcatagnnnnn

SEQ ID NO: 230970 - DNA, 384 bp, Homo sapiens; identical to SEQ ID NO: 230967
  misc_feature: GYAE6OF01AYDX4.13.11.A11.1.454.CMB.1.raw
  modified_base (379)..(384): a, c, t, g, unknown or other
  misc_feature (379)..(384): n is a, c, g, or t

SEQ ID NO: 230971 - DNA, 379 bp, Homo sapiens
  misc_feature: GYAE6OF01A6MAL.13.11.A11.1.454.CMB.1.raw
  modified_base (375)..(379): a, c, t, g, unknown or other
  misc_feature (375)..(379): n is a, c, g, or t
tcagtcacgtactacacgaccggtgctcgatttagctacgactgcagggccagtcagattgtcagcagcaactacttagcctggtaccagcaaaggcctggccaggctcccaggcgcctcatctatgctgcttccagtagggccactggcgtcccagacaggttcagtggcagtgggtctgggacagacttcaccctcaccatcagcagactggagcctgaagattttgcagtctattactgtcagcagtatggtagccgaaagacgttcggccaagggaccaaggtggaaatcaaacgaactgtggctgcacatctgtcttcatcttcccgcatctgatagtacgtgactgagcgggctggcaaggcgcatagnnnnn

SEQ ID NO: 230972 - DNA, 385 bp, Homo sapiens
  misc_feature: GYAE6OF01AT90W.13.11.A11.1.454.CMB.1.raw
  modified_base (380)..(385): a, c, t, g, unknown or other
  misc_feature (380)..(385): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttatttctgtcaccagtatggtaggtcaccgtacacttttggccaggggaccaagctggagatcaagcgaactgtggctgcaccatctgtcttcatcttcccgccatctgatagtacgtgactgagcgggctggcaaggcgcatagnnnnnn

SEQ ID NO: 230973 - DNA, 405 bp, Homo sapiens
  misc_feature: GYAE6OF01BXPSD.13.11.A11.1.454.CMB.1.raw
  modified_base (401)..(405): a, c, t, g, unknown or other
  misc_feature (401)..(405): n is a, c, g, or t
tcagtcacgtactacacgaccggtgctcgatttagctacgactgcagggttctctggtataaactggaatggtgccagcacaacttatgcagactctgtgaagggccgattcaccatctccagagacagtgccgagaactccgtacatctgcaaatgaacagtctcggagtcgaggacacggccttgtatttctgtgcgaggttagcagtggctggtacttacgcaatggacgtctggggccaagggaccacggtcaccgtctcctcagcctccaccaagggcccatcggtcttccccctggcaccctcctccaagagcacctctggggcacagcggccctgggctgcctggtcaaggctacttctagtacgtgactgagcgggctggcaaggcgcatagnnnnn

SEQ ID NO: 230974 - DNA, 383 bp, Homo sapiens
  misc_feature: GYAE6OF01DIN3B.13.11.A11.1.454.CMB.1.raw
  modified_base (241)..(241): a, c, t, g, unknown or other
  misc_feature (241)..(241): n is a, c, g, or t
  modified_base (379)..(383): a, c, t, g, unknown or other
  misc_feature (379)..(383): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttatttcngtcaccagtatggtaggtcaccgtacacttttggccaggggaccaagctggagatcaagcgaactgtggctgcaccatctgtcttcatcttcccgcatctgatagtacgtgactgagcgggctggcaaggcgcatagnnnnn

SEQ ID NO: 230975 - DNA, 382 bp, Homo sapiens
  misc_feature: GYAE6OF01BIGT3.13.11.A11.1.454.CMB.1.raw
  modified_base (378)..(382): a, c, t, g, unknown or other
  misc_feature (378)..(382): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttatttctgtcaccagtatggtagtcaccgtacacttttggccaggggaccaagctggagatcaagcgaactgtgctgcaccatctgtcttcatcttcccgccatctgatagtacgtgactgagcgggctggcaaggcgcatagnnnnn

SEQ ID NO: 230976 - DNA, 385 bp, Homo sapiens
  misc_feature: GYAE6OF01BK3JT.13.11.A11.1.454.CMB.1.raw
  modified_base (379)..(385): a, c, t, g, unknown or other
  misc_feature (379)..(385): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctacttttattctgtcaccagtatggtagtcaccgtacacttttggccaggggaccaagctggagatcaagcgaactgtggctgcaccatctgtcttcatcttcccgctatctgatagtacgtgactgagcggctggcaaggcgcatagnnnnnnn

SEQ ID NO: 230977 - DNA, 362 bp, Homo sapiens
  misc_feature: GYAE6OF01C6RO6.13.11.A11.1.454.CMB.1.raw
  modified_base (242)..(242): a, c, t, g, unknown or other
  misc_feature (242)..(242): n is a, c, g, or t
  modified_base (355)..(362): a, c, t, g, unknown or other
  misc_feature (355)..(362): n is a, c, g, or t
tcagtcacgtactacacgaccggtgctcgatttagctacgactgcagggccagtcagattgtcagcagcaactacttagcctggccaggctcctcatctacgatgtattcaggaggaccactgacatcccagacaggttcagtggcagtgggtctgggacagacttcactctcaccatcagcagactggaacctgaagactttgcacttttatttctgtcaccagtatggtagtcaccgtanacttttggccaggggaccaagctggagatcaagcgaactgtggctgcaccatctgtcttcatcttcccgccatctgatagtacgtgactgagcgggctggcaaggcgcatagnnnnnnnn

SEQ ID NO: 230978 - DNA, 388 bp, Homo sapiens
  misc_feature: GYAE6OF01DRVTC.13.11.A11.1.454.CMB.1.raw
  modified_base (242)..(242): a, c, t, g, unknown or other
  misc_feature (242)..(242): n is a, c, g, or t
  modified_base (372)..(372): a, c, t, g, unknown or other
  misc_feature (372)..(372): n is a, c, g, or t
  modified_base (377)..(388): a, c, t, g, unknown or other
  misc_feature (377)..(388): n is a, c, g, or t
tcagtcacgtactacacgaccggtgctcgatttagctacgactgcagggccaggtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcacttttattcngtcaccagtatggtagtcaccgtacactttggccagggaccaagctggagatcaagcgaactgtggctgcaccatctgtcttcatcttcccgcatctgatagtacgtgactgagcgggctggcaaggcgnatagnnnnnnnnnnnn

SEQ ID NO: 230979 - DNA, 384 bp, Homo sapiens
  misc_feature: GYAE6OF01CBC6Z.13.11.A11.1.454.CMB.1.raw
  modified_base (380)..(384): a, c, t, g, unknown or other
  misc_feature (380)..(384): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttatttctgtcaccagtatggtaggtcaccgtacacttttggccaggggaccaagctggagatcaagcgaactgtggctgcaccatctgtcttcatcttcccgccatctgatagtacgtgactgagcgggctggcaaggcgcatagnnnnn

SEQ ID NO: 230980 - DNA, 644 bp, Homo sapiens
  misc_feature: GYAE6OF01CF4DY.13.11.A11.1.454.CMB.1.raw
  modified_base (606)..(606): a, c, t, g, unknown or other
  misc_feature (606)..(606): n is a, c, g, or t
  modified_base (608)..(608): a, c, t, g, unknown or other
  misc_feature (608)..(608): n is a, c, g, or t
  modified_base (610)..(610): a, c, t, g, unknown or other
  misc_feature (610)..(610): n is a, c, g, or t
  modified_base (612)..(614): a, c, t, g, unknown or other
  misc_feature (612)..(614): n is a, c, g, or t
  modified_base (616)..(644): a, c, t, g, unknown or other
  misc_feature (616)..(644): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcagggacgaccatgacactcccagacgtaggttcaggtggcaggtgggtcgtgggacagtacttcactctccaccatcagcagacgtacggaacctagaacgttactttgaccttaactttttatttcgtgttccaaccctaagttagttagggttacgggttaccctaacccggttaccttaaccgtttttcgggacccggtaacgggggaacccaaaggtccgtagggaagtacttaccgaaacggaccggtaaaccttgggtcgggtacttcggaccctaacccgtactttccgttcggtttcccttttacctaactttcccccgttttccccccggacccttaacgtttcccgttaaggtaacgtttaacggttaaccggttacggtaacccgtttagggaacggggtcccgggggtccgttacggggaaccggtaaaacggggcccgtaaccgtaaacggttaaggngngngnnngnnnnnnnnnnnnnnnnnnnnnnnnnnnnn

SEQ ID NO: 230981 - DNA, 387 bp, Homo sapiens
  misc_feature: GYAE6OF01ARMR2.13.11.A11.1.454.CMB.1.raw
  modified_base (380)..(387): a, c, t, g, unknown or other
  misc_feature (380)..(387): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttatttctgtcaccagtatggtaggtcaccgtacacttttggcctaggggaccaagctggagatcaagcgaactgtggctgcaccatctgtcttcatcttcccgccatctgatagtacgtgactgagcggctggcaaggcgcatagnnnnnnnn

SEQ ID NO: 230982 - DNA, 386 bp, Homo sapiens
  misc_feature: GYAE6OF01DW7AA.13.11.A11.1.454.CMB.1.raw
  modified_base (381)..(386): a, c, t, g, unknown or other
  misc_feature (381)..(386): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagctttgctacttttattctgttcaccagtatggtaggtcaccgtacacttttggcctaggggaccaagctggagatcaagcgaactgtgctgcaccatctgtcttcatcttcccgccatctgatagtacgtgactgagcgggctggcaaggcgcatagnnnnnn

SEQ ID NO: 230983 - DNA, 382 bp, Homo sapiens
  misc_feature: GYAE6OF01BIT2K.13.11.A11.1.454.CMB.1.raw
  modified_base (379)..(382): a, c, t, g, unknown or other
  misc_feature (379)..(382): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcacttttattctgtcaccagtatggtaggtcaccgtacacttttggccaggggaccaagctggagatcaagcgaactgtggctgcacatctgtcttcatcttcccgccatctgatagtacgtgactgagcgggctggcaaggcgcatagnnnn

SEQ ID NO: 230984 - DNA, 388 bp, Homo sapiens
  misc_feature: GYAE6OF01B9BFZ.13.11.A11.1.454.CMB.1.raw
  modified_base (382)..(388): a, c, t, g, unknown or other
  misc_feature (382)..(388): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctacttttatttctgtcaccagtatggtaggtcaccgtacacttttggccaggggaccaagctggagatcaagcgaactgtggctgcaccatctgtcttcatcttcccgctatctgatagtacgtgactgagcgggctggcaaggcgcatagnnnnnnn

SEQ ID NO: 230985 - DNA, 383 bp, Homo sapiens
  misc_feature: GYAE6OF01BO3JG.13.11.A11.1.454.CMB.1.raw
  modified_base (379)..(383): a, c, t, g, unknown or other
  misc_feature (379)..(383): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttattctgtcaccagtatggtaggtcaccgtacacttttggccaggggaccaagctggagatcaagcgaactgtggctgcaccatctgtcttcatcttcccgccatctgatagtacgtgactgagcgggctggcaaggcgcatgnnnnn

SEQ ID NO: 230986 - DNA, 386 bp, Homo sapiens
  misc_feature: GYAE6OF01A9MZ3.13.11.A11.1.454.CMB.1.raw
  modified_base (381)..(386): a, c, t, g, unknown or other
  misc_feature (381)..(386): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttatttctgtcaccagtatggtaggtcaccgtacacttttggccaggggaccaagctggagatcaagcgaactgtggctgcaccatctgtcttcatcttcccgccatctgatagtacgtgactgagcgggctggcaaggcgcatagnnnnnn

SEQ ID NO: 230987 - DNA, 384 bp, Homo sapiens
  misc_feature: GYAE6OF01A5H0N.13.11.A11.1.454.CMB.1.raw
  modified_base (379)..(384): a, c, t, g, unknown or other
  misc_feature (379)..(384): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttatttctgtcaccagtatggtaggtcaccgtacacttttggcctaggggaccaagctggagatcaagcgaactgtggctgcaccatctgtcttcatcttcccgccatctgatagacgtgactgagcggctggcaaggcgcatagnnnnnn

SEQ ID NO: 230988 - DNA, 386 bp, Homo sapiens
  misc_feature: GYAE6OF01EECOM.13.11.A11.1.454.CMB.1.raw
  modified_base (381)..(386): a, c, t, g, unknown or other
  misc_feature (381)..(386): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctacttttattctgtcaccagtatggtaggtcaccgtacacttttggccaggggaccaagctggagatcaagcgaactgtggctgcaccatctgtcttcatcttcccgccatctgatagtacgtgactgagcgggctggcaaggcgcatagnnnnnn

SEQ ID NO: 230989 - DNA, 388 bp, Homo sapiens
  misc_feature: GYAE6OF01EQO2F.13.11.A11.1.454.CMB.1.raw
  modified_base (376)..(376): a, c, t, g, unknown or other
  misc_feature (376)..(376): n is a, c, g, or t
  modified_base (382)..(388): a, c, t, g, unknown or other
  misc_feature (382)..(388): n is a, c, g, or t
tcagtcacgtactacacgaccggtgctcgatttagctacgactgcagggccagtcagattgtcagcagcaactacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctcggacgttcggccaagggaccaaggtggaaatcaaacgaactgtggctgcaccatctgtcttcatcttcccgccatctgattagtacgtgactgagcgggctggcaagggcncatagnnnnnnn

SEQ ID NO: 230990 - DNA, 386 bp, Homo sapiens
  misc_feature: GYAE6OF01EB2RH.13.11.A11.1.454.CMB.1.raw
  modified_base (382)..(386): a, c, t, g, unknown or other
  misc_feature (382)..(386): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctacttttattctgtcaccagtatggtaggtcaccgtacacttttggcctaggggaccaagctggagatcaagcgaactgtggctgcaccatctgtcttcatcttcccgccatctgatagtacgtgactgagcgggctggcaaggcgcatagnnnnn

SEQ ID NO: 230991 - DNA, 385 bp, Homo sapiens
  misc_feature: GYAE6OF01ACMTL.13.11.A11.1.454.CMB.1.raw
  modified_base (381)..(385): a, c, t, g, unknown or other
  misc_feature (381)..(385): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttatttctgtcaccagtatggtaggtcaccgtacacttttggccaggggaccaagctggagatcaagcgaactgtggctgcaccatctgtcttcatcttcccgccatctgatagtacgtgactgagcgggctggcaaggcgcatagnnnnn

SEQ ID NO: 230992 - DNA, 388 bp, Homo sapiens
  misc_feature: GYAE6OF01AH23F.13.11.A11.1.454.CMB.1.raw
  modified_base (379)..(388): a, c, t, g, unknown or other
  misc_feature (379)..(388): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttattctgtcaccagtatggtaggtcaccgtacacttttggccaggggaccaagctggagatcaagcgaactgtggctgcaccatctgtcttcatcttcccgccatctgatagtacgtgactgagcgggctggcaaggcgcatagnnnnnnnnnn

SEQ ID NO: 230993 - DNA, 596 bp, Homo sapiens
  misc_feature: GYAE6OF01DBAGC.13.11.A11.1.454.CMB.1.raw
  modified_base (367)..(367): a, c, t, g, unknown or other
  misc_feature (367)..(367): n is a, c, g, or t
  modified_base (576)..(576): a, c, t, g, unknown or other
  misc_feature (576)..(576): n is a, c, g, or t
tcagtcacgtactacacgaccggtgctcgatttagctacgactgcaggggtctgggagaggagccccagccctgagattcccaggtgtttccattcagtgatcagcactgaacacagaggactcaccatggagttgggactgagcgtggagttttcctttagggctatttaaaaggtgtccagtgtgaagtgcagctggtggagtctgggggagcttggtacagcctggcaggtccctgagactctcctgtgcagcctctggattcatctttgatgattatgccatgcacgtgggtccgcaagcctcgaggggaaggccgtagggagtcgggtctgaaggttattaggtggaaatggtaggtaaacngtaaggctagtggcggtacttcgtagtggaacggccgtattccactatcctcaagacacgaaccgaccaaacgtaacctcccgttagtactccgtagaactaaagtgaaacctaggttccaggaagacgcgttaggaacggtaaccgaccggttccttaggttaacttacggttagtacggaacgtaaaacggtccttaagtttaacgngtaaggtggtcgttacccgg

SEQ ID NO: 230994 - DNA, 386 bp, Homo sapiens
  misc_feature: GYAE6OF01EF7TY.13.11.A11.1.454.CMB.1.raw
  modified_base (381)..(386): a, c, t, g, unknown or other
  misc_feature (381)..(386): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctacttttatttctgtcaccagtatggtaggtcaccgtacacttttggccaggggaccaagctggagatcaagcgaactgtggctgcaccatctgtcttcatcttcccgcatctgatagtacgtgactgagcgggctggcaaggcgcatagnnnnnn

SEQ ID NO: 230995 - DNA, 385 bp, Homo sapiens
  misc_feature: GYAE6OF01BH3W5.13.11.A11.1.454.CMB.1.raw
  modified_base (382)..(385): a, c, t, g, unknown or other
  misc_feature (382)..(385): n is a, c, g, or t
tcagtcacgtactacacgaccggtgctcgatttagctacgactgcagggccagtcagattgtcagcagcaactacttagcctggtaccagcagaagcctggccaggccccaggctcctcatctacgatgtattcaggaggaccactgacatcccagacaggttcagtggcagtgggtctgggacagacttcactctcaccatcagcagcctcgagcctgaagattttgcagcttattactgtcagcagcgtagcaactggcctcggccctttcggcggagggaccaaggtggagatcaaaacgaactgtggctgcaccatctgtcttcatcttcccgccaatctgatagtacgtgactgagcgggctggcaaggcgcatagnnnn

SEQ ID NO: 230996 - DNA, 444 bp, Homo sapiens
  misc_feature: GYAE6OF01CCYII.13.11.A11.1.454.CMB.1.raw
  modified_base (416)..(444): a, c, t, g, unknown or other
  misc_feature (416)..(444): n is a, c, g, or t
tcagtcacgtactacacgaccggtgctcgattttagctacgactgcaggggccagtcagattgtcagcagcaactacttagcctggtaccaggccagaagcctggccagggcccccaggctcctcatctacgatcgtattcaggaggaccactgacatcccagacaggttcagtcggcagtgggtctggggacagacttcactctcaccatcagcagactggaaccctgaagtactttgctacgttttattcctgtcaccagtatggtaggtcaaccgtacacgttttggccaggggaccaaggctggagatcgaagcgaaactgtaggcttggacctaccgatcttgtactttcaagttccttccccgcatctgatagtacgtgactgagcgggctggcaagggccacacgtagnnnnnnnnnnnnnnnnnnnnnnnnnnnnn

SEQ ID NO: 230997 - DNA, 384 bp, Homo sapiens
  misc_feature: GYAE6OF01AZ2W1.13.11.A11.1.454.CMB.1.raw
  modified_base (378)..(384): a, c, t, g, unknown or other
  misc_feature (378)..(384): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcacttttattctgtcaccagtatggtaggtcaccgtacacttttggccaggggaccaagctggagatcaagcgaactgtggctgcaccatctgtcttcatcttcccgcatctgatagtacgtgactgagcgggctggcaggcgcatagnnnnnnn

SEQ ID NO: 230998 - DNA, 546 bp, Homo sapiens
  misc_feature: GYAE6OF01DWUUS.13.11.A11.1.454.CMB.1.raw
  modified_base (201)..(201): a, c, t, g, unknown or other
  misc_feature (201)..(201): n is a, c, g, or t
  modified_base (375)..(375): a, c, t, g, unknown or other
  misc_feature (375)..(375): n is a, c, g, or t
tcagtcacgtactacacgaccggtgctcgattttagctacgactgcagggggagaaagagctgctcagttaggacccagagggaaccatggaaaccccagcgcagcttctcttcctcctgctactctggctcccagataccaccggagaaattgtgttgacgcagtctccaggcatcgtgtctttgtctccaggggaaagngcccaccctctccgtgcagggccagtcagattgcagcagcaactacttagcctggtaccagcagaagcctggccaggcccccaggcctccctcatctacgatgtattcgagggagaccactgacactcccagacaggttcagtggcaggtgggtctgggacagtacttcactcncacatcagcagactaggaacctagaacgtactttcgactacttttagtttctcgtacactagttatggtagtctaccgtactacgtttggaccgtagggtacctagtcgtggagtagtacgaaggtcgtaagtggtaggctagccgtaacctatacttcgttcttctaccg

SEQ ID NO: 230999 - DNA, 359 bp, Homo sapiens
  misc_feature: GYAE6OF01BJAD1.13.11.A11.1.454.CMB.1.raw
  modified_base (354)..(359): a, c, t, g, unknown or other
  misc_feature (354)..(359): n is a, c, g, or t
tcagtcacgtactacacgaccggtgctcgatttagctacgactgcagggccagtcagattgtcagcagcaactacttagcctggccaggctcctcatctacgatgtattcaggaggaccactgacatcccagacaggttcagtggcagtgggtctgggacagacttcactctcaccatcagcagactggaacctgaagacttttgcactttatttctgtcaccagtatggtagtcaccgtacacttttggccaggggaccaagctggagatcaagcgaactgtggctgcaccatctgtcttcatcttcccgcatctgatagtacgtgactgagcgggctggcaaggcgcatagnnnnnn

SEQ ID NO: 231000 - DNA, 600 bp, Homo sapiens
  misc_feature: GYAE6OF01AWG5T.13.11.A11.1.454.CMB.1.raw
  modified_base (582)..(582): a, c, t, g, unknown or other
  misc_feature (582)..(582): n is a, c, g, or t
  modified_base (584)..(600): a, c, t, g, unknown or other
  misc_feature (584)..(600): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcgagggacggaccactgacactcccagacgtaggttcaggtggcaggtgggtcgtgggacagtaccttcactctccaccatcagcagacgtacggaacctagaacgttacttttcgaccttaactttttatttcgtcgttccaaccctaagttagttgggttacggtccaacccggttaacttaccgtttttcgggacccggtaacggggggtaaccccaaaggtccggttaggggaacgtacgtaccgaaaacggaccggtaaaccgttgggtcgggtccgttccggaccaaacccctagttccgttcggttccctttacctaactttcccccgttacccccgaccctaacttccgttaggtaacgttaacggttaccggtacgtaaccgttaggaacgggtccggggtcgttacggggaccgaaacgggtccgactaagttaggngnnnnnnnnnnnnnnnnn

SEQ ID NO: 231001 - DNA, 388 bp, Homo sapiens
  misc_feature: GYAE6OF01CEQHT.13.11.A11.1.454.CMB.1.raw
  modified_base (380)..(388): a, c, t, g, unknown or other
  misc_feature (380)..(388): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttatttctgtcaccagtatggtaggtcaccgtacacttttggccaggggaccaagctggagatcaagcgaactgtggctgcaccatctgtcttcatcttcccgccatctgatagtacgtgactgagcgggctggcaaggcgcatagnnnnnnnnn

SEQ ID NO: 231002 - DNA, 386 bp, Homo sapiens
  misc_feature: GYAE6OF01EPHOO.13.11.A11.1.454.CMB.1.raw
  modified_base (380)..(386): a, c, t, g, unknown or other
  misc_feature (380)..(386): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctacttttattctgttcaccagtatggtaggtcaccgtacacttttggccaggggaccaagctggagatcaagcgaactgtgctgcacatctgtcttcatctcccgccatctgatagtacgtgactgagcgggtctggcaaggcgcatagnnnnnnn

SEQ ID NO: 231003 - DNA, 382 bp, Homo sapiens
  misc_feature: GYAE6OF01EBD6G.13.11.A11.1.454.CMB.1.raw
  modified_base (242)..(242): a, c, t, g, unknown or other
  misc_feature (242)..(242): n is a, c, g, or t
  modified_base (379)..(382): a, c, t, g, unknown or other
  misc_feature (379)..(382): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcacttttatttcngtcaccagtatggtaggtcaccgtacacttttggccagggaccaagctggagatcaagcgaactgtggctgcaccatctgtcttcatcttcccgcatctgatagtacgtgactgagcgggctggcaaggcgcatagnnnn

SEQ ID NO: 231004 - DNA, 384 bp, Homo sapiens
  misc_feature: GYAE6OF01DPIMY.13.11.A11.1.454.CMB.1.raw
  modified_base (242)..(242): a, c, t, g, unknown or other
  misc_feature (242)..(242): n is a, c, g, or t
  modified_base (381)..(384): a, c, t, g, unknown or other
  misc_feature (381)..(384): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcacttttatttcngtcaccagtatggtaggtcaccgtacacttttggccaggggaccaagctggagatcaagcgaactgtggctgcaccatctgtcttcatcttcccgccatctgatagtacgtgactgagcgggctggcaaggcgcatagnnnn

SEQ ID NO: 231005 - DNA, 387 bp, Homo sapiens
  misc_feature: GYAE6OF01BH5GQ.13.11.A11.1.454.CMB.1.raw
  modified_base (242)..(242): a, c, t, g, unknown or other
  misc_feature (242)..(242): n is a, c, g, or t
  modified_base (380)..(387): a, c, t, g, unknown or other
  misc_feature (380)..(387): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctacttttattcngtcaccagtatggtagtcaccgtacacttttggccaggggaccaagctggagatcaagcgaactgtggctgcaccatctgtcttcatcttcccgccatctgatagtacgtgactgagcgggctggcaaggcgcatagnnnnnnnn

SEQ ID NO: 231006 - DNA, 387 bp, Homo sapiens
  misc_feature: GYAE6OF01BPXDB.13.11.A11.1.454.CMB.1.raw
  modified_base (382)..(387): a, c, t, g, unknown or other
  misc_feature (382)..(387): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctacttttattctgtcaccagtatggtaggtcaccgtacacttttggcctaggggaccaagctggagatcaagcgaactgtggctgcaccatctgtcttcatcttcccgccatctgatagtacgtgactgagcgggctggcaaggcgcatagnnnnnn

SEQ ID NO: 231007 - DNA, 386 bp, Homo sapiens
  misc_feature: GYAE6OF01C7VGH.13.11.A11.1.454.CMB.1.raw
  modified_base (241)..(241): a, c, t, g, unknown or other
  misc_feature (241)..(241): n is a, c, g, or t
  modified_base (380)..(386): a, c, t, g, unknown or other
  misc_feature (380)..(386): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcacttttattcngtcaccagtatggtaggtcaccgtacacttttggccaggggaccaagctggagatcaagcgaactgtggctgcaccatctgtcttcatcttcccgccatctgatagtacgtgactgagcgggctggcaaggcgcatagnnnnnnn

SEQ ID NO: 231008 - DNA, 543 bp, Homo sapiens
  misc_feature: GYAE6OF01EVCTM.13.11.A11.1.454.CMB.1.raw
  modified_base (518)..(518): a, c, t, g, unknown or other
  misc_feature (518)..(518): n is a, c, g, or t
  modified_base (522)..(543): a, c, t, g, unknown or other
  misc_feature (522)..(543): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaacctgaagactttgcttattttattctcgtaccacgtagttagtgggttacgtcctaaccgtacctttagttttcggaccggacgggaaccaagtcggtaggagtataccgaaggaccgtaacgttgggtacggtcgtcggacccaaaccttacgttccgttcgtttccttactaccgtttccccgttacccccgacttaacttcgtaagttaacttaacgggtttaccggtacgttaaccgtagggaaccggggtccgggtcggttcgggaaccggtaacggggtccgaacgtaagtaggngagnnnnnnnnnnnnnnnnnnnnnn

SEQ ID NO: 231009 - DNA, 387 bp, Homo sapiens
  misc_feature: GYAE6OF01AZ1DX.13.11.A11.1.454.CMB.1.raw
  modified_base (380)..(387): a, c, t, g, unknown or other
  misc_feature (380)..(387): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttattctgtcaccagtatggtaggtcaccgtacacttttggccaggggaccaagctggagatcaagcgaactgtggctgcaccatctgtcttcatcttcccgccatctgatagtacgtgactgagcgggctggcaaggcgcatagnnnnnnnn

SEQ ID NO: 231010 - DNA, 383 bp, Homo sapiens
  misc_feature: GYAE6OF01DTQVP.13.11.A11.1.454.CMB.1.raw
  modified_base (241)..(241): a, c, t, g, unknown or other
  misc_feature (241)..(241): n is a, c, g, or t
  modified_base (379)..(383): a, c, t, g, unknown or other
  misc_feature (379)..(383): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcacttttattcngttcaccagtatggtaggtcaccgtacacttttggccaggggaccaagctggagatcaagcgaactgtggctgcaccatctgtcttcatcttcccgcatctgatagtacgtgactgagcggctggcaaggcgcatagnnnnn

SEQ ID NO: 231011 - DNA, 390 bp, Homo sapiens
  misc_feature: GYAE6OF01B2P32.13.11.A11.1.454.CMB.1.raw
  modified_base (243)..(243): a, c, t, g, unknown or other
  misc_feature (243)..(243): n is a, c, g, or t
  modified_base (384)..(390): a, c, t, g, unknown or other
  misc_feature (384)..(390): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctggggacagacttcactctcaccatcagcagactggaacctgaagactttgcacttttatttcngtcaccagtatggtaggtcaccgtacacttttggccaggggaccaagctggagatcaagcgaactgtggctgcaccatctgtcttcatctttcgccatctgtatagtacgtgactgagcgggctgggcaaggcgacatagnnnnnnn

SEQ ID NO: 231012 - DNA, 384 bp, Homo sapiens; identical to SEQ ID NO: 230962
  misc_feature: GYAE6OF01E52IG.13.11.A11.1.454.CMB.1.raw
  modified_base (379)..(384): a, c, t, g, unknown or other
  misc_feature (379)..(384): n is a, c, g, or t

SEQ ID NO: 231013 - DNA, 431 bp, Homo sapiens
  misc_feature: GYAE6OF01EHF3S.13.11.A11.1.454.CMB.1.raw
  modified_base (187)..(187): a, c, t, g, unknown or other
  misc_feature (187)..(187): n is a, c, g, or t
  modified_base (242)..(242): a, c, t, g, unknown or other
  misc_feature (242)..(242): n is a, c, g, or t
  modified_base (380)..(381): a, c, t, g, unknown or other
  misc_feature (380)..(381): n is a, c, g, or t
  modified_base (383)..(383): a, c, t, g, unknown or other
  misc_feature (383)..(383): n is a, c, g, or t
  modified_base (385)..(388): a, c, t, g, unknown or other
  misc_feature (385)..(388): n is a, c, g, or t
  modified_base (392)..(392): a, c, t, g, unknown or other
  misc_feature (392)..(392): n is a, c, g, or t
  modified_base (394)..(394): a, c, t, g, unknown or other
  misc_feature (394)..(394): n is a, c, g, or t
  modified_base (407)..(407): a, c, t, g, unknown or other
  misc_feature (407)..(407): n is a, c, g, or t
  modified_base (410)..(431): a, c, t, g, unknown or other
  misc_feature (410)..(431): n is a, c, g, or t
tcagtcacgtactacacgaccggtgctcgatttagctacgactgcagggccagtcagattgtcagcagcaactacttagcctggtaccagcagaagccctggccaggcccccaggctcctcatctacgatgtattcaggaggaccactgacatcccagacaggttcagtggcagtgggtctgggacngacttcactctcaccatcagcagactggaaccctgaagctttgcacttttattcngtcaccagtatggtaggtcaccgtacactttttggccaggggaccaagctggagatcaagcgaactgtgctgcaccatctgtcttcatcttcccgcatctgatagtacgtgactgagcggctggctaaggcgcatagnntncnnnngctnangctgctgatgcancgnnnnnnnnnnnnnnnnnnnnnn

SEQ ID NO: 231014 - DNA, 384 bp, Homo sapiens; identical to SEQ ID NO: 230979
  misc_feature: GYAE6OF01CF8KG.13.11.A11.1.454.CMB.1.raw
  modified_base (380)..(384): a, c, t, g, unknown or other
  misc_feature (380)..(384): n is a, c, g, or t

SEQ ID NO: 231015 - DNA, 388 bp, Homo sapiens
  misc_feature: GYAE6OF01AWDBA.13.11.A11.1.454.CMB.1.raw
  modified_base (381)..(388): a, c, t, g, unknown or other
  misc_feature (381)..(388): n is a, c, g, or t
tcagtcacgtactacacgaccggtgctcgatttagctacgactgcagggccagtcagagtgttcccaacaactacttagcctggtaccagcaaaggcctggccaggctcccaggcgcctcatctatgctgcttccagtagggccactggcgtcccagacaggttcagtggcagtgggtctgggacagacttcaccctcaccatcagcagcctcgagcctgaagattttgcagcttattactgtcagcagcgtagcaactggcctccggccctttcggcggagggaccaaggtggagatcaaacgaactgtggctgcaccatctgtcttcatcttccgccatctgatagtacgtgactgagcgggctggcaaggcgcatagnnnnnnnn

SEQ ID NO: 231016 - DNA, 386 bp, Homo sapiens
  misc_feature: GYAE6OF01AJ0AO.13.11.A11.1.454.CMB.1.raw
  modified_base (381)..(386): a, c, t, g, unknown or other
  misc_feature (381)..(386): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctacttttatttctgtcaccagtatggtaggtcaccgtacacttttggccaggggaccaagctggagatcaagcgaactgtggctgcaccatctgtcttcatcttcccgccatctgatagtacgtgactgagcggctggcaaggcgcatagnnnnnn

SEQ ID NO: 231017 - DNA, 382 bp, Homo sapiens
  misc_feature: GYAE6OF01BWF09.13.11.A11.1.454.CMB.1.raw
  modified_base (376)..(382): a, c, t, g, unknown or other
  misc_feature (376)..(382): n is a, c, g, or t
tcagtcacgtactacacgaccggtgctcgatttagctacgactgcagggccagtcagacagttagcaacaacgtagcctggtaccagcagaaacgtggccaggcccccaggctcctcatctacgatgtattcaggaggaccactgacatcccagacaggttcagtggcagtgggtctgggacagacttcactctcaccatcagcagactggaacctgaagactttgcactttatttctgtcaccagtatggtaggtcaccgtacacttttggccaggggaccaagctggagatcaagcgaactgtggctgcaccatctgtcttcatcttcccgcatctgatagtacgtgactgagcgggctggcaaggcgcatagnnnnnnn

SEQ ID NO: 231018 - DNA, 389 bp, Homo sapiens
  misc_feature: GYAE6OF01DG9YF.13.11.A11.1.454.CMB.1.raw
  modified_base (243)..(243): a, c, t, g, unknown or other
  misc_feature (243)..(243): n is a, c, g, or t
  modified_base (382)..(389): a, c, t, g, unknown or other
  misc_feature (382)..(389): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctacttttatttcngtcaccagtatggtaggtcaccgtacacttttggccaggggaccaagctggagatcaagcgaactgtggctgcaccatctgtcttcatcttcccgccatctgatagtacgtgactgagcgggctggcaaggcgcatagnnnnnnnn

SEQ ID NO: 231019 - DNA, 414 bp, Homo sapiens
  misc_feature: GYAE6OF01E6FMJ.13.11.A11.1.454.CMB.1.raw
  modified_base (407)..(414): a, c, t, g, unknown or other
  misc_feature (407)..(414): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcaggtgggtctgggacagacttcactctcaccatcagcagactggaacctgaagtctttgcttacttttattctgtcacctagtatggtagtcaccgtactacgtttggccgtagggaccagcgtaggagatacaagcgaacgtgtcgctcgacactatctgttcttcactcctcccgacctattctagtattaggtacgtgacgtggacggcgggctaggacgaaggcgacatagnnnnnnnn

SEQ ID NO: 231020 - DNA, 388 bp, Homo sapiens
  misc_feature: GYAE6OF01BX4IY.13.11.A11.1.454.CMB.1.raw
  modified_base (241)..(241): a, c, t, g, unknown or other
  misc_feature (241)..(241): n is a, c, g, or t
  modified_base (372)..(372): a, c, t, g, unknown or other
  misc_feature (372)..(372): n is a, c, g, or t
  modified_base (378)..(388): a, c, t, g, unknown or other
  misc_feature (378)..(388): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttattcngtcaccagtatggtaggtcaccgtacacttttggccaggggaccaagctggagatcagcgaactgtggctgcacatctgtcttcatcttcccgcatctgatagtacgtgactgagcgggctggcaaggcgnagtagnnnnnnnnnnn

SEQ ID NO: 231021 - DNA, 383 bp, Homo sapiens
  misc_feature: GYAE6OF01DX6RV.13.11.A11.1.454.CMB.1.raw
  modified_base (379)..(383): a, c, t, g, unknown or other
  misc_feature (379)..(383): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttatttctgtcaccagtatggtaggtcaccgtacacttttggccaggggaccaagctggagatcaagcgaactgtggctgcaccatctgtcttcatcttcccgcatctgatagtacgtgactgagcgggctggcaaggcgcatagnnnnn

SEQ ID NO: 231022 - DNA, 539 bp, Homo sapiens
  misc_feature: GYAE6OF01DE1DV.13.11.A11.1.454.CMB.1.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctcccagtttctcctgaggttcaggtcaaactcagataaacgacagggctctggacgtccccagccgcttctctggatccaaaggatgacttccgccaacgcgagggatagttactcatctcgtgggctccagtctgacgatgaggctgacttattactgtttgacttggacaacaacacgcctaggacttcgttcgggacctgggacccacggtccaccgtccgtaggtcacggccccgaagccccaaccctactacgtaccacttccgtcgttaccccc

SEQ ID NO: 231023 - DNA, 224 bp, Homo sapiens
  misc_feature: GYAE6OF01EEYZH.13.11.A11.1.454.CMB.1.raw
  modified_base (221)..(224): a, c, t, g, unknown or other
  misc_feature (221)..(224): n is a, c, g, or t
tcagtcacgtactacacgaccggtgctcgatttagctacgactgcagggtggaggctgaggatgttattgggctctattattgcatgcaagcaacacactggccgtacacttttggccaggggaccaagctggagatcaatcgaactgtggctgcaccatctgtcttcatcttcccgccatctgatagtacgtgactgagcgggctggcaaggcgcatagnnnn

SEQ ID NO: 231024 - DNA, 385 bp, Homo sapiens
  misc_feature: GYAE6OF01CE5DI.13.11.A11.1.454.CMB.1.raw
  modified_base (374)..(374): a, c, t, g, unknown or other
  misc_feature (374)..(374): n is a, c, g, or t
  modified_base (380)..(385): a, c, t, g, unknown or other
  misc_feature (380)..(385): n is a, c, g, or t
tcagtcacgtactacacgaccggtgctcgatttagctacgactgcagggccagtcagattgtcagcagcaactacttagcctggtaccagcagaagcctggccaggcccccaggcctcctcatctacgatgtattcaggaggaccactgacatcccagacaggttcagtggcagtgggtctgggacagacttcactctcaccatcagcagactggaacctgaagactttgctactttatttctgtcaccagtatgtaggtcaccgtacacttttggccagggaccaagctggagatcaaacgaactgttgctgcaccatctgtcttcatcttcccgcatctgatagtacgtgactggagcgggctggcaaggcncatagnnnnnn

SEQ ID NO: 231025 - DNA, 384 bp, Homo sapiens
  misc_feature: GYAE6OF01D2TYY.13.11.A11.1.454.CMB.1.raw
  modified_base (380)..(384): a, c, t, g, unknown or other
  misc_feature (380)..(384): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaacctgaagactttgctacttttattctgtcaccagtatggtagtcaccgtacacttttggccagggaccaagctggagatcaagcgaactgtggctgaaccatctgtcttcatccttccgccatctgatagtacgtgactgagcgggctggcaaggcgcatagnnnnn

SEQ ID NO: 231026 - DNA, 551 bp, Homo sapiens
  misc_feature: GYAE6OF01ENXX3.13.11.A11.1.454.CMB.1.raw
  modified_base (185)..(185): a, c, t, g, unknown or other
  misc_feature (185)..(185): n is a, c, g, or t
  modified_base (190)..(190): a, c, t, g, unknown or other
  misc_feature (190)..(190): n is a, c, g, or t
  modified_base (206)..(206): a, c, t, g, unknown or other
  misc_feature (206)..(206): n is a, c, g, or t
  modified_base (486)..(486): a, c, t, g, unknown or other
  misc_feature (486)..(486): n is a, c, g, or t
  modified_base (508)..(508): a, c, t, g, unknown or other
  misc_feature (508)..(508): n is a, c, g, or t
  modified_base (511)..(549): a, c, t, g, unknown or other
  misc_feature (511)..(549): n is a, c, g, or t
  modified_base (551)..(551): a, c, t, g, unknown or other
  misc_feature (551)..(551): n is a, c, g, or t
tcagtcacgtactacacgaccggtgctcgatttagctacgactgcagggccagtcagattgtccagcagcaactacttagcctggtaccagcagaagcctggccaggccccccaggctcctcatctacgatgtattcagggaggaccactgacatcccagacaggttcagtggcaggtgggtcgnggacngtctcactctcacctntcgacgcagtacgtacgaacctagaacgttctttgactttaacttttactttcgtcgtacctaaccgttagttacgttagggtacggttacccttaaccggtaacctttacggtttttaccgggacccgggtaacggggaacctaacggtccgtagggaagtacgtacgaaacggacgtaacgtgggtacgtcgtcgacctaacgtatcgttcgttacttctaacttcccttacccgactacttacttaagtacgtgtacgcgttggaggtcgggtacgnggaccgaaggtccactagtcgntannnnnnnnnnnnnnnnnnnnnnnnnnnnnnnnnnnnnnngn

SEQ ID NO: 231027 - DNA, 398 bp, Homo sapiens
  misc_feature: GYAE6OF01BEV3U.13.11.A11.1.454.CMB.1.raw
  modified_base (249)..(249): a, c, t, g, unknown or other
  misc_feature (249)..(249): n is a, c, g, or t
  modified_base (389)..(398): a, c, t, g, unknown or other
  misc_feature (389)..(398): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatccccagacaggttcagtggcagtgggtctgggacagaccttcactctcaccatcagcagactggaaacctgaagtacctttgctacttttatttcngtcaccagtatggtaggtcaccgtacacttttggccaggggaccaagctggagatcaagcgaactgtggctgcaccatctgtcttcatcttcccgcatctgatagtacgtgactgagcgggctggacaaggcgacatagnnnnnnnnnn

SEQ ID NO: 231028 - DNA, 385 bp, Homo sapiens
  misc_feature: GYAE6OF01CW24J.13.11.A11.1.454.CMB.1.raw
  modified_base (245)..(245): a, c, t, g, unknown or other
  misc_feature (245)..(245): n is a, c, g, or t
  modified_base (382)..(385): a, c, t, g, unknown or other
  misc_feature (382)..(385): n is a, c, g, or t
tcagtcacgtactacacgaccggtgctcgatttagctacgactgcagggccagtcagattgtcagcagcaactacttagcctggtaccagcagaagcctggccacggcccccaggcctcctcatctacgatgtattcaggaggaccactgacatcccagacaggttcagtggcagtgggtctgggacagacttcactctcaccatcagcagactggaacctgaagtctttgctacttttatttcngtcaccagtatggtagtcaccgtacacttttggccaggggaccaagctggagatcaagcgaactgtggctgcacatctgtcttcatccttcccgcctatctgatagtcgtgactgagcgggctggcaggcgcatagnnnn

SEQ ID NO: 231029 - DNA, 214 bp, Homo sapiens
  misc_feature: GYAE6OF01BXEI4.13.11.A11.1.454.CMB.1.raw
  modified_base (212)..(214): a, c, t, g, unknown or other
  misc_feature (212)..(214): n is a, c, g, or t
tcagtcacgtactacacgaccggtgctcgatttagctacgactgcaggggccagggaaccctggtcaccgtctcctctgcctccaccaaggcccatcggtcttcccctggcgccctgctccaggagcacctccgagagcacagcggccctgggctgcctggtcaaggactacttcctagtacgtgactgagcgggctggcaaggcgcatagnnn

SEQ ID NO: 231030 - DNA, 385 bp, Homo sapiens
  misc_feature: GYAE6OF01DDXLE.13.11.A11.1.454.CMB.1.raw
  modified_base (242)..(242): a, c, t, g, unknown or other
  misc_feature (242)..(242): n is a, c, g, or t
  modified_base (374)..(374): a, c, t, g, unknown or other
  misc_feature (374)..(374): n is a, c, g, or t
  modified_base (380)..(385): a, c, t, g, unknown or other
  misc_feature (380)..(385): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttatttcngtcaccagtatggtaggtcaccgtacacttttggccaggggaccaagctggagatcaagcgaactgtggctgcaccatctgtcttcatcttcccgctatctgatagtacgtgactgagcgggctggcaggcncatagnnnnnn

SEQ ID NO: 231031 - DNA, 386 bp, Homo sapiens
  misc_feature: GYAE6OF01DO2G7.13.11.A11.1.454.CMB.1.raw
  modified_base (245)..(245): a, c, t, g, unknown or other
  misc_feature (245)..(245): n is a, c, g, or t
  modified_base (376)..(376): a, c, t, g, unknown or other
  misc_feature (376)..(376): n is a, c, g, or t
  modified_base (382)..(386): a, c, t, g, unknown or other
  misc_feature (382)..(386): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaacctgaagacttttgctacttttatttcngtcaccagtatggtaggtcaccgtacacttttggccagggaccaagctggagatcaagcgaactgtggctgcacatctgtcttcatcttcccgctatctgatagtacgtgactgagcgggctggcaaggcncatagnnnnn

SEQ ID NO: 231032 - DNA, 396 bp, Homo sapiens
  misc_feature: GYAE6OF01D3ZSF.13.11.A11.1.454.CMB.1.raw
  modified_base (370)..(370): a, c, t, g, unknown or other
  misc_feature (370)..(370): n is a, c, g, or t
  modified_base (389)..(396): a, c, t, g, unknown or other
  misc_feature (389)..(396): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctacttttattctgtcaccagtatggtaggtcaccgtactacttttggccaggggaccaaggctggagatcaagcgaactgtggctgcaccatctgtcttcactccttcccgcctatctgatagtcgtgactgaggcgggntcgggcaagggcgcatagnnnnnnnn

SEQ ID NO: 231033 - DNA, 550 bp, Homo sapiens
  misc_feature: GYAE6OF01A3WE5.13.11.A11.1.454.CMB.1.raw
  modified_base (195)..(195): a, c, t, g, unknown or other
  misc_feature (195)..(195): n is a, c, g, or t
tcagtcacgtactacacgaccggtgctcgatttagctacgactgcaggggagaagagctgctcagttaggacccagagggaaccatggaaaccccagcgcagcttctcttcctcctgctactctggctcccagataccaccggagaaattgtgttgacgcagtctccaggcatcgtgtctttgtctcaggggaangccaccctctcctgcagggccagtcagattgtcagcagcaactcttagcctggtaccagcagaagcctggccacggcccccaggcctccgtcatcctacgatgtattcgacggtaggaccacgtgacactcccagacaggttcaggtggcgaggtgggtctgggacagtacttcactctcaccatcagcagactggaacctgaacgtacttgactactttattctagtacacgtagtagtcggtacgtcaccgttctacgtttcggaccgtacgggactaagtccgtaggacgtactacgtaaggaccgtaagtgggtcgaccgtgcctactacgttcttacgtcgttcgtaccg

SEQ ID NO: 231034 - DNA, 219 bp, Homo sapiens
  misc_feature: GYAE6OF01CKNPB.13.11.A11.1.454.CMB.1.raw
  modified_base (214)..(219): a, c, t, g, unknown or other
  misc_feature (214)..(219): n is a, c, g, or t
tcagtcacgtactacacgaccggtgctcgatttagctacgactgcaggggccagggaaccctggtcaccgtctcctctgcctccaccaagggcccatcggtcttccccctggcgccctgctccaggagcacctccgagagcacagcggccctgggctgcctggtcaaggactacttcctagtacgtgactgagcgggctggcaaggcgcatagnnnnnn

SEQ ID NO: 231035 - DNA, 389 bp, Homo sapiens
  misc_feature: GYAE6OF01DN7ZL.13.11.A11.1.454.CMB.1.raw
  modified_base (187)..(187): a, c, t, g, unknown or other
  misc_feature (187)..(187): n is a, c, g, or t
  modified_base (244)..(244): a, c, t, g, unknown or other
  misc_feature (244)..(244): n is a, c, g, or t
  modified_base (357)..(357): a, c, t, g, unknown or other
  misc_feature (357)..(357): n is a, c, g, or t
  modified_base (385)..(389): a, c, t, g, unknown or other
  misc_feature (385)..(389): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacngacttcactctcaccatcagcagactggaacctgaagactttgctacttttatttcngtcaccaagtatggtaggtcaccgtacacttttggccaggggaccaagctggagatcaagcgaactgtggctgcaccatctgtcttcatcttcccgccatctgatagtacgtnactgagtcgggctggcaagcgcaatagnnnnn

SEQ ID NO: 231036 - DNA, 387 bp, Homo sapiens
  misc_feature: GYAE6OF01BXKLE.13.11.A11.1.454.CMB.1.raw
  modified_base (241)..(241): a, c, t, g, unknown or other
  misc_feature (241)..(241): n is a, c, g, or t
  modified_base (352)..(352): a, c, t, g, unknown or other
  misc_feature (352)..(352): n is a, c, g, or t
  modified_base (379)..(387): a, c, t, g, unknown or other
  misc_feature (379)..(387): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagctttgctacttttattcngtcaccagtatggtaggtcaccgtacacttttggccaggggaccaagctggagatcaagcgaactgtggactgcaccatctgtcttcatctcccgcatctgatagtacgtnactgagcgggctggcaaggcgcatagnnnnnnnnn

SEQ ID NO: 231037 - DNA, 392 bp, Homo sapiens
  misc_feature: GYAE6OF01CQVRB.13.11.A11.1.454.CMB.1.raw
  modified_base (241)..(241): a, c, t, g, unknown or other
  misc_feature (241)..(241): n is a, c, g, or t
  modified_base (384)..(392): a, c, t, g, unknown or other
  misc_feature (384)..(392): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggagaccactgacatcccagacaggttcagtggcagtgggtctgggacagacttcactctcaccatcagcagactggaacctgaagactttgctactttatttcngtcacagtatggtaggtcaccgtactacttttggccaggggaccaagctggagatcaagcgaactgtggctgcaccatctgtcttcatccttcccgctatctgatagtacgtgactgacgcgggctggcaaggcgacagtagnnnnnnnnn

SEQ ID NO: 231038 - DNA, 386 bp, Homo sapiens
  misc_feature: GYAE6OF01A2RGY.13.11.A11.1.454.CMB.1.raw
  modified_base (381)..(386): a, c, t, g, unknown or other
  misc_feature (381)..(386): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagtactttgctacttttattctgtcaccagtatggtaggtcaccgtacacttttggccaggggaccaagctggagatcaagtgaactgtggctgcaccatctgtcttcatcttcccgccatctgatagtacgtgactgagcgggctggcaggcgcatagnnnnnn

SEQ ID NO: 231039 - DNA, 385 bp, Homo sapiens
  misc_feature: GYAE6OF01CRW7P.13.11.A11.1.454.CMB.1.raw
  modified_base (241)..(241): a, c, t, g, unknown or other
  misc_feature (241)..(241): n is a, c, g, or t
  modified_base (381)..(385): a, c, t, g, unknown or other
  misc_feature (381)..(385): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcacttttattcngtcaccagtatgtaggtcaccgtacacttttggccaggggaccaaagctggagatcaagcgaactgtggctgcaccatctgtcttcatcttcccgccatctgatagtacgtgaactgagcgggctggcaaggcgcatagnnnnn

SEQ ID NO: 231040 - DNA, 445 bp, Homo sapiens
  misc_feature: GYAE6OF01CBC0G.13.11.A11.1.454.CMB.1.raw
  modified_base (436)..(445): a, c, t, g, unknown or other
  misc_feature (436)..(445): n is a, c, g, or t
tcagtcacgtactacacgaccggtgctcgatttagctacgactgcagggccagtcagattgtcagcagcaactacttagcctggtaccagcagaagcctggccaggcccccaggcctcctcatctacgatgtattcaggaggaccactgacatcccagacaggttcagtggcaggtgggtctgggacagacttcactctcaccatcagcagactggaacctgaagtctttgctacttttatttctgtctaccagtagtggtaggtactaccgtactacgtttcggtccgacgggaccgaacgcgtggagagtacgaacgacgaacgtgtggcgtcgcaccactctcgttcttctaaaaaaaaaaaaactccttcccgtcctactctgtatacgtacgtacgtacgtgacggcgggcgtcggacgacggcgcatagnnnnnnnnnn

SEQ ID NO: 231041 - DNA, 391 bp, Homo sapiens
  misc_feature: GYAE6OF01BLDDV.13.11.A11.1.454.CMB.1.raw
  modified_base (383)..(383): a, c, t, g, unknown or other
  misc_feature (383)..(383): n is a, c, g, or t
  modified_base (385)..(391): a, c, t, g, unknown or other
  misc_feature (385)..(391): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagtactttgctacttttattctgtcaccagtatggtagtcaccgtacacttttggccaggggaccaagctggagatcaagcgaactgtggctgcaccatctgtcttcatcttcccgcatctgatagtacgtgactggagcgggctggactaaggcgcagtangnnnnnnn

SEQ ID NO: 231042 - DNA, 384 bp, Homo sapiens
  misc_feature: GYAE6OF01DDBH8.13.11.A11.1.454.CMB.1.raw
  modified_base (242)..(242): a, c, t, g, unknown or other
  misc_feature (242)..(242): n is a, c, g, or t
  modified_base (379)..(384): a, c, t, g, unknown or other
  misc_feature (379)..(384): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcacttttatttcngtcaccagtatggtaggtcaccgtacacttttggccaggggaccaagctgagatcaagcgaactgtggctgcaccatctgtcttcatcttcccgcatctgatagtacgtgactgagcgggctggcaaggcgcatagnnnnnn

SEQ ID NO: 231043 - DNA, 593 bp, Homo sapiens
  misc_feature: GYAE6OF01BK1RZ.13.11.A11.1.454.CMB.1.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccgagggagtccctccccagtttctcctgaggttcaggtcaaactcagataaacgacgagggctctggacgtccccagcccgcttctcgtggatccgaaggatgacttccgccaacgcgagggatattactcatcctgtcgggcctcgagtctgacgtatggaggtctgtaaccttatttacctggttttacgactttgggacaaccaaactaccggccttagggtacttccgttaccgggaccgtacggggaccctacggtcctacccggttacctagggtaccacggcccccaacgggtccccaaacccccgtctccgtacctaccttccgtcgttccccccg

SEQ ID NO: 231044 - DNA, 417 bp, Homo sapiens
  misc_feature: GYAE6OF01ENOBF.13.11.A11.1.454.CMB.1.raw
  modified_base (386)..(386): a, c, t, g, unknown or other
  misc_feature (386)..(386): n is a, c, g, or t
  modified_base (388)..(417): a, c, t, g, unknown or other
  misc_feature (388)..(417): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagtactttgctacttttattctagtcaccagtatggtagtcaccgtactacttttggccagggaccaagctggagatcaagcgaactggtgctgcacctatctgtcttcactcctccgcctatctgatagtacgtgactgagcgggctggactaaggcacatgangnnnnnnnnnnnnnnnnnnnnnnnnnnnnnn

SEQ ID NO: 231045 - DNA, 390 bp, Homo sapiens
  misc_feature: GYAE6OF01DV3EB.13.11.A11.1.454.CMB.1.raw
  modified_base (245)..(245): a, c, t, g, unknown or other
  misc_feature (245)..(245): n is a, c, g, or t
  modified_base (381)..(381): a, c, t, g, unknown or other
  misc_feature (381)..(381): n is a, c, g, or t
  modified_base (386)..(390): a, c, t, g, unknown or other
  misc_feature (386)..(390): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaacctgaagtactttgctacttttatttcngtcaccagtatggtaggtcaccgtacacttttggccaggggaccaagctggagatcaagcgaactgtggctgcaccatctgtcttcatccttcccgcctatctgattagtcgtgactggagcgggctggcaggcgnatagnnnnn

SEQ ID NO: 231046 - DNA, 391 bp, Homo sapiens
  misc_feature: GYAE6OF01CR8KJ.13.11.A11.1.454.CMB.1.raw
  modified_base (243)..(243): a, c, t, g, unknown or other
  misc_feature (243)..(243): n is a, c, g, or t
  modified_base (377)..(377): a, c, t, g, unknown or other
  misc_feature (377)..(377): n is a, c, g, or t
  modified_base (383)..(391): a, c, t, g, unknown or other
  misc_feature (383)..(391): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaacctgaagactttgcacttttatttcngtcaccagtatggtaggtcaccgtacacttttggccaggggaccaagctggagatcaagcgaacttgtggctgcaccatctgtcttcatcttcccgccatctgatagtacgtgactgagcgggctggcaaggcncatagnnnnnnnnn

SEQ ID NO: 231047 - DNA, 385 bp, Homo sapiens
  misc_feature: GYAE6OF01BHGN6.13.11.A11.1.454.CMB.1.raw
  modified_base (380)..(385): a, c, t, g, unknown or other
  misc_feature (380)..(385): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttattctgtcaccagtatggtaggtcaccgtacacttttggccaggggaccaagctggagatcaagcgaactgtggctgcaccatctgtcttcatcttcccgccatctgatagtacgtgactgagcgggctggcaaggcgcatagnnnnnn

SEQ ID NO: 231048 - DNA, 391 bp, Homo sapiens
  misc_feature: GYAE6OF01AHPNV.13.11.A11.1.454.CMB.1.raw
  modified_base (383)..(391): a, c, t, g, unknown or other
  misc_feature (383)..(391): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctacttttatttctgtcaccagtatggtaggtcaccgtacacttttggccaggggaccaagctggagatcaagcgaactgtggctgcaccatctgtcttcatcttcccgccatctgatagtacgtgactgagcgggctggcaaggcgcagtagnnnnnnnnn

SEQ ID NO: 231049 - DNA, 409 bp, Homo sapiens
  misc_feature: GYAE6OF01C1WXF.13.11.A11.1.454.CMB.1.raw
  modified_base (193)..(193): a, c, t, g, unknown or other
  misc_feature (193)..(193): n is a, c, g, or t
  modified_base (248)..(248): a, c, t, g, unknown or other
  misc_feature (248)..(248): n is a, c, g, or t
  modified_base (372)..(373): a, c, t, g, unknown or other
  misc_feature (372)..(373): n is a, c, g, or t
  modified_base (382)..(382): a, c, t, g, unknown or other
  misc_feature (382)..(382): n is a, c, g, or t
  modified_base (386)..(409): a, c, t, g, unknown or other
  misc_feature (386)..(409): n is a, c, g, or t
tcagtcacgtactacacgaccggtgctcgatttagctacgactgcagggccaggtcagattgtcagcagcaactacttagcctggtaccagcagaagcctggccaggcccccaggctcctcatctacgatgtattcaggaggaccactgacatcccagacaggttcagtggcagtgggtctgggacagacttnactctcaccatcgagcagacctggaacctggaacacttttgctacttttatttcngtcaccagtatggtagtcaccgttacacttttggccaggggaccaagctggagactcgaagcgaactggtggctgcacatctgtcttcatcttcccgcatctagatagacgtgactgagcgggnnggcaggcgnatgnnnnnnnnnnnnnnnnnnnnnnnn

SEQ ID NO: 231050 - DNA, 357 bp, Homo sapiens
  misc_feature: GYAE6OF01CNHO0.13.11.A11.1.454.CMB.1.raw
  modified_base (322)..(322): a, c, t, g, unknown or other
  misc_feature (322)..(322): n is a, c, g, or t
  modified_base (329)..(357): a, c, t, g, unknown or other
  misc_feature (329)..(357): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcacttttattctgtcaccagtatggaactgtgctgacacatctgtctcatcctcccgcatcctgtagtacgtgactgagcggctggcaaggcncatagannnnnnnnnnnnnnnnnnnnnnnnnnnnn

SEQ ID NO: 231051 - DNA, 527 bp, Homo sapiens
  misc_feature: GYAE6OF01ASH3K.13.11.A11.1.454.CMB.1.raw
  modified_base (392)..(392): a, c, t, g, unknown or other
  misc_feature (392)..(392): n is a, c, g, or t
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgcaacgcagggatattactcatctctggctccagtctgacgntgagctgactattactgtttgacttggcacaacaaccgcctggattcgttacggaccgtcgggacctacggtccaccgtccgtacggtcacgccccgaaggcccaaaccccgctcgtacacctcgtcgtcccccg

SEQ ID NO: 231052 - DNA, 406 bp, Homo sapiens
  misc_feature: GYAE6OF01CLWJZ.13.11.A11.1.454.CMB.1.raw
  modified_base (394)..(406): a, c, t, g, unknown or other
  misc_feature (394)..(406): n is a, c, g, or t
tcagtcacgtactacacgaccggtgctcgatttagctacgactgcagggccagtcagagtgttcccaacaactacttagcctggtaccagcaaaggcctggccaggctcccaggcgccctcatctatgctgcttccagtagggccactggcgtcccagacaggttcagtggcaggtgggtcgtgggacagacttcaccctcaccatcagcagacgtggagcctagaagtattttgcagttcttattactgtcagcagtatggtagaccgaaagacgttcggaccgaagggaccaaggtaggaaatacgaaaacgaactggtggctgcacatctgtcttcatctccgcatctgatagtacgtgactgaggcgggtctggcaaggcgctagtacgnnnnnnnnnnnnn

SEQ ID NO: 231053 - DNA, 401 bp, Homo sapiens
  misc_feature: GYAE6OF01D17YP.13.11.A11.1.454.CMB.1.raw
  modified_base (345)..(345): a, c, t, g, unknown or other
  misc_feature (345)..(345): n is a, c, g, or t
  modified_base (391)..(401): a, c, t, g, unknown or other
  misc_feature (391)..(401): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagtactttgactacttttattctgtcaccagtatggtaggtcaccgtactacttttggccaggggaccaagctggagatcaagcgaactgtggctgacaccatctgtcttcattcctcccgctntctgactagtacgtgactggacgcgggctggcaaggcgctagtagnnnnnnnnnnn

SEQ ID NO: 231054 - DNA, 392 bp, Homo sapiens
  misc_feature: GYAE6OF01DT2KA.13.11.A11.1.454.CMB.1.raw
  modified_base (386)..(392): a, c, t, g, unknown or other
  misc_feature (386)..(392): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaacctgaagactttgctacttttatttctgtcaccagtatggtaggtcaccgtacacttttggcctaggggaccaagctggagatcaagcgaactgtggctgcaccatctgtcttcatcttcccgccatctgatagtacgtgacgtgagtcgggctggcaaggcgcatagnnnnnnn

SEQ ID NO: 231055 - DNA, 385 bp, Homo sapiens
  misc_feature: GYAE6OF01DFSTT.13.11.A11.1.454.CMB.1.raw
  modified_base (342)..(342): a, c, t, g, unknown or other
  misc_feature (342)..(342): n is a, c, g, or t
  modified_base (381)..(385): a, c, t, g, unknown or other
  misc_feature (381)..(385): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctacttttatttctgtcaccagtatggtagtcaccgtactactttggccaggggaccaagctggagatcaaagcgaactgtggctgcacatctgtcttcatcttcccgcatcngatagtacgtgactgagcggctggccaaggcgacatagnnnnn

SEQ ID NO: 231056 - DNA, 423 bp, Homo sapiens
  misc_feature: GYAE6OF01BNMRT.13.11.A11.1.454.CMB.1.raw
  modified_base (322)..(322): a, c, t, g, unknown or other
  misc_feature (322)..(322): n is a, c, g, or t
  modified_base (404)..(423): a, c, t, g, unknown or other
  misc_feature (404)..(423): n is a, c, g, or t
tcagtcacgtactacacgaccggtgctcgatttagctacgactgcagggccagtcagattgtcagcagcaactacttagcctggtaccagcacgaagccctggccaggcccccaggctcctcatctacgatgtattcaggaggaccactgacatcccagacaggttcagtggcagtggtctgggacagacttcactctcaccatcagcagactggaacctgaagtctttgctacttttattctgtctaccagttatggtaaggtcaccggtacacttttggcctaggggacccaagccttaggagactcaaagcgtaactgngtctgcaccatcctggtccttcattccttcccgcctatcctgactagtacgtgaactgagcgggctggcaaggcgcatagcnnnnnnnnnnnnnnnnnnnn

SEQ ID NO: 231057 - DNA, 380 bp, Homo sapiens
  misc_feature: GYAE6OF01CF1QM.13.11.A11.1.454.CMB.1.raw
  modified_base (376)..(380): a, c, t, g, unknown or other
  misc_feature (376)..(380): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttattctgtcaccagtatggtagtcaccgtacacttttggccaggggaccaagctggagatcaagcgaactgtgctgcacatctgtcttcatcttcccgcatctgatagtacgtgactgagcgggctggcaaggcgcatagnnnnn

SEQ ID NO: 231058 - DNA, 387 bp, Homo sapiens
  misc_feature: GYAE6OF01BS5H8.13.11.A11.1.454.CMB.1.raw
  modified_base (378)..(387): a, c, t, g, unknown or other
  misc_feature (378)..(387): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcacttttattctgtcaccagtatggtaggtcaccgtacacttttggccaggggaccaagctggagatcaagcgaactgtggctgcaccatctgtcttcatctcccgcatctgatagtacgtgactgagcgggctggcaaggcgcatagnnnnnnnnnn

SEQ ID NO: 231059 - DNA, 396 bp, Homo sapiens
  misc_feature: GYAE6OF01B5PTW.13.11.A11.1.454.CMB.1.raw
  modified_base (339)..(339): a, c, t, g, unknown or other
  misc_feature (339)..(339): n is a, c, g, or t
  modified_base (388)..(396): a, c, t, g, unknown or other
  misc_feature (388)..(396): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagacttttgctacttttatttctgtcaccagtatggtaggtcaccgtactacttttggccaggggtaccaagctggagatcaagcgaactgtggctgcaccatctgtcttcatcttcncgcctatctgatgtacgtgactgagcgggtctgggcaaggcgacatagnnnnnnnnn

SEQ ID NO: 231060 - DNA, 401 bp, Homo sapiens
  misc_feature: GYAE6OF01ARSPA.13.11.A11.1.454.CMB.1.raw
  modified_base (387)..(401): a, c, t, g, unknown or other
  misc_feature (387)..(401): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggagaccactgacatcccagacaggttcagtggcagtgggtctgggacagacttcactctcaccatcagcagactggaacctgaagtctttgctacttttattctgtcaccagtatggtagtcaccgtactacttttggccgaggggaccaagctggagatcaagcgaactgtgctgcaccatctgtcttcatccttcccgctatctagatagtacgtgacgtgacgcggctggcgaaggcgactagtagnnnnnnnnnnnnnnn

SEQ ID NO: 231061 - DNA, 383 bp, Homo sapiens
  misc_feature: GYAE6OF01E1V36.13.11.A11.1.454.CMB.1.raw
  modified_base (294)..(294): a, c, t, g, unknown or other
  misc_feature (294)..(294): n is a, c, g, or t
  modified_base (379)..(383): a, c, t, g, unknown or other
  misc_feature (379)..(383): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcacttttattctgtcaccagtatggtaggtcaccgtacacttttggccaggggaccaagctgganatcaagcgaactgtggctgcacatctgtcttcatcttcccgccatctgatagtacgtgactgagcgggctggcaaggcgcatagnnnnn

SEQ ID NO: 231062 - DNA, 599 bp, Homo sapiens
  misc_feature: GYAE6OF01DNQ16.13.11.A11.1.454.CMB.1.raw
  modified_base (244)..(244): a, c, t, g, unknown or other
  misc_feature (244)..(244): n is a, c, g, or t
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttcggtccctatgacatatattggtaccganagaagccagggacgtccctcccagtttctcctgaggttcaggtcaaactcaagataaacgacgagggctcgtggacgtccccagccgccttctcgtggataccgaagatgacttcccgaccaacgcgaagggtattaagttactcacgttctcgtcgggcctccgagttcgtagacgtaagtcggacggtcttagtaacttagttacgttgttttacgacgtttcggacctaacaaacgtaaccgtcccgttaggacttcgttaccggacgttcgggaaccctacggtcctacccggtcgtacggtccacggccccaacggccccaaccctctacgtccactcgtccgtcccccg

SEQ ID NO: 231063 - DNA, 615 bp, Homo sapiens
  misc_feature: GYAE6OF01C8T6W.13.11.A11.1.454.CMB.1.raw
  modified_base (242)..(242): a, c, t, g, unknown or other
  misc_feature (242)..(242): n is a, c, g, or t
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttgtccctatgacatatattggtaccganaagaagccagggagtccctcccctagtttctcctgaggttcaggtcaaactcaagataaacgacagggctcgtggacgtccccagccgcttctctaggactaccgaaggatgacttccgaccaacgcagggatacttactcattctacgtgggcctccgtagtctagacgtatgacggctagacttatacgttggttttagacgtttggactaaacgaaccgtaaccggtccttgggtaacttccggttaccgggaccgttacggggaacccctacgggtcctaacccggtccgttaacgggtccaccggaccccgaaacgggcccccaaaccccgtacgttcgtaccaaccttccgttcccggttccccccg

SEQ ID NO: 231064 - DNA, 410 bp, Homo sapiens
  misc_feature: GYAE6OF01BMNOB.13.11.A11.1.454.CMB.1.raw
  modified_base (397)..(397): a, c, t, g, unknown or other
  misc_feature (397)..(397): n is a, c, g, or t
  modified_base (399)..(410): a, c, t, g, unknown or other
  misc_feature (399)..(410): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatccccagacaggttcagtggcagtgggtctgggacagacttcactctcaccatcagcagtctgcagtctgaagtattttgctagttttattactgtcagcagtataataactggcctccgtacatgtactacttttggccaggggaccaaccgtggagatcagacgaactgtggctgcacatctgtctcatccttcccgcatctgatagtacgtgactgagcggctggacgaacggcgacatagncnnnnnnnnnnnn

SEQ ID NO: 231065 - DNA, 338 bp, Homo sapiens
  misc_feature: GYAE6OF01BCR2V.13.11.A11.1.454.CMB.1.raw
  modified_base (325)..(325): a, c, t, g, unknown or other
  misc_feature (325)..(325): n is a, c, g, or t
  modified_base (331)..(338): a, c, t, g, unknown or other
  misc_feature (331)..(338): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttattctgtcaccagtatggaactgtggctgcaccatctgtctcatccttcccgcatctgatagtacgtgactgagcgggctggcaaggcncatagnnnnnnnn

SEQ ID NO: 231066 - DNA, 385 bp, Homo sapiens
  misc_feature: GYAE6OF01BNGHK.13.11.A11.1.454.CMB.1.raw
  modified_base (241)..(241): a, c, t, g, unknown or other
  misc_feature (241)..(241): n is a, c, g, or t
  modified_base (378)..(385): a, c, t, g, unknown or other
  misc_feature (378)..(385): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggagaccactgacatcccagacaggttcagtggcagtgggtctgggacagacttcactctcaccatcagcagactggaacctgaagactttgctacttttattcngtcaccagtatggtaggtcaccgtacacttttggccagggaccaagctggagatcaagcgaactgtggactgcaccatctgtcttcatctcccgcatctgatagtacgtgactgagcggctggctaggcgcatacgnnnnnnnn

SEQ ID NO: 231067 - DNA, 391 bp, Homo sapiens
  misc_feature: GYAE6OF01BOFO9.13.11.A11.1.454.CMB.1.raw
  modified_base (385)..(391): a, c, t, g, unknown or other
  misc_feature (385)..(391): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtgtcagtgggtctgggacagacttcactctcaccatcagcagactggaacctgaagtactttgctacttttattctgtcaccagtatggtaggtcaccgtactacttttggcctagggaccaagctggagatcaagcgaactggtaggctgcaccatctgtcttcatctcccgcatctgatagtacgtgactgagcgggctggcaaggcgtcagtagnnnnnnn

SEQ ID NO: 231068 - DNA, 404 bp, Homo sapiens
  misc_feature: GYAE6OF01D1SOO.13.11.A11.1.454.CMB.1.raw
  modified_base (390)..(404): a, c, t, g, unknown or other
  misc_feature (390)..(404): n is a, c, g, or t
tcagtcacgtactacacgaccggtgctcgattttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagtacttttgctacttttatttctgtcaccagtatggtaggtcaccgtacacttttgccaggggaccaagctggagagtcaagcgaactgtggctgcacatctgtcttcattccttcccgctatctgatagtacgtgactgagcgggctgggacaagggcgacatagnnnnnnnnnnnnnnn

SEQ ID NO: 231069 - DNA, 217 bp, Homo sapiens
  misc_feature: GYAE6OF01DGYZL.13.11.A11.1.454.CMB.1.raw
  modified_base (212)..(217): a, c, t, g, unknown or other
  misc_feature (212)..(217): n is a, c, g, or t
tcagtcacgtactacacgaccggtgctcgatttagctacgactgcaggggccagggaaccctggtcaccgtctcctctgcctccaccaagggcccatcggtcttcccctggcgccctgctccaggagcacctccgagagcacagcggccctgggatgcctggtcaaggactacttcctagtacgtgactgagcggctggcaaggcgcatagnnnnnn

SEQ ID NO: 231070 - DNA, 447 bp, Homo sapiens
  misc_feature: GYAE6OF01BAHE7.13.11.A11.1.454.CMB.1.raw
  modified_base (427)..(428): a, c, t, g, unknown or other
  misc_feature (427)..(428): n is a, c, g, or t
  modified_base (430)..(447): a, c, t, g, unknown or other
  misc_feature (430)..(447): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagacttttgctacttttatttctgtcaccagtatggtaggtcaccgtactacttttggccaggggaccaaagcgtaggagatacgaagcgaactggtggctgacaccattctgtcttctacttcccttcccgctacttctagacttacggtcgtacgtacgtggacggcgggtcgtagggaccgtaaagggccgacgtaagtaggnngnnnnnnnnnnnnnnnnnn

SEQ ID NO: 231071 - DNA, 400 bp, Homo sapiens
  misc_feature: GYAE6OF01C5VP1.13.11.A11.1.454.CMB.1.raw
  modified_base (295)..(296): a, c, t, g, unknown or other
  misc_feature (295)..(296): n is a, c, g, or t
  modified_base (298)..(298): a, c, t, g, unknown or other
  misc_feature (298)..(298): n is a, c, g, or t
  modified_base (301)..(301): a, c, t, g, unknown or other
  misc_feature (301)..(301): n is a, c, g, or t
  modified_base (306)..(307): a, c, t, g, unknown or other
  misc_feature (306)..(307): n is a, c, g, or t
  modified_base (377)..(400): a, c, t, g, unknown or other
  misc_feature (377)..(400): n is a, c, g, or t
tcagtcacgtactacacgaccggtgctcgatttagctacgactgcagggccagtcagattgtcagcagcaactacttagcctggtaccagcagaagcctggccaggcccccaggctcctcatctagatgtattcaggaggaccactgacatcccagacaggttcagtggcagtgggtctggggacagacttcactctcaccatcagcagactggaacctgaagactttgcacttttatttctgtcaccagtatggtaggtcaccgtacacttttggccagggaccaagctgagannangangtgcnncacatctctctcatctccgccactctgatagtacgtgtacgtgagcggcgtggacgacggcgcgagtagnnnnnnnnnnnnnnnnnnnnnnnn

SEQ ID NO: 231072 - DNA, 404 bp, Homo sapiens
  misc_feature: GYAE6OF01AUZC5.13.11.A11.1.454.CMB.1.raw
  modified_base (225)..(225): a, c, t, g, unknown or other
  misc_feature (225)..(225): n is a, c, g, or t
  modified_base (308)..(308): a, c, t, g, unknown or other
  misc_feature (308)..(308): n is a, c, g, or t
  modified_base (378)..(378): a, c, t, g, unknown or other
  misc_feature (378)..(378): n is a, c, g, or t
  modified_base (389)..(389): a, c, t, g, unknown or other
  misc_feature (389)..(389): n is a, c, g, or t
  modified_base (395)..(404): a, c, t, g, unknown or other
  misc_feature (395)..(404): n is a, c, g, or t
tcagtcacgtactacacgaccggtgctcgatttagctacgactgcagggccagtcagattgtcagcagcaactacttagcctggtaccagcagaaacgtggccaggctcccaggctcctcatctatggtgcatccaccagggccactggtatcccagaccggttcagtggcagtgggtctgggacagacttcactctcaccatcagcagtctgcagtctgaagtnttttgctagttttattactgtcagcagtataataactggcctccgtacatgtactacttttggccaggggaccaaccgtgganatcagacgaactgtggctgcaccatctgtcttcattcctcccgcatctgatagtacgtgactgagcgggntgggcaaggcncatagnnnnnnnnnn

SEQ ID NO: 231073 - DNA, 382 bp, Homo sapiens
  misc_feature: GYAE6OF01ALYFD.13.11.A11.1.454.CMB.1.raw
  modified_base (373)..(373): a, c, t, g, unknown or other
  misc_feature (373)..(373): n is a, c, g, or t
  modified_base (379)..(382): a, c, t, g, unknown or other
  misc_feature (379)..(382): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttatttctgtcaccagtatggtaggtcaccgtacacttttggccaggggaccaagctggagatcaagcgaactgtggctgcaccatctgtcttcatcttcccgccatctgtagtacgtgactgagcgggctggcaaggcncatagnnnn

SEQ ID NO: 231074 - DNA, 397 bp, Homo sapiens
  misc_feature: GYAE6OF01BQ9MU.13.11.A11.1.454.CMB.1.raw
  modified_base (345)..(345): a, c, t, g, unknown or other
  misc_feature (345)..(345): n is a, c, g, or t
  modified_base (386)..(387): a, c, t, g, unknown or other
  misc_feature (386)..(387): n is a, c, g, or t
  modified_base (389)..(397): a, c, t, g, unknown or other
  misc_feature (389)..(397): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagtactttgctacttttatttctgtcaccagtatggtaggtcaccgtacacttttggccaggggaccaagctggagatcaagcgaactgtggctgcaccatctgtcttcatctcccgccatctnatagtacgtgactgagcgggctcgggcaagggcgcagtagnnannnnnnnnn

SEQ ID NO: 231075 - DNA, 394 bp, Homo sapiens
  misc_feature: GYAE6OF01DO7ST.13.11.A11.1.454.CMB.1.raw
  modified_base (311)..(311): a, c, t, g, unknown or other
  misc_feature (311)..(311): n is a, c, g, or t
  modified_base (387)..(394): a, c, t, g, unknown or other
  misc_feature (387)..(394): n is a, c, g, or t
tcagtcacgtactacacgaccggtgctcgatttagctacgactgcagggccaggtcagattgtcagcagcaactacttagcctggtaccagcagaagcctggccaggcccccaggctcctcatctacgatgtattcaggaggaccactgacatcccagacaggttcagtggcagtggtctgggacagacttcactctcaccatcagcagactggaacctgaagactttgctacttttattctgtcaccagtatggtaggtctaccgtactacgttttggccagggtaccaagctggagatcaagcgaatgngctgcacatctgtcttcactcttcccgctatctgatagtacgtgactgagtcgggactggacaaggcgacagtagnnnnnnnn

SEQ ID NO: 231076 - DNA, 818 bp, Homo sapiens
  misc_feature: GYAE6OF01CEAQ2.13.11.A11.1.454.CMB.1.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatagttggtaccgacagaagccgagggacgtccctcccctagtttctcctgacggttcaggtacaaactcaagaactaaacgacgagggctcgtaggacgtccccagcccgtcttctcgtggactaccgaaaggtactcgtaacgtttcccgaccgtaaacggacgtaaggggtaacttaacgtttacctacctaagtttcccttaccggttcgggggtacccctttacccggtacggttaccgtttacggaaacgggtagttacgggacgggtaccttacggtaacctttaaacgttttacgtttggtttttacggtaaccgttttacgggacctaaaccgtaaaaccgtaaccgggtacccgtttacgggtaaactttacccggttttacccggggaacccgttacccgggggtaaacccccgtaccgggttaaccccgtaccccggttacccggtttaacggggtaaccccgtaaccgggtaccccccggtaaaacccggggtacccccccctaaaacccccgttacgttaccccggttaacccctaacccgttttccccggttaccccggttttaccccccccgg

SEQ ID NO: 231077 - DNA, 397 bp, Homo sapiens
  misc_feature: GYAE6OF01DOYY3.13.11.A11.1.454.CMB.1.raw
  modified_base (384)..(384): a, c, t, g, unknown or other
  misc_feature (384)..(384): n is a, c, g, or t
  modified_base (390)..(397): a, c, t, g, unknown or other
  misc_feature (390)..(397): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctggggacagacttcactctcaccatcagcagactggaacctgaacgactttgctacttttatttctgtcaccagtatggtagtcaccgtactacttttggccaggggaccaagcgtggagatcaagcgaactgtggctgacaccatctgtcttcactccttcccgctatctgatagtacgtgactgagcgggtctggcaaggcanagtagnnnnnnnn

SEQ ID NO: 231078 - DNA, 388 bp, Homo sapiens
  misc_feature: GYAE6OF01CYNAV.13.11.A11.1.454.CMB.1.raw
  modified_base (379)..(388): a, c, t, g, unknown or other
  misc_feature (379)..(388): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttatttctgtcaccagtatggtagtcaccgtacacttttggccaggggaccaagctggagatcaagcgaactgtggctgcaccatctgtcttcatcttcccgctatctgatagtacgtgactgagcgggctggcaaggcgcatagnnnnnnnnnn

SEQ ID NO: 231079 - DNA, 518 bp, Homo sapiens
  misc_feature: GYAE6OF01BFZT6.13.11.A11.1.454.CMB.1.raw
  modified_base (482)..(482): a, c, t, g, unknown or other
  misc_feature (482)..(482): n is a, c, g, or t
  modified_base (484)..(518): a, c, t, g, unknown or other
  misc_feature (484)..(518): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtgcaggtgggtctgggacagacttcactctcaccatcagcagactggaacctgaagtactttgctacttttatttctgtaccacctagttagtggtaggtcaccgttactacgttttggccgaggggaccaaggctggagtatcgaagcgaacttggtacggcttcgacctaacccatttccgttaggttcctttaccaactttcccgtttacccccgacctaacttccgttagtaattaacggttaccgtagtaaccgttgggaacgggtccgggtacgtcggggaacctaaacgggccgtacgaagttaacgngnnnnnnnnnnnnnnnnnnnnnnnnnnnnnnnnnnn

SEQ ID NO: 231080 - DNA, 387 bp, Homo sapiens
  misc_feature: GYAE6OF01B9PZG.13.11.A11.1.454.CMB.1.raw
  modified_base (378)..(378): a, c, t, g, unknown or other
  misc_feature (378)..(378): n is a, c, g, or t
  modified_base (383)..(387): a, c, t, g, unknown or other
  misc_feature (383)..(387): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaacctgaagacttttgctacttttattctgtcaccagtatggtaggtcaccgtacacttttggccaggggaccaagctggagatcaagcgaactgtggctgcaccatctgtcttcatcttcccgccatctgatagtacgtgactgagcgggctggcaaggcgnatagnnnnn

SEQ ID NO: 231081 - DNA, 385 bp, Homo sapiens
  misc_feature: GYAE6OF01DSOGA.13.11.A11.1.454.CMB.1.raw
  modified_base (242)..(242): a, c, t, g, unknown or other
  misc_feature (242)..(242): n is a, c, g, or t
  modified_base (353)..(353): a, c, t, g, unknown or other
  misc_feature (353)..(353): n is a, c, g, or t
  modified_base (375)..(375): a, c, t, g, unknown or other
  misc_feature (375)..(375): n is a, c, g, or t
  modified_base (380)..(385): a, c, t, g, unknown or other
  misc_feature (380)..(385): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggacggaccactgacatcccagacaggttcagtggcagtgggtctgggacagacttcactctcaccatcagcagactggaacctgaagactttgctactttattcngtcaccagtatggtagtcaccgtactactttggcagggaccaagctggagatcaagcgaactgtggactgcaccatctgtcttcatccttcccgctatctgatagtacgtnactgagtcggctggcaaggcgnatagnnnnnn

SEQ ID NO: 231082 - DNA, 699 bp, Homo sapiens
  misc_feature: GYAE6OF01AZ7WA.13.11.A11.1.454.CMB.1.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttcgtcctatgacatatattcggtaccgacagaacgccgagggactccctccctagtttcctccgtggacggttcaggtacaaactcgaagaataaaccgacgagggtcctacgtacggacctccccgagtccgtactttcgtcgtaggactaccgaaaggtctacgacttcccgacgaacgcgaagggtattaacgtactcacttcgtacgtcgggtcctacgtacggtctaggaacgtagtacggacggtacttagtaccttagtttacgtgtttacgtacgttacggaacctaacgaaaccgtaccgtccgttaggttaccgttaccggttacccgggtacccgtaccgggaacccgttaccgggttcccgtaacccggttaccggtaacgggtacccgaaccggacccccggtaaccggaccccctaaaacccccgtcgttaacccgtaccccgtaccttcccgttaccccgttaccccccg

SEQ ID NO: 231083 - DNA, 402 bp, Homo sapiens
  misc_feature: GYAE6OF01EED5G.13.11.A11.1.454.CMB.1.raw
  modified_base (222)..(222): a, c, t, g, unknown or other
  misc_feature (222)..(222): n is a, c, g, or t
  modified_base (387)..(402): a, c, t, g, unknown or other
  misc_feature (387)..(402): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggagaccactgacatcccagacaggttcagtggcagtgggtctgggacagacttcactctcaccatcagcagactggaacctgaanactttgctacttttattctgtcacctagtatggtagtcaccgtacacttttggcctaggggaccaagctggagtatcaagcgaactgtgctgcaccgatcgtgtcttcatcttcccgcatctgattacgtacgtgactgagtcgggctggcaaggtcgcagtagnnnnnnnnnnnnnnnn

SEQ ID NO: 231084 - DNA, 392 bp, Homo sapiens
  misc_feature: GYAE6OF01BXSPK.13.11.A11.1.454.CMB.1.raw
  modified_base (376)..(376): a, c, t, g, unknown or other
  misc_feature (376)..(376): n is a, c, g, or t
  modified_base (382)..(392): a, c, t, g, unknown or other
  misc_feature (382)..(392): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagtctttgctacttttatttctgtcaccagtatggtaggtcaccgtacacttttggccaggggaccaagctggagatcaagcgaatgtggctgcacatctgtcttcactcttcccgccatctgatagtacgtgactgagcgggctggcaaggcgnagtagnnnnnnnnnnn

SEQ ID NO: 231085 - DNA, 389 bp, Homo sapiens
  misc_feature: GYAE6OF01BSF9R.13.11.A11.1.454.CMB.1.raw
  modified_base (381)..(389): a, c, t, g, unknown or other
  misc_feature (381)..(389): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagcctcgagcctgaagattttgcagcttattactgtcagcagctagcaactggcctccggccctttcggcggagggaccaaggtcggagatcaaacgaactgtggctgcaccatctgtcttcatcttccgccatctgatagtacgtgactgagcgggctggcaaggcgcatagnnnnnnnnn

SEQ ID NO: 231086 - DNA, 845 bp, Homo sapiens
  misc_feature: GYAE6OF01CE5ZN.13.11.A11.1.454.CMB.1.raw
  modified_base (182)..(182): a, c, t, g, unknown or other
  misc_feature (182)..(182): n is a, c, g, or t
tcagtcacgtactacacgaccggtgctcgatttagctacgactgcaggggtcgtggggagaggagccccagccctgagattcccaggtgtttccattcagtgatcagcactgaacacagaggactcaccatggagttgggactgagctggtattttccgttttggcttaattttaaaaggtntccagtgtgaagtgcagctgggtgagtcgtgggggaggtcttgggtacgagccgtgggccacgggtccccgtggacgtacctcctccgttgtcgccagtccctcgtggtacttctatttcgtttagaacttagtaatttacgtcggtcctaagttcggaccgtaccggttccggggtacccggtacgaacggtcccgtacccgggaagggggaaccgggtccggtaggggtacgggttcggggtactacggtaaggtttaagtttaacgggttaaggtaaagttaggttaaggttaaactaaggttaacggtacttaggtcggaccggtacttcggttagggtaacgggaaccgggtccttaaccttccgaaacccttcgtaccctaaccggaaacgtaaccgaaacccgaacccggaacctaaacgtaacccctttcccgtagtttaacctcgttaagaacctaaagtaccgaaaccgtagttacggttacggaacggtacgtacggttacgggaaaccgggtaccgttacccgggttaccgtttaacgtttaacgttttacggtacgggttaaccggtaaaacccggtttaaaaaccggttaccccgtttaagtttaaccgggacggtttaacggggttccgggttcccgtttacccgggg

SEQ ID NO: 231087 - DNA, 424 bp, Homo sapiens
  misc_feature: GYAE6OF01CU0AT.13.11.A11.1.454.CMB.1.raw
  modified_base (341)..(341): a, c, t, g, unknown or other
  misc_feature (341)..(341): n is a, c, g, or t
  modified_base (356)..(356): a, c, t, g, unknown or other
  misc_feature (356)..(356): n is a, c, g, or t
  modified_base (360)..(360): a, c, t, g, unknown or other
  misc_feature (360)..(360): n is a, c, g, or t
  modified_base (386)..(424): a, c, t, g, unknown or other
  misc_feature (386)..(424): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggagaccactgacatcccagacaggttcagtggcagtgggctgggacagacttcactctcaccatcagcagactggaacctgaagacttttgctactttagttctagtcaccagtatggtaaggtcaccgtcacgttttgccaggggaccaagctgagatcaagcgaacttgcggctgcaccatcctgtactcatcttcccgcanctgatagtctgactnacgngggctggacaaggcgcttagagcagnnnnnnnnnnnnnnnnnnnnnnnnnnnnnnnnnnnnnnn

SEQ ID NO: 231088 - DNA, 403 bp, Homo sapiens
  misc_feature: GYAE6OF01CQ9MJ.13.11.A11.1.454.CMB.1.raw
  modified_base (241)..(241): a, c, t, g, unknown or other
  misc_feature (241)..(241): n is a, c, g, or t
  modified_base (375)..(375): a, c, t, g, unknown or other
  misc_feature (375)..(375): n is a, c, g, or t
  modified_base (391)..(403): a, c, t, g, unknown or other
  misc_feature (391)..(403): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagtctttgctactttattcngtcaccagtatggtaggtcaccgtactacttttaggccaggggaccaagcgtaggagatcaagcgaacgtgtggctgcaccatctgtcttcacgttccttcccgcctatctgatagtacgtgaactgagcgggntggcaaggcgcatagnnnnnnnnnnnnn

SEQ ID NO: 231089 - DNA, 415 bp, Homo sapiens
  misc_feature: GYAE6OF01AV3MU.13.11.A11.1.454.CMB.1.raw
  modified_base (394)..(394): a, c, t, g, unknown or other
  misc_feature (394)..(394): n is a, c, g, or t
  modified_base (397)..(397): a, c, t, g, unknown or other
  misc_feature (397)..(397): n is a, c, g, or t
  modified_base (400)..(415): a, c, t, g, unknown or other
  misc_feature (400)..(415): n is a, c, g, or t
tcagtcacgtactacacgaccggtgctcgatttagctacgactgcagggccagtcagattgtcagcagcaactacttagcctggtaccagcagaagcctggccaggcccccaggcctcctcatctacgatgtattcaggaggaccactgacatcccagacaggttcagtggcagtgggtctgggacagacttcactctcaccatcagcagactggaacctgaagtctttgactacttttattctgtcaccagtatggtaggtcaccgtacacttttggccaggggaccaagctggagatcaagcgaacgtgtggctgcaccatctgtcttacactcttcccgctatctgatagtacgtgactggacgcgggcgtacggcagggtcgcagtacgngcntgnnnnnnnnnnnnnnnn

SEQ ID NO: 231090 - DNA, 382 bp, Homo sapiens
  misc_feature: GYAE6OF01E1Y1E.13.11.A11.1.454.CMB.1.raw
  modified_base (266)..(266): a, c, t, g, unknown or other
  misc_feature (266)..(266): n is a, c, g, or t
  modified_base (291)..(291): a, c, t, g, unknown or other
  misc_feature (291)..(291): n is a, c, g, or t
  modified_base (371)..(371): a, c, t, g, unknown or other
  misc_feature (371)..(371): n is a, c, g, or t
  modified_base (374)..(382): a, c, t, g, unknown or other
  misc_feature (374)..(382): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctacttttattctgtcaccagtatggtagtcacgtanacttttggcagggaccaagctgganatcaagcgaactgtggctgcacatctgtcttcatcttcccgccatctgatagtacgtagactgagcggctaggcaaggcnatnnnnnnnnn

SEQ ID NO: 231091 - DNA, 411 bp, Homo sapiens
  misc_feature: GYAE6OF01D8CGQ.13.11.A11.1.454.CMB.1.raw
  modified_base (392)..(392): a, c, t, g, unknown or other
  misc_feature (392)..(392): n is a, c, g, or t
  modified_base (394)..(411): a, c, t, g, unknown or other
  misc_feature (394)..(411): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagtctttgctacttttattctgtcaccagtatggtagtcaccgtactacttttggccaggggaccaagctaggagattaagcgtaactgtgctgcacatctgtcttcatccttcccgctatctagattacgtactgactggagtcgggctgggacgaggccgacagtagcngnnnnnnnnnnnnnnnnnn

SEQ ID NO: 231092 - DNA, 529 bp, Homo sapiens
  misc_feature: GYAE6OF01DM9L1.13.11.A11.1.454.CMB.1.raw
  modified_base (183)..(183): a, c, t, g, unknown or other
  misc_feature (183)..(183): n is a, c, g, or t
  modified_base (200)..(200): a, c, t, g, unknown or other
  misc_feature (200)..(200): n is a, c, g, or t
  modified_base (250)..(250): a, c, t, g, unknown or other
  misc_feature (250)..(250): n is a, c, g, or t
  modified_base (481)..(481): a, c, t, g, unknown or other
  misc_feature (481)..(481): n is a, c, g, or t
  modified_base (483)..(483): a, c, t, g, unknown or other
  misc_feature (483)..(483): n is a, c, g, or t
  modified_base (487)..(487): a, c, t, g, unknown or other
  misc_feature (487)..(487): n is a, c, g, or t
  modified_base (489)..(489): a, c, t, g, unknown or other
  misc_feature (489)..(489): n is a, c, g, or t
  modified_base (491)..(491): a, c, t, g, unknown or other
  misc_feature (491)..(491): n is a, c, g, or t
  modified_base (493)..(493): a, c, t, g, unknown or other
  misc_feature (493)..(493): n is a, c, g, or t
  modified_base (495)..(496): a, c, t, g, unknown or other
  misc_feature (495)..(496): n is a, c, g, or t
  modified_base (498)..(508): a, c, t, g, unknown or other
  misc_feature (498)..(508): n is a, c, g, or t
  modified_base (510)..(514): a, c, t, g, unknown or other
  misc_feature (510)..(514): n is a, c, g, or t
  modified_base (516)..(529): a, c, t, g, unknown or other
  misc_feature (516)..(529): n is a, c, g, or t
tcagtcacgtactacacgaccggtgctcgatttagctacgactgctagggccagtcagattgtcagcagcaactacttagcctggtaccagcagaagccctggccaggcccccaggctcctcatctagatgtattcgaggagaccactgacatcccagactaggttcagtggcaggtgggtcngggacagacttcactcncaccagtcaagcagtactggaacctgaatactttgactacttttattcgntacaccagtatggtagtcaccgtactactttggccgaggggacaagcctaggagaatcgaaagtcaaacgtgtaggctaggccaaccatccgtgttccttacaattcccttaccccggacctatttcccgtacgtaagttaacggttaaccgttggaaacccgttgggaaccggttccggggacttacggggaaccccaaaagggtccccgacgaaagttaggactagganangagnanananannannnnnnnnnnngnnnnngnnnnnnnnnnnnnn

SEQ ID NO: 231093 - DNA, 391 bp, Homo sapiens
  misc_feature: GYAE6OF01EJ5GK.13.11.A11.1.454.CMB.1.raw
  modified_base (367)..(367): a, c, t, g, unknown or other
  misc_feature (367)..(367): n is a, c, g, or t
  modified_base (384)..(391): a, c, t, g, unknown or other
  misc_feature (384)..(391): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctacttttattctgtcaccagtatggtaggtcaccatactactttggccaggggaccaagctggagatcaagcgaactgtggctgcaccatctgtctcatcttcccgcatctgatacgtacgtgactgaggcgggtcngggcaaggcgacatagnnnnnnnn

SEQ ID NO: 231094 - DNA, 399 bp, Homo sapiens
  misc_feature: GYAE6OF01AFV2N.13.11.A11.1.454.CMB.1.raw
  modified_base (385)..(385): a, c, t, g, unknown or other
  misc_feature (385)..(385): n is a, c, g, or t
  modified_base (388)..(399): a, c, t, g, unknown or other
  misc_feature (388)..(399): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcaggtgggtctgggacagacttcactctcaccatcagcagactggaacctgaagtacttttgctacttttattctgtcaccagtatggtagtcaccgtactacttttggccaggggaccaagcgtggagatcaagcgaactgtggctgcacctatctgtcttcactcttcccgcctatctgtatagtacgtgtactgagcggctggacaggtcgnatnnnnnnnnnnnn

SEQ ID NO: 231095 - DNA, 521 bp, Homo sapiens
  misc_feature: GYAE6OF01D7GKE.13.11.A11.1.454.CMB.1.raw
  modified_base (495)..(521): a, c, t, g, unknown or other
  misc_feature (495)..(521): n is a, c, g, or t
tcagtcacgtactacacgaccggtgctcgatttagctacgactgcagggccagtcagattgtcagcagcaactacttagcctggtaccagcagaagccctggccaggcccccaggctcctcatctacgatgtattcgaggaggaccactgacatcccagacaggttcagtggcaggtgggtctgggacagtaccttcactctcaccatccagcagactaggaacctagaacgtctttgacttactttttagttctgtacctactagtagtggttacggtctaccgtacttacgtttggaccgaggggtaacccaaggtccgtaggaagtagtaccgaaagcgtaaacgtggtacggtctcgacctaccgtattccgttatcctttactaccgtttccgtaccccgtctacttcgtacgtacttacggtaacgttcgtaccgtaggaccgggtccgggtacgtcgggaccgtaagggacctacgtaatacggcagnnnnnnnnnnnnnnnnnnnnnnnnnnn

SEQ ID NO: 231096 - DNA, 835 bp, Homo sapiens
  misc_feature: GYAE6OF01BU3F6.13.11.A11.1.454.CMB.1.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtccttccctctctcgcttctccgtggagcgtcacgcctagtcctcacctcgcctaccgttgcgcgaggtcggaccaacctaagttcggtttcggtacccttagtacgaactattattacgttacggtaaccgaacgaaggaacggaccggaacgggtaccgtccctacccgttacgtttcctccgtaggtacggttacgaacggtaactaaaccgtacgaaacggtaaacgtaaaaccggacggtaacgggtacctacggtaccgggtacccgttaccccgacggtcccgttccgtttaccgttaccgttacgggaacttaaccggaagtacgttaccggtaaccgttaccccggaaccgaacggtaaccggtaacgggttaatttaaccttaaccgtacttacgttccggttccgttcggggtacccttaccgtacggtccgttaacggacggttaagtcgggtaacgtcgttaacgttaacttttacgtttacggtttgttttaccggtacggttacgaaccaaacgtaaccggtaccggtccgttacggttaacgttcccggttaaccggacggtaccggacccgttaccgcccgttacccgtagtaccggactaaacccggcccggaccgaaccccctaacccgttggtaccctaccgtaccgtttcccgttccccgtacccccg

SEQ ID NO: 231097 - DNA, 409 bp, Homo sapiens
  misc_feature: GYAE6OF01DB58O.13.11.A11.1.454.CMB.1.raw
  modified_base (329)..(329): a, c, t, g, unknown or other
  misc_feature (329)..(329): n is a, c, g, or t
  modified_base (341)..(341): a, c, t, g, unknown or other
  misc_feature (341)..(341): n is a, c, g, or t
  modified_base (397)..(409): a, c, t, g, unknown or other
  misc_feature (397)..(409): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagtactttgctacttttattctgtcacctagtatggtacgtcaccgtactactttggcctaggggaccaagcgtaggagatcaagcgaacgtgtggctgacacatctntcttcatcttcngtcctatctgtatagtacgtgtactgaggcgggtctcgggcgaaggtcgacatagnnnnnnnnnnnnn

SEQ ID NO: 231098 - DNA, 406 bp, Homo sapiens
  misc_feature: GYAE6OF01DHANW.13.11.A11.1.454.CMB.1.raw
  modified_base (244)..(244): a, c, t, g, unknown or other
  misc_feature (244)..(244): n is a, c, g, or t
  modified_base (396)..(406): a, c, t, g, unknown or other
  misc_feature (396)..(406): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagtactttgctacttttatttcngtcaccagtatggtaggtcaccgtactacttttggccgtaggggaccaagcgtaggagtatcaagcgaacgtgtggctgcacctatctgtcttcatcttcccgctatctgtatagtacgtgacgtgacgcgggctggctaaggcgacatagnnnnnnnnnnn

SEQ ID NO: 231099 - DNA, 397 bp, Homo sapiens
  misc_feature: GYAE6OF01C201T.13.11.A11.1.454.CMB.1.raw
  modified_base (389)..(397): a, c, t, g, unknown or other
  misc_feature (389)..(397): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctggggacagacttcactctcaccatcagccagactggaaccctgaagacttttgctacttttattctgtcaccagtatggtaggtcaccgtacacttttggcctagggaccaagcgtggagatcaagcgaactgtggctgcaccatctgtcttcatcttcccgctatctgatacgtcgtgacttgagcgggctggactaggcgacatagnnnnnnnnn

SEQ ID NO: 231100 - DNA, 664 bp, Homo sapiens
  misc_feature: GYAE6OF01AGHDS.13.11.A11.1.454.CMB.1.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgccttctcctggagcgtcagccagtctcacctgcaccttgcgcagtggcaccaatgttgtcctatgacatatattggtaccgacagaacgccagggacgtcctccctagtttctccgtagacggttcaggtacaaactcaagataaacgacgagggtctcgtaggacgtccccagccgtcttctcgtacggactaccgaaggtatacgacttcccgaccaacggcgaagggaacttaacttactactactacgtcgtagggccttaccgacgttcgtacgaccggtagtcggaacggcttacgtaacttagtttacgttggtttacgtacgttcggaactaaccaaccgtaaccgcgttaggtacttccgttacccgggacgtaccggggtaacctccgggtaccctacccggtacccgttacgggtaccaccggtaccccgaaaccgggaccccctaaaccccgtcgttaccgaccttacccgttcccgttcccgttaccccccg

SEQ ID NO: 231101 - DNA, 563 bp, Homo sapiens
  misc_feature: GYAE6OF01D40MY.13.11.A11.1.454.CMB.1.raw
  modified_base (525)..(525): a, c, t, g, unknown or other
  misc_feature (525)..(525): n is a, c, g, or t
  modified_base (529)..(563): a, c, t, g, unknown or other
  misc_feature (529)..(563): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggagaccactgacatcccagacaggttcagtggcagtgggtctgggacagacttcactctcaccatcagcagactggaacctgaagtctttgacttacttttattctgtcaccagtatggtagtcaccgttactacgttttcggaccgtaggggacctaaggccgtagggaagtacgttacgaaacggaccgtaacttcgggtacggcgttacggccaaccctaagttccttcggttacctttaccgtaacctttcccgtttacccccggtcctacgtttccgttacggtaacgtttaacgggttaaccgttcggtaaccgttacgggaccgggtaccggggtccgttacggggaccgtaaacgggaccgtaccgtaaagttaggcgntcgnnnnnnnnnnnnnnnnnnnnnnnnnnnnnnnnnnn

SEQ ID NO: 231102 - DNA, 389 bp, Homo sapiens
  misc_feature: GYAE6OF01AXODL.13.11.A11.1.454.CMB.1.raw
  modified_base (381)..(389): a, c, t, g, unknown or other
  misc_feature (381)..(389): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggagaccactgacatcccagacaggttcagtggcagtgggtctgggacagacttcactctcaccatcagcagactggaacctgaagactttgcacttttattctgtcaccagtatggtagtcaccgtacacttttggcctaggggaccaagctggagatcaagcgaactgtggctgcaccatctgtcttcatcttccgccaatctcgatagtacgtgactgaggcgggctggcaaggcgcatagnnnnnnnnn

SEQ ID NO: 231103 - DNA, 432 bp, Homo sapiens
  misc_feature: GYAE6OF01DG38J.13.11.A11.1.454.CMB.1.raw
  modified_base (242)..(242): a, c, t, g, unknown or other
  misc_feature (242)..(242): n is a, c, g, or t
  modified_base (368)..(368): a, c, t, g, unknown or other
  misc_feature (368)..(368): n is a, c, g, or t
  modified_base (405)..(432): a, c, t, g, unknown or other
  misc_feature (405)..(432): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggagaccactgacatcccagacaggttcagtgcagtgggtctgggacagacttcactctcaccatcagcagactggaacctgaagtactttgctacttttatttcngtcaccagtatggtaggtcaccgtactacgttttcggccgtaggggaccaaagtctaggagatcgaaagccgaactgtaggctgcaccatctgtcttcactcttcccgctatcttgtacgtacgtnacgtgacggcgggcgtgggaccaaggcgacgaatcgnnnnnnnnnnnnnnnnnnnnnnnnnnnn

SEQ ID NO: 231104 - DNA, 445 bp, Homo sapiens
  misc_feature: GYAE6OF01C49BN.13.11.A11.1.454.CMB.1.raw
  modified_base (344)..(344): a, c, t, g, unknown or other
  misc_feature (344)..(344): n is a, c, g, or t
  modified_base (436)..(445): a, c, t, g, unknown or other
  misc_feature (436)..(445): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtggtcgtgggacagacttcactctcacccatcagcagactggaaccttgaagtacttttgctacttttatttcctgtcacctagttagtggtaggtccaaccgttactacttttggccaggggacccaaggctgggagtatacgaagcgaactgtggctggcaccatcgtntcttcacgttccttcccgcctatttctaggtacttagtaccggtgaaccgtggacggtcggggtacctgggaccgtaagggcgcaagttgannnnnnnnnn

SEQ ID NO: 231105 - DNA, 397 bp, Homo sapiens
  misc_feature: GYAE6OF01BRPOT.13.11.A11.1.454.CMB.1.raw
  modified_base (388)..(397): a, c, t, g, unknown or other
  misc_feature (388)..(397): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaacctgaagactttgctacttttattctgtcaccagtatggtagtcaccgtacacttttggccaggggaccaagctaggagatcgaagcgaactgtggctgcacatctgtcttcatccttcccgcctatctgatacgtacgtgactggagcgggcgtggcaaggcgcagtagnnnnnnnnnn

SEQ ID NO: 231106 - DNA, 417 bp, Homo sapiens
  misc_feature: GYAE6OF01BIZDF.13.11.A11.1.454.CMB.1.raw
  modified_base (238)..(238): a, c, t, g, unknown or other
  misc_feature (238)..(238): n is a, c, g, or t
  modified_base (320)..(320): a, c, t, g, unknown or other
  misc_feature (320)..(320): n is a, c, g, or t
  modified_base (400)..(417): a, c, t, g, unknown or other
  misc_feature (400)..(417): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtgcagtgggtctgggacagacttcactctcaccatcagcagactggaacctgaatctttgctatttattcngtcacctagtatggtagtcaccgtactacttttggcctaggggtaccaagcgtggagatcaagcgaactgtggctgcacatntgtcttcattccttcccgcctactctacgtatacgtacgtgtaacttggacgcgggctgggccgaaggccgcgaatagcnnnnnnnnnnnnnnnnnn

SEQ ID NO: 231107 - DNA, 424 bp, Homo sapiens
  misc_feature: GYAE6OF01BTFJN.13.11.A11.1.454.CMB.1.raw
  modified_base (311)..(311): a, c, t, g, unknown or other
  misc_feature (311)..(311): n is a, c, g, or t
  modified_base (394)..(424): a, c, t, g, unknown or other
  misc_feature (394)..(424): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggagcctgaagtattttgcagtgtattactgtctagcagttatggagcctcacctcggacgttcggaccaagggacctaaggtgaaatcaaacgactgngctgcacatctagtcttcattccgtcccgactgtctgactagtacgtgatgacgtgggctgggcaagggcgtacagtagcgannnnnnnnnnnnnnnnnnnnnnnnnnnnnnn

SEQ ID NO: 231108 - DNA, 395 bp, Homo sapiens
  misc_feature: GYAE6OF01AWNFB.13.11.A11.1.454.CMB.1.raw
  modified_base (327)..(327): a, c, t, g, unknown or other
  misc_feature (327)..(327): n is a, c, g, or t
  modified_base (388)..(395): a, c, t, g, unknown or other
  misc_feature (388)..(395): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggagaccactgacatcccagacaggttcagtggcaggtgggtctgggacagacttcactctcaccatcagcagactggaacctgaagtactttgctacttttattctgtctaccagtatggtaggtcaccgtacactttttggccaggggtaccaagctcggagatcaaagcgaactgtgctgcacatctntcttcatccttcccgccatctgtatacgtacgtgactgagcgggctggcgaagcgcatagnnnnnnnn

SEQ ID NO: 231109 - DNA, 750 bp, Homo sapiens
  misc_feature: GYAE6OF01DI99Y.13.11.A11.1.454.CMB.1.raw
tcagtcacgtactacacgaccggtgctcgatttagctacgactgcaggggtctgggagaggagccccagccctgagattcccaggtgttccattcagtgatcagcactgaacacagaggactcaccatggagttgggactgagctggatttttcctttggcttattttaaaaggtgtccagtgtgaagtgcagctggtggagtcgtgggggagcttggtacagcctggcaggtccctgagactctcctgtgcagcctcgtggattcattctttgattgtattatcgccctatcgcctacggtcggggtcccgacaacggtccgtaccggaagggggaacgggtcccgtaggggacggttcggggtacctacggtaagggtttatttaagggttagggtaaattaggttaggtaaaactagttacgggtacttagtcgggaccggtaactttcggttagggtagggaaaccggggtcccgtaacgtttacccaacccgtacttcccgtacccgaaaggaacgaacccgaaaccgacccgtaaaaccggtaaaccccttccccgttaggttaacttcccgtagtaacctaaaagttacggaaaaccgtaggttaccgtaggaacgtacggtacgtagggaacggtaacccgaccgggttacctttaggttaacgtttaccgtaggtacgtaaaccggttaaacggttacccttaagtttaacgcggttaacggtcggttccgtttacccggg

SEQ ID NO: 231110 - DNA, 386 bp, Homo sapiens
  misc_feature: GYAE6OF01BWT2T.13.11.A11.1.454.CMB.1.raw
  modified_base (382)..(386): a, c, t, g, unknown or other
  misc_feature (382)..(386): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaacctgaagactttgctacttttattctgtcaccagtatggtaggtcaccgtacacttttggccaggggaccaagctggagatcaagcgaactgtggctgcacatctgtcttcatcttcccgccatctgatagtacgtgactgacgcgggctggcaaggcgcatagnnnnn

SEQ ID NO: 231111 - DNA, 380 bp, Homo sapiens
  misc_feature: GYAE6OF01AMKK8.13.11.A11.1.454.CMB.1.raw
  modified_base (377)..(380): a, c, t, g, unknown or other
  misc_feature (377)..(380): n is a, c, g, or t
tcagtcacgtactacacgaccggtgctcgatttagctacgactgcagggccagtcagattgtcagcagcaactacttagcctggtaccagcagaagcctggccaggcccccaggctcctcatttatggtgcatccactagggccactggtgtcccagtcaggttcagcggcagtgggtctgggacagacttcactctcaccatcagcagcctgcagtctgaagattttgcagtctattactgtcagcagtatagttactggagaaccttcggccaagggacacgactggagattaaaggaactgtggctgcaccatctgtcttcatcttcccgccatctgatagtacgtgactgagcgggctggcaaggcgcatagnnnn

SEQ ID NO: 231112 - DNA, 678 bp, Homo sapiens
  misc_feature: GYAE6OF01DHHIS.13.11.A11.1.454.CMB.1.raw
  modified_base (245)..(245): a, c, t, g, unknown or other
  misc_feature (245)..(245): n is a, c, g, or t
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcacgccagtcctcacctgcctaccttgcgcagtgcaccatgttggcctatcgactatatattcggaccganagaacgccgaggggactccctcccgtagtttcctccgtaggtacggttcaacgggttactaaaccgtcgaaggtaacgtaaaacggacgtacgggtcctacggtacggtaccgtccccgacggtcccgtctttccgtcgtcggaactaccgaaggtgtacgacgttccgaccaacgacgtaggtacttacttacactactcgtcgtcgcctcgtagtctagacgtagtcgagtactacgtaacttagtacgttagtacgttagtcgttaacggacccgttaagaccgtaaggttcgtacggttacggtttacggttacggtaccggggtagggtacgggtaaaccgtaagggtcccgtaccggtcgttaacggtcgaaccgacccggtaacgtcccggtacccgtccccggttcgtaccgtccttaccccggg

SEQ ID NO: 231113 - DNA, 404 bp, Homo sapiens
  misc_feature: GYAE6OF01B69GS.13.11.A11.1.454.CMB.1.raw
  modified_base (391)..(404): a, c, t, g, unknown or other
  misc_feature (391)..(404): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaacctgaagtactttgctacttttattctgtcaccagtatggtaggtcaccgtactacttttggccaggggaccaagctggagatcgaagcgaactggtagctgcaccatctgtcttcatcctcccgccatcctgactagtacgtgactgagcgggctgggcaaggcgacatacgnnnnnnnnnnnnnn

SEQ ID NO: 231114 - DNA, 595 bp, Homo sapiens
  misc_feature: GYAE6OF01DSQX1.13.11.A11.1.454.CMB.1.raw
  modified_base (254)..(254): a, c, t, g, unknown or other
  misc_feature (254)..(254): n is a, c, g, or t
  modified_base (547)..(547): a, c, t, g, unknown or other
  misc_feature (547)..(547): n is a, c, g, or t
  modified_base (550)..(550): a, c, t, g, unknown or other
  misc_feature (550)..(550): n is a, c, g, or t
  modified_base (552)..(552): a, c, t, g, unknown or other
  misc_feature (552)..(552): n is a, c, g, or t
  modified_base (554)..(557): a, c, t, g, unknown or other
  misc_feature (554)..(557): n is a, c, g, or t
  modified_base (559)..(560): a, c, t, g, unknown or other
  misc_feature (559)..(560): n is a, c, g, or t
  modified_base (562)..(569): a, c, t, g, unknown or other
  misc_feature (562)..(569): n is a, c, g, or t
  modified_base (571)..(595): a, c, t, g, unknown or other
  misc_feature (571)..(595): n is a, c, g, or t
tcagtcacgtactacacgaccggtgctcgattttagctacgactgcagggccagtcagattgtcagcagcaactacttagcctggtaccagcagaagcctggccaggccccccaggcctcctcatctacgatgtattcaggagaccactgacatcccagacaggttcagtggcagtgggtctgggacagacttcactctcaccatcagcagacgtaggaaccctgaacgtacttttggccttacttttatttcngtacacctagttacgtaggtacggtactacccgttactacgttttcggaccgacggggtaccaaggtccgtagggacgtaacttacgaaaggtaccggtaaaccgttgggtcgggaccttcggacctaacccgtactttccttaggtttccctttacgtacctttccccgtttacccccgtacctactttccgttagtaaacgtttaacgggttaccgttacggacgttacgggtacgggtacccggggtcggttacgggaccggaaacgggtccggtaccgtaagttaacgngcncngnnnngnngnnnnnnnngnnnnnnnnnnnnnnnnnnnnnnnnn

SEQ ID NO: 231115 - DNA, 547 bp, Homo sapiens
  misc_feature: GYAE6OF01C21E9.13.11.A11.1.454.CMB.1.raw
  modified_base (194)..(194): a, c, t, g, unknown or other
  misc_feature (194)..(194): n is a, c, g, or t
tcagtcacgtactacacgaccggtgctcgatttagctacgactgcaggggagaagagctgctcagttaggacccagagggaaccatggaaacccagcgcagcttctcttcctcctgctactctggctccagataccaccggagaaattgtgttgacgcagtctccaggcatcgtgtctttgtctccaggggaanagccacctctcctgcagggccagtcagattgtcagcagcaactacttagcctggtaccagcagaagcctggccacggccccaggctcctcatctacgatgtatcgaggacgacactgacatcccagacaggttcagtgcaggtggtctgggacagtacttcactctcaccatcagcacgtactcggaactgaagtacttacgcttactttattctcgtctacctagtagtacggtacgtactaccgttacttacgtttcggacgtaacgggacctagtcgtaggagacgtacgaacggtcgtaacgtcggtcggacgtcgacctaccgtacttccgttacgtcttcgtacccg

SEQ ID NO: 231116 - DNA, 394 bp, Homo sapiens
  misc_feature: GYAE6OF01AQXU7.13.11.A11.1.454.CMB.1.raw
  modified_base (387)..(394): a, c, t, g, unknown or other
  misc_feature (387)..(394): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagcttttgctacttttattctgtcaccagtatggtaggtcaccgtactacttttggccaggggaccaagctggagatcaagcgaactggtggctgcaccatctgttcttcactccttcccgctactctgatagtacgtgactgagcgggctggcaaggcgcatagnnnnnnnn

SEQ ID NO: 231117 - DNA, 394 bp, Homo sapiens
  misc_feature: GYAE6OF01BW6B3.13.11.A11.1.454.CMB.1.raw
  modified_base (383)..(384): a, c, t, g, unknown or other
  misc_feature (383)..(384): n is a, c, g, or t
  modified_base (386)..(394): a, c, t, g, unknown or other
  misc_feature (386)..(394): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctacttttatttctgtcaccagtatggtaggtcaccgtacacttttggccaggggaccaagctggagatcaagcgaactgtggctgcaccatctgtcttcatcttcccgccatctgatagtacgtgactgagcgggctggcaaggcgcagtagnngnnnnnnnnn

SEQ ID NO: 231118 - DNA, 600 bp, Homo sapiens
  misc_feature: GYAE6OF01D6Y2Z.13.11.A11.1.454.CMB.1.raw
  modified_base (567)..(575): a, c, t, g, unknown or other
  misc_feature (567)..(575): n is a, c, g, or t
  modified_base (577)..(577): a, c, t, g, unknown or other
  misc_feature (577)..(577): n is a, c, g, or t
  modified_base (579)..(600): a, c, t, g, unknown or other
  misc_feature (579)..(600): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagcgggtctgggacagatttcactctcaccatcagcagcctgcaggctagaagatggtgctaagttttattacgtgtaccagctaaattatttactagtacctccgtccggacggtccttacaccggttttccgggacggggtaacggggtacccgtaaggggtacgaagacgtacgaaaacgtaacgttggtcggactacggacctaccgtaagttcctcggttaccttacgtaccgttttaccccgttacccccggtaccctaaacgttcccgttaaggtaaccgttttaacggttaaccccgggttagtaacccgttacggggtaacgggtcccgggggtacgttcggggtaacccggaaacggggtccctaacgtagtaagggctagagtnnnnnnnnngncnnnnnnnnnnnnnnnnnnnnnn

SEQ ID NO: 231119 - DNA, 423 bp, Homo sapiens
  misc_feature: GYAE6OF01BC2T2.13.11.A11.1.454.CMB.1.raw
  modified_base (400)..(423): a, c, t, g, unknown or other
  misc_feature (400)..(423): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtgcagtgggtctgggacagacttcactctcaccatcagcagactggaaacctgaacgtcttttgcctacttttattctgtcaccagtatggtaggtcaccgtactacttttcggctaggggaccaagcgtgagatcgaagcgaactgtggctgcaccatctgtcttctactccttcccgctactctgtactagtacgtgacgtgacggcgggcgtggacgaaggcgagagagnnnnnnnnnnnnnnnnnnnnnnnn

SEQ ID NO: 231120 - DNA, 585 bp, Homo sapiens
  misc_feature: GYAE6OF01AIJ87.13.11.A11.1.454.CMB.1.raw
  modified_base (133)..(133): a, c, t, g, unknown or other
  misc_feature (133)..(133): n is a, c, g, or t
  modified_base (242)..(242): a, c, t, g, unknown or other
  misc_feature (242)..(242): n is a, c, g, or t
  modified_base (414)..(414): a, c, t, g, unknown or other
  misc_feature (414)..(414): n is a, c, g, or t
  modified_base (456)..(456): a, c, t, g, unknown or other
  misc_feature (456)..(456): n is a, c, g, or t
  modified_base (493)..(493): a, c, t, g, unknown or other
  misc_feature (493)..(493): n is a, c, g, or t
  modified_base (533)..(533): a, c, t, g, unknown or other
  misc_feature (533)..(533): n is a, c, g, or t
  modified_base (539)..(540): a, c, t, g, unknown or other
  misc_feature (539)..(540): n is a, c, g, or t
  modified_base (544)..(544): a, c, t, g, unknown or other
  misc_feature (544)..(544): n is a, c, g, or t
  modified_base (549)..(549): a, c, t, g, unknown or other
  misc_feature (549)..(549): n is a, c, g, or t
  modified_base (554)..(554): a, c, t, g, unknown or other
  misc_feature (554)..(554): n is a, c, g, or t
  modified_base (557)..(557): a, c, t, g, unknown or other
  misc_feature (557)..(557): n is a, c, g, or t
  modified_base (559)..(559): a, c, t, g, unknown or other
  misc_feature (559)..(559): n is a, c, g, or t
  modified_base (563)..(563): a, c, t, g, unknown or other
  misc_feature (563)..(563): n is a, c, g, or t
  modified_base (566)..(567): a, c, t, g, unknown or other
  misc_feature (566)..(567): n is a, c, g, or t
  modified_base (569)..(585): a, c, t, g, unknown or other
  misc_feature (569)..(585): n is a, c, g, or t
tcagtcacgtactacacgaccggtgctcgatttagctacgactgcagggccagtcagattgtcagcagcaactacttagcctggtaccagcagaagccctggccacgccccccaggctccctcactcctaggntagttattccagggaggtacccaattgaccacttcccccaaggacctagggtttcaggtggcgtaggttcgggtcgtacggggacacggtacttccgactctaccaacnctccgagtaccgacgtaccgtaggtaaccctgaaacgttacctttgacctatttttattccctgtcaccagtgtcgtaggtcctaccggttacctagtttcggaccgtaccggggaacaccgtacggtggtacctattaccgaacggacggtaacgttcggtacgcggttanaccgaccctattacgtcgttacgtcctacgtccctttacccnccttaatcgtaagtactacgggttctcgtacggttcncggggacccggttgaccggtacgacggtcgacgagtagtncagtanncgantcgancgtanctnancgtnatnngnnnnnnnnnnnnnnnnn

SEQ ID NO: 231121 - DNA, 453 bp, Homo sapiens
  misc_feature: GYAE6OF01DAI38.13.11.A11.1.454.CMB.1.raw
  modified_base (198)..(198): a, c, t, g, unknown or other
  misc_feature (198)..(198): n is a, c, g, or t
  modified_base (421)..(422): a, c, t, g, unknown or other
  misc_feature (421)..(422): n is a, c, g, or t
  modified_base (427)..(453): a, c, t, g, unknown or other
  misc_feature (427)..(453): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactcncaccatcagcagactggaacctgaagtctttgctacttttattctgtcaccagtagttggtacggttctaccgttactacttttggccgtaaggggaccaaggcctggagatcaagcgaactggtgctagcacctattctgttcttctactccttcccgcctattctagtacttacgtacgtgacgtggacggccgggtctagggacgaagggcgctagtagnngcagnnnnnnnnnnnnnnnnnnnnnnnnnnn

SEQ ID NO: 231122 - DNA, 450 bp, Homo sapiens
  misc_feature: GYAE6OF01BVP5W.13.11.A11.1.454.CMB.1.raw
  modified_base (242)..(242): a, c, t, g, unknown or other
  misc_feature (242)..(242): n is a, c, g, or t
  modified_base (433)..(450): a, c, t, g, unknown or other
  misc_feature (433)..(450): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcaggtgggtctgggacagacttcactctcaccatcagcagactggaacctgaagtctttgctattttattcngtcaccagtatggtagtcaccgtactacttttggccaggggaccaagcgtagggagatcgaagcgaactggtggctgccacatctgtccttctacttccttccccgctacttcgtacgtagttaacggtaccggacgttaggaccggtcggggtacgtaggggaccgaagggccgaacgagtacgcagcannnnnnnnnnnnnnnnnn

SEQ ID NO: 231123 - DNA, 396 bp, Homo sapiens
  misc_feature: GYAE6OF01DV6U3.13.11.A11.1.454.CMB.1.raw
  modified_base (241)..(241): a, c, t, g, unknown or other
  misc_feature (241)..(241): n is a, c, g, or t
  modified_base (373)..(373): a, c, t, g, unknown or other
  misc_feature (373)..(373): n is a, c, g, or t
  modified_base (388)..(396): a, c, t, g, unknown or other
  misc_feature (388)..(396): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagctttgctacttttattcngtcaccagtatggtaggtcaccgtacacgttttggccaggggaccaagctaggagatcaagcgaactggtggctgcaccatctgtcttcatccttcccgcctatctagactagtacgtgaactggagcgggntggcaggcgcatagnnnnnnnnn

SEQ ID NO: 231124 - DNA, 502 bp, Homo sapiens
  misc_feature: GYAE6OF01C3N9S.13.11.A11.1.454.CMB.1.raw
  modified_base (316)..(316): a, c, t, g, unknown or other
  misc_feature (316)..(316): n is a, c, g, or t
  modified_base (323)..(323): a, c, t, g, unknown or other
  misc_feature (323)..(323): n is a, c, g, or t
  modified_base (473)..(473): a, c, t, g, unknown or other
  misc_feature (473)..(473): n is a, c, g, or t
  modified_base (476)..(477): a, c, t, g, unknown or other
  misc_feature (476)..(477): n is a, c, g, or t
  modified_base (479)..(502): a, c, t, g, unknown or other
  misc_feature (479)..(502): n is a, c, g, or t
tcagtcacgtactacacgaccggtgctcgatttagctacgactgcagggccagtcagattgtcagcagcaactacttagcctggtaccagcagaagcctggccaggccccccaggcctcctcatctacgatgtattcaggaggaccatgacatcccagacaggttcaggtggcaggtgggtctgggacagtacttcactctcaccatcagcagtacgtacgaacctagaacgtctttgtaccttacttttattccagtaccaccgtagttagtggtacgtacctaccgtacttacgttcggacgacgggacaaggngtagganacgtacgagacgacgtggtcgactcgctacctacttctagttcccttactaccttcccttaccccgtactacgttcgtaacggtacgtttaacggtcgtagtaccggtacgggccgggacggtcggtacggaccgacgggtcctaagagncgnngnnnnnnnnnnnnnnnnnnnnnnnn

SEQ ID NO: 231125 - DNA, 433 bp, Homo sapiens
  misc_feature: GYAE6OF01D825Z.13.11.A11.1.454.CMB.1.raw
  modified_base (401)..(401): a, c, t, g, unknown or other
  misc_feature (401)..(401): n is a, c, g, or t
  modified_base (408)..(433): a, c, t, g, unknown or other
  misc_feature (408)..(433): n is a, c, g, or t
tcagtcacgtactacacgaccggtgctcgattttagctacgactgcagggccagtcagattgtcagcagcaactacttagcctggtaccagcagaagcctggccaggccccccaggctcctcatctacgatgtattcaggagaccactgacatcccagacaggttcagtgcagtgggtctgggacagacttcactctacaccatcagcagactggaacctgaaatctttgactacttttattctgtcaccagtagtggtagtcaccgtactacgtttggccaggggaccaagctagggagagtcaagcgaactggtgctcgcaccagtctcgtcttcatccttcccgacctatctagtatacgtacgtagactaggagcgggtcgtaggacaagggccganagtagannnnnnnnnnnnnnnnnnnnnnnnnn

SEQ ID NO: 231126 - DNA, 613 bp, Homo sapiens
  misc_feature: GYAE6OF01C796H.13.11.A11.1.454.CMB.1.raw
  modified_base (247)..(247): a, c, t, g, unknown or other
  misc_feature (247)..(247): n is a, c, g, or t
  modified_base (558)..(558): a, c, t, g, unknown or other
  misc_feature (558)..(558): n is a, c, g, or t
  modified_base (560)..(560): a, c, t, g, unknown or other
  misc_feature (560)..(560): n is a, c, g, or t
  modified_base (578)..(578): a, c, t, g, unknown or other
  misc_feature (578)..(578): n is a, c, g, or t
  modified_base (580)..(580): a, c, t, g, unknown or other
  misc_feature (580)..(580): n is a, c, g, or t
  modified_base (583)..(584): a, c, t, g, unknown or other
  misc_feature (583)..(584): n is a, c, g, or t
  modified_base (586)..(587): a, c, t, g, unknown or other
  misc_feature (586)..(587): n is a, c, g, or t
  modified_base (589)..(594): a, c, t, g, unknown or other
  misc_feature (589)..(594): n is a, c, g, or t
  modified_base (597)..(597): a, c, t, g, unknown or other
  misc_feature (597)..(597): n is a, c, g, or t
  modified_base (599)..(604): a, c, t, g, unknown or other
  misc_feature (599)..(604): n is a, c, g, or t
  modified_base (607)..(613): a, c, t, g, unknown or other
  misc_feature (607)..(613): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcaggtgggtctggggacaggtaccttcactctccaccatcagcagactggaacctgaatctttgctattttattcngtacacctagtatggtacgtcaccgttactacgttttggaccgtacggggaccaacgtcgtaggaagtactacgaaggacgtaaacgttggtcggacctaggacctacccgtaattccgttaggttacccttttactaacccgtttccccgtttacccccggtacccttacgtttaccttacgggtaacgttttaacgggttaccggtttacggtaaccgttaggggtaaccggggtccgggggtccgttacgggggtaacccgaaggggtacccgggtaaccgtaacggttaaaggaccttggagtcgtnancgtgacgtgacgtcagcnangannannannnnnnagngnnnnnnatnnnnnnn

SEQ ID NO: 231127 - DNA, 720 bp, Homo sapiens
  misc_feature: GYAE6OF01C2G4I.13.11.A11.1.454.CMB.1.raw
  modified_base (289)..(289): a, c, t, g, unknown or other
  misc_feature (289)..(289): n is a, c, g, or t
  modified_base (441)..(441): a, c, t, g, unknown or other
  misc_feature (441)..(441): n is a, c, g, or t
tcagtcacgtactacacgaccggtgctcgatttagctacgactgcgagggggggacacagcctactctgaggcatcccttccagaagtcactatacagtaggagacatgcaaatggggtccctccctctgccgatacgaaaaccacgccccacgccctgaccctgcacgctcgtgggagacggacgccccacgcccgtgacgtacttcccacgttcgttcgacctagttcggtagactcgagccgtactacgaacacgagacgacctcgccagtggtagttcggctagngtcgttcggttttctggttcgtacgtttaagtttaaggtcgtacgtaggtgtaggcgtgcgtagtcgtaggtagtaggtcgggtggggtagtcggttcgggtacgggtccgggttcggggtccctaggtacgtcttccgtcgtaggttaccnccgttaccgtacggtcgttacttacgtagttacgttagtagtacggtagtaggtcgtactaacgtacccgtacggttacccgggacccacccggtaaccgtacgggggaaacgggtaccgggcgtacggtacggtagggttccgggttaacttacggttaacggtaaacgttaaccgggttggaagtttcgggactacgaacgtaccctataaacgttcgagtcgtaacgtctcggtagggtacgaccgtacggtactaccgacgttcgtaaccgtacg

SEQ ID NO: 231128 - DNA, 389 bp, Homo sapiens
  misc_feature: GYAE6OF01ASOGR.13.11.A11.1.454.CMB.1.raw
  modified_base (382)..(389): a, c, t, g, unknown or other
  misc_feature (382)..(389): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagtactttgctacttttattctgtcaccagtatggtaggtcaccgtacactttggccaggggaccaagctggagatcaagcgaactgtgctgcacatctgtcttcatcttcccgcaatctgatacgtactgactgaggcgggctggacaaggcgacatagnnnnnnnn

SEQ ID NO: 231129 - DNA, 670 bp, Homo sapiens
  misc_feature: GYAE6OF01BCK5G.13.11.A11.1.454.CMB.1.raw
  modified_base (198)..(198): a, c, t, g, unknown or other
  misc_feature (198)..(198): n is a, c, g, or t
  modified_base (272)..(272): a, c, t, g, unknown or other
  misc_feature (272)..(272): n is a, c, g, or t
  modified_base (297)..(297): a, c, t, g, unknown or other
  misc_feature (297)..(297): n is a, c, g, or t
tcagtcacgtactacacgaccggtgctcgatttagctacgactgcaggggagaagagctgctcagttaggacccagagggaaccatggaaaccccagcgcagcttctcttcctcctgctactctggctcccagataccgaccggagaaattgtgttgacgcagtctcaggcatcgtgtctttgtcctccgaggggaancgcccaccctctcctgcgacgggccagtcagtattgacagcagctaaacttcttagcctggtaccagcaagacnccgtggccacggccccagcctcctnactcacgatgtactcgaggacgacctactgaacctactcccgaagacgtaggttccaaggtcggcctagggttcgggttactacggggaacctaggtaccctttaccgacgtttccaaccacccgtagtccgagtccaacgtacgttacggaaaccttggaaacgttactttacgtaaccttacgttttacgttccttacgtacctaaccgttagtttaacggttcggttaacgtcccgtaaccgtttaccggttacgtttaccggggactaaccggggtaaccgtaggtcggtaacggaacggtataaccggaaggtccgtaagtcgggttcgaccgtgaaccctccgtacgttactcgttaccttccgtcg

SEQ ID NO: 231130 - DNA, 741 bp, Homo sapiens
  misc_feature: GYAE6OF01A26ND.13.11.A11.1.454.CMB.1.raw
tcagtcacgtactacacgaccggtgctcgatttagctacgactgcaggggagaagagctgctcagttaggacccagagggaaccatggaaaccccagcgcagcttctcttcctcctgctactctggctcccagataccaccggagaaatagtgatgacgcagtctccacgcctacctgtctgtcgtctccgaggggaaagacgcccaccctctcctgcgacgggccagtcagacagttagacaacaacgtagccgtacggtaccaggaccaacggtaaaccggttcggacccgacggtccgtaccccgaacggtcccttaccctcgtaactaccgttagttacgggtcgacctacgtacccgaaccgacggggtaccctacggtcggtacctacccgacggttacccgtacgacggtcggaccgtaggtcgggtctaggggactacgtaccgttacaccgttcctaccgtacctacgtaccgacggtcgtacggttcgtacggccgtaacgtttcgtaaggttaacgttacgttttcggtaaccgtttaacggttttaacttaccggtacgttaaccgtaaggttaccctaaagttaacttaaacgttacgtacccggtacccttaaccgttactaacgtttcgttaaccttacggtttaccgggaccggtaccggtaaccctacgtacggacgtactagacgtaccgtaggtcgacgtctacgactacctgttcgtaccg

SEQ ID NO: 231131 - DNA, 670 bp, Homo sapiens
  misc_feature: GYAE6OF01EH78D.13.11.A11.1.454.CMB.1.raw
  modified_base (404)..(404): a, c, t, g, unknown or other
  misc_feature (404)..(404): n is a, c, g, or t
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctccgtggagcgtcagccagtctcacctgcctaccttgcgcagtgcaccaatgttcggtccctatgacatattagttcggtaccgacagaagccgagggtacgtccctccctagtttctcctggtacgttcaggtaccaaactcaagtaataaacgacgagggctcgtggacgtccccagccgtacttctcgtggactaccgaaggatgacttccgaccgaacgcgagggtattacgttacnctagttctacgtcgggtcctaccgagttctacggacgtagtggacggtcgtagtaacttatttacgttgtttacgtacgtttggactaacgaaccgtacgtaccgttaggtaactttccgttaccggtaccggtacgggaacccgtaaccgggtccgtaacccggttccggtaacggttaccgaccggtaaccccgaaacccgggacccctaaacccccgtacgttaccgtacccgttaaccttcccgttccgtttaccccccccg

SEQ ID NO: 231132 - DNA, 466 bp, Homo sapiens
  misc_feature: GYAE6OF01EJOWT.13.11.A11.1.454.CMB.1.raw
  modified_base (246)..(246): a, c, t, g, unknown or other
  misc_feature (246)..(246): n is a, c, g, or t
  modified_base (445)..(466): a, c, t, g, unknown or other
  misc_feature (445)..(466): n is a, c, g, or t
tcagtcacgtactacacgaccggtgctcgatttagctacgactgcagggccagtcagattgtcagcagcaactacttagcctggtaccagcagaagccctggccaggccccccaggctcctcatctacgatgtattcaggaggaccactgacatccccagacaggttcagtggcagtgggtctgggacagacttcactctcaccatcagcagactggaacctgaagtactttgctattttattctntcaccagtatgtaggtcaccgtacacttttggccaggggaccaagcgtagggaagactacgaaaggccgaaactggtggctggcctactatcgtgtcttactattcccgttaccccgcctactccgtagtacttacgttaaccggtgtacgtggacggtccgggggtctgggacgaacgggtccgactagtaggctagnnnnnnnnnnnnnnnnnnnnnn

SEQ ID NO: 231133 - DNA, 436 bp, Homo sapiens
  misc_feature: GYAE6OF01CHU8A.13.11.A11.1.454.CMB.1.raw
  modified_base (241)..(241): a, c, t, g, unknown or other
  misc_feature (241)..(241): n is a, c, g, or t
  modified_base (395)..(395): a, c, t, g, unknown or other
  misc_feature (395)..(395): n is a, c, g, or t
  modified_base (398)..(398): a, c, t, g, unknown or other
  misc_feature (398)..(398): n is a, c, g, or t
  modified_base (401)..(401): a, c, t, g, unknown or other
  misc_feature (401)..(401): n is a, c, g, or t
  modified_base (404)..(436): a, c, t, g, unknown or other
  misc_feature (404)..(436): n is a, c, g, or t
tcagtcacgtactacacgaccggtgctcgatttagctacgactgcagggccagtcagattgtcagcagcaactacttagcctggtaccagcagaagccctggccaggccccccaggctcctcatctacgatgtattcaggaggaccactgacatccccagacaggttcagtggcagtgggtctgggacagacttcactctcaccatcagcagactggaacctgaagtctttgctacttttnttctgtcaccagtactggtagtcaccgtactacttttggcctagggaccaagctggagatcaagcgaactgtgctgcaccatctgtctcatctcccgcattgatagtacgtgactggtacgcgggtctgggtaccaagggccgcaacgtaagcngantgntcnnnnnnnnnnnnnnnnnnnnnnnnnnnnnnnnn

SEQ ID NO: 231134 - DNA, 454 bp, Homo sapiens
  misc_feature: GYAE6OF01DBKG7.13.11.A11.1.454.CMB.1.raw
  modified_base (246)..(246): a, c, t, g, unknown or other
  misc_feature (246)..(246): n is a, c, g, or t
  modified_base (419)..(419): a, c, t, g, unknown or other
  misc_feature (419)..(419): n is a, c, g, or t
  modified_base (422)..(454): a, c, t, g, unknown or other
  misc_feature (422)..(454): n is a, c, g, or t
tcagtcacgtactacacgaccggtgctcgatttagctacgactgcagggccagtcagattgtcagcagcaactacttagcctggtaccagcagaagcctggccaggccccccaggcctcctcatctacgatgtatcaggagaccactgacatcccagacaggttcagtggcagtgggtctggggacagacttcactctcaccatcagcagactggaacctgaagtactttgctacttttatttccntcaccagtatggtagtcaccgtactacttttcggcctaggggaccaaaggtccgtggagactacaacgtacgaacttggtggactgacaccactctgtcttccgattccttccccgctactctgatacgtacgtgacgtggagcgggctagggacaacgggtcgacaacgtgngtnnnnnnnnnnnnnnnnnnnnnnnnnnnnnnnnn

SEQ ID NO: 231135 - DNA, 465 bp, Homo sapiens
  misc_feature: GYAE6OF01BT5EH.13.11.A11.1.454.CMB.1.raw
  modified_base (435)..(435): a, c, t, g, unknown or other
  misc_feature (435)..(435): n is a, c, g, or t
  modified_base (438)..(465): a, c, t, g, unknown or other
  misc_feature (438)..(465): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagcttcactctcaccatcagcagactggaacctgaagtactttgactacttttatttcgtgtacaccagtagtaggtaggtcctaccgtactacgttttcggaccgtaggggaccaagcgtggagatcgtaagcgaactggcgctcgacaccgactcgttcgttcttctacttccttccccggctacttcgattaagtaccgttacgtcgtaagtcgaggccgggctaggacgtacgggcacgtagtgancgnnnnnnnnnnnnnnnnnnnnnnnnnnnn

SEQ ID NO: 231136 - DNA, 515 bp, Homo sapiens
  misc_feature: GYAE6OF01D2IEN.13.11.A11.1.454.CMB.1.raw
  modified_base (122)..(122): a, c, t, g, unknown or other
  misc_feature (122)..(122): n is a, c, g, or t
  modified_base (204)..(204): a, c, t, g, unknown or other
  misc_feature (204)..(204): n is a, c, g, or t
  modified_base (248)..(248): a, c, t, g, unknown or other
  misc_feature (248)..(248): n is a, c, g, or t
  modified_base (468)..(468): a, c, t, g, unknown or other
  misc_feature (468)..(468): n is a, c, g, or t
  modified_base (470)..(470): a, c, t, g, unknown or other
  misc_feature (470)..(470): n is a, c, g, or t
  modified_base (473)..(473): a, c, t, g, unknown or other
  misc_feature (473)..(473): n is a, c, g, or t
  modified_base (477)..(478): a, c, t, g, unknown or other
  misc_feature (477)..(478): n is a, c, g, or t
  modified_base (480)..(480): a, c, t, g, unknown or other
  misc_feature (480)..(480): n is a, c, g, or t
  modified_base (482)..(482): a, c, t, g, unknown or other
  misc_feature (482)..(482): n is a, c, g, or t
  modified_base (484)..(489): a, c, t, g, unknown or other
  misc_feature (484)..(489): n is a, c, g, or t
  modified_base (491)..(515): a, c, t, g, unknown or other
  misc_feature (491)..(515): n is a, c, g, or t
tcagtcacgtactacacgaccggtgctcgatttagctacgactgcagggccagtcagattgtcagcagcaactacttagcctggtaccagcagaagcctggccacggccccccaggctcctnatctacgatgtattcgaggaggaccatgacatcccagactaggttcagtggcaggtggtctgggacagcttcactctcaccntcagcagacgtggaacctgaacgttctttgcttacttttattcngtcaccagtatggtagtccaccgttactacgttttcggacctaggggaccaagcgtggagtactacgaagtacctaacgttggtggcttgaccctactacttcgttgttccttactacttcccgttaccccgctacttcgtaagtacgttaacgttccgtagtccgtaggacggtccgggtcgtacgggaccgtaacgggccgtaccgtaaagttacggnantgntgcnncncncnnnnnnannnnnnnnnnnnnnnnnnnnnnnnn

SEQ ID NO: 231137 - DNA, 659 bp, Homo sapiens
  misc_feature: GYAE6OF01ARU45.13.11.A11.1.454.CMB.1.raw
  modified_base (647)..(647): a, c, t, g, unknown or other
  misc_feature (647)..(647): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaacgtactttgacttacttttatttctcgtacacctagtatggtacggtcaccgtactacgtttggaccgtagggtaccaaggtctaggagtacgtacaaggcgaacgtggtacggtcctacggaccaaccgtattcgttacgttaccgttcctacgttccccgttacccccgtaccttacgttaccgtacggtaacttaccgggttaacggttcggtaacggtcgggtaacgggtccccgggggtacgttaaccggggacggtaaaccggggttcccggacgggttaaacgttaccggagccgttagacgtagtacggccgtcgtacgtacgtagtacgtacgtcgtacgtagacgtacgtacgtacgtgcgtactacgtacagtacgtacgtacgtactagtagtacgtctacgacgtcgtacangtacggtgtacg

SEQ ID NO: 231138 - DNA, 496 bp, Homo sapiens
  misc_feature: GYAE6OF01EGVPF.13.11.A11.1.454.CMB.1.raw
  modified_base (459)..(459): a, c, t, g, unknown or other
  misc_feature (459)..(459): n is a, c, g, or t
  modified_base (461)..(462): a, c, t, g, unknown or other
  misc_feature (461)..(462): n is a, c, g, or t
  modified_base (464)..(496): a, c, t, g, unknown or other
  misc_feature (464)..(496): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaacctgaacgtctttgacttacttttacttctcgttcacctagtatggtacggtactaccgtactaccgttttggccgaacggggacctaagtcgtaggagatcaaggcgtaactggaggctgcaccgatctgtccttacctacttccttccccgactagttcctagtaacgttacgttacggtcgtacgtaggtacgggaccgggtcggttacgggacgtaaacgggcgacgtaacgtgacgngnngnnnnnnnnnnnnnnnnnnnnnnnnnnnnnnnnn

SEQ ID NO: 231139 - DNA, 547 bp, Homo sapiens
  misc_feature: GYAE6OF01CXZ86.13.11.A11.1.454.CMB.1.raw
  modified_base (196)..(196): a, c, t, g, unknown or other
  misc_feature (196)..(196): n is a, c, g, or t
  modified_base (245)..(245): a, c, t, g, unknown or other
  misc_feature (245)..(245): n is a, c, g, or t
  modified_base (250)..(250): a, c, t, g, unknown or other
  misc_feature (250)..(250): n is a, c, g, or t
  modified_base (511)..(511): a, c, t, g, unknown or other
  misc_feature (511)..(511): n is a, c, g, or t
  modified_base (519)..(547): a, c, t, g, unknown or other
  misc_feature (519)..(547): n is a, c, g, or t
tcagtcacgtactacacgaccggtgctcgatttagctacgactgcagggccagtcagattgtcagcagcaactacttagcctggtaccagcagaagccctggccaggccccccaggcctcctcatctacgatgtattcaggagaccactgacatcccagacaggttcagtggcaggtgggtctgggacagaccttnactctcaccatcagcagactggaacctagaactactttgactacttttnttccngtacctaccgtagttacgtagggttacgtacctaacccgttactaccggttttcgggacccgtaacggggacctaaggcgtacgggaacgtactaccgaaaggtccggtaaacgtttcggtacggtaccgttacggacctacccgtacgttcccggtctttaccgtaacgtttccccgtcccgtacctatttcccgtagtacgttacgtacggttgaacgtggacggtccggtacgtcggaacgacggtcgacaggtagcntagcatcnnnnnnnnnnnnnnnnnnnnnnnnnnnnn

SEQ ID NO: 231140 - DNA, 384 bp, Homo sapiens
  misc_feature: GYAE6OF01EIQ9N.13.11.A11.1.454.CMB.1.raw
  modified_base (358)..(358): a, c, t, g, unknown or other
  misc_feature (358)..(358): n is a, c, g, or t
  modified_base (377)..(384): a, c, t, g, unknown or other
  misc_feature (377)..(384): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagcctgcagtctgaagattttgcagtctattactgtcagcagtatagttactggagaaccttcggccaagggacacgactggagattaaaggactgtgctgcaccatctgtcttcatccttcccgcatctgatagtcgtgactgagcgggntggcaaggcgacagtacgnnnnnnnn

SEQ ID NO: 231141 - DNA, 477 bp, Homo sapiens
  misc_feature: GYAE6OF01C9Q42.13.11.A11.1.454.CMB.1.raw
  modified_base (451)..(477): a, c, t, g, unknown or other
  misc_feature (451)..(477): n is a, c, g, or t
tcagtcacgtactacacgaccggtgctcgatttagctacgactgcagggccagtcagattgtcagcagcaactacttagcctggtaccagcagaagcctggccaggccccccaggcctcctcatctacgatgtattcaggagaccactgacatcccagacaggttcaggtggcaggtggtctgggacagtccttcactctcacctatcagcagacctggaacctgaacgtctttgctacttttattctgtcacgtagttagtggtacggtctaccgttactacgttttcggaccgtagggtaaccaagcgtcgaagtacaacgaagccgtaatggtacgctgaccaccgtatctgttcctctacctccttacccgctctacctgtaagttacggtacgtcgtaacgtcggaacggtccgggtctacgggaactacgggccaggtagtagcnnnnnnnnnnnnnnnnnnnnnnnnnnn

SEQ ID NO: 231142 - DNA, 405 bp, Homo sapiens
  misc_feature: GYAE6OF01EC5HF.13.11.A11.1.454.CMB.1.raw
  modified_base (295)..(295): a, c, t, g, unknown or other
  misc_feature (295)..(295): n is a, c, g, or t
  modified_base (319)..(319): a, c, t, g, unknown or other
  misc_feature (319)..(319): n is a, c, g, or t
  modified_base (391)..(405): a, c, t, g, unknown or other
  misc_feature (391)..(405): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagtactttgctacttttattctgtcacagtatggtagtcaccgtactacttttggccgagggaccaggctgganatacaagcgaactgtggctgcacntctgtcttcactcttcccgctatctgatagtacgtgtacgtgacggcgggtctcggacgaaggcgacactgnnnnnnnnnnnnnnn

SEQ ID NO: 231143 - DNA, 404 bp, Homo sapiens
  misc_feature: GYAE6OF01BY0X8.13.11.A11.1.454.CMB.1.raw
  modified_base (244)..(244): a, c, t, g, unknown or other
  misc_feature (244)..(244): n is a, c, g, or t
  modified_base (299)..(299): a, c, t, g, unknown or other
  misc_feature (299)..(299): n is a, c, g, or t
  modified_base (386)..(386): a, c, t, g, unknown or other
  misc_feature (386)..(386): n is a, c, g, or t
  modified_base (392)..(404): a, c, t, g, unknown or other
  misc_feature (392)..(404): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaacctgaagtctttgcttacttttattcngtcaccagttatggtagtcaccgttactacttttggccaggggaccaagctgganatcaagcgaactgtgctgcaccatctgtcttcacttcctcccgcctatctgtatagtacgtgactgaggtcgggctggcgaggcganagtagnnnnnnnnnnnnn

SEQ ID NO: 231144 - DNA, 411 bp, Homo sapiens
  misc_feature: GYAE6OF01CQ4XS.13.11.A11.1.454.CMB.1.raw
  modified_base (186)..(186): a, c, t, g, unknown or other
  misc_feature (186)..(186): n is a, c, g, or t
  modified_base (223)..(223): a, c, t, g, unknown or other
  misc_feature (223)..(223): n is a, c, g, or t
  modified_base (241)..(241): a, c, t, g, unknown or other
  misc_feature (241)..(241): n is a, c, g, or t
  modified_base (385)..(385): a, c, t, g, unknown or other
  misc_feature (385)..(385): n is a, c, g, or t
  modified_base (390)..(411): a, c, t, g, unknown or other
  misc_feature (390)..(411): n is a, c, g, or t
tcagtcacgtactacacgaccggtgctcgatttagctacgactgcagggccagtcagattgtcagcagcaactacttagcctggtaccagcagaagcctggccaggcccccaggctcctcatctagatgtattcaggaggaccactgacatcccagacaggttcagtggcaggtgggtctgggacngacttcactctcgaccatcagcagactggaactgaanctttgctacttttattcngtcacagtatgtaggtcacgtactactttggccaggggaccaagctaggagatcaagcgaacgtgtggctgccgacctatctgtcttctaatccttcccgcctatctgattagtacgtgactgagcggctggacaaggcgactnaagcnnnnnnnnnnnnnnnnnnnnnn

SEQ ID NO: 231145 - DNA, 492 bp, Homo sapiens
  misc_feature: GYAE6OF01CWJHP.13.11.A11.1.454.CMB.1.raw
  modified_base (214)..(214): a, c, t, g, unknown or other
  misc_feature (214)..(214): n is a, c, g, or t
  modified_base (241)..(241): a, c, t, g, unknown or other
  misc_feature (241)..(241): n is a, c, g, or t
  modified_base (253)..(253): a, c, t, g, unknown or other
  misc_feature (253)..(253): n is a, c, g, or t
  modified_base (343)..(343): a, c, t, g, unknown or other
  misc_feature (343)..(343): n is a, c, g, or t
  modified_base (461)..(461): a, c, t, g, unknown or other
  misc_feature (461)..(461): n is a, c, g, or t
  modified_base (465)..(492): a, c, t, g, unknown or other
  misc_feature (465)..(492): n is a, c, g, or t
tcagtcacgtactacacgaccggtgctcgatttagctacgactgcatggccagtcagattgtcagcagcaactacttagcctggtaccagcagagcctggcccacggccccccaggcctcctcatctacgattgtattcgagggagacccactgacactcccagacaggttcaggtggcaggtgggtctggggacagacttcacctctccaccntcagcagactggaacctgaagtctttnctactttttatntgtccactaagtgtggtaggtctaaccgttactacttttggccgtacggggaccaaggcgtaggaagatacaaggtcgaacgtggtcggntacgccaccgtatccttgtcctttacgacttcccttccccgctacgttctagtacgtacgttacggtacgtacgtgggacgggtccgggagtcgggacgaacggtcgacgaaagtganacgnnnnnnnnnnnnnnnnnnnnnnnnnnnn

SEQ ID NO: 231146 - DNA, 431 bp, Homo sapiens
  misc_feature: GYAE6OF01DJ8YL.13.11.A11.1.454.CMB.1.raw
  modified_base (187)..(187): a, c, t, g, unknown or other
  misc_feature (187)..(187): n is a, c, g, or t
  modified_base (242)..(242): a, c, t, g, unknown or other
  misc_feature (242)..(242): n is a, c, g, or t
  modified_base (422)..(431): a, c, t, g, unknown or other
  misc_feature (422)..(431): n is a, c, g, or t
tcagtcacgtactacacgaccggtgctcgatttagctacgactgcagggccagtcagattgtcagcagcaactacttagcctggtaccagcagaagcctggccaggccccccaggcctcctcatctacgatgtattcaggaggaccactgacatcccagacaggttcagtggcagtgggtctggganagacttcactctcaccatcagcagactggaacctgaagtctttgctatttattcngtccaccagtagtggtagtccaccgtactacgtttggccgaggggaccagcgtaggagatcgaagcgaactggtcggctcgcacccatctagtcttcacttccgttccgacctatctcgagttaacggtaccgggtactcggagggtccgggtacgtgggaccgaaggtcgacagtacgnnnnnnnnnn

SEQ ID NO: 231147 - DNA, 428 bp, Homo sapiens
  misc_feature: GYAE6OF01DULYV.13.11.A11.1.454.CMB.1.raw
  modified_base (249)..(249): a, c, t, g, unknown or other
  misc_feature (249)..(249): n is a, c, g, or t
  modified_base (400)..(401): a, c, t, g, unknown or other
  misc_feature (400)..(401): n is a, c, g, or t
  modified_base (403)..(428): a, c, t, g, unknown or other
  misc_feature (403)..(428): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatccccagacaggttcagtggcagtgggtctgggacagacttcactctcaccatcagcagactggaacctgaacgtacttttgctacttttatttccngtcaccagtatggtagtcaccgtacacttttggcaggggaccaagctggagatcaagcaactgtggactgacaccatctgtccttcattccttcccgccattctgattagtacgtgacgtgacgcgggtctggacgaaggtcgcaagtcgnngnnnnnnnnnnnnnnnnnnnnnnnnnn

SEQ ID NO: 231148 - DNA, 441 bp, Homo sapiens
  misc_feature: GYAE6OF01DFPPX.13.11.A11.1.454.CMB.1.raw
  modified_base (243)..(243): a, c, t, g, unknown or other
  misc_feature (243)..(243): n is a, c, g, or t
  modified_base (394)..(394): a, c, t, g, unknown or other
  misc_feature (394)..(394): n is a, c, g, or t
  modified_base (419)..(441): a, c, t, g, unknown or other
  misc_feature (419)..(441): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggagaccatgacatcccagacaggttcagtgcagtgggtctgggacagaccttcactctcaccatcagcagactggaacctgaagtctttgctaactttttatttcngtacaacctagtagtggtaggtcctaaccgtactacgttttcggaccgaggggtaccaagcgtaggacgatccaaagcgaacgtgtggctcgcacctatctgtcttcactccttcccgctagtctagaagtacgtacgtgtacgtggacgngggctggactaacgggcacgatagnnnnnnnnnnnnnnnnnnnnnnn

SEQ ID NO: 231149 - DNA, 985 bp, Homo sapiens
  misc_feature: GYAE6OF01DQU4P.13.11.A11.1.454.CMB.1.raw
tcagtcacgtactacacgaccggtgctcgatttagctacgactgcgagggtctgggagaggacgccccagccctgagacttcccgaggttgtttccattcagtgatcagcactgaacacaggagacctcacagtggtaggttggactgagtcgttaggttactttttccgtttggactttaaagttttaaaacggtcgtacctaggtgtagtaaggtcgcgagtcgttgggtggacggttcgggtgggggtacggtcgtttacgggtaacgccggtccggttcggaccggtacggttcccgtaggacgtccttccgttccgtgtccgacgtcgtccttacggttagtaccttaccgttacgtttagtagtacgtttaattaccgtccggtaactacggtttacgcccgggtaaccggggtttccggggtaacccgaaaccggaaacccggtttcccggaaaacccgggggaaacggggggtaaaccggttccggggtttaacgggggtaacggggtttttcccggggttaacccggttaaggggtttaaaacgggtttttaaacggggtttttaaaacgggggaacgggttaaaaaacggggtttcggggttaaagggttaaccgaaccccggggtttaaagggtttaccgggtacccgttttaaggggacccgggtttacggttacggttacggttacgggtaaaccgggtaaccggttaccgttaaccgtaccgtaccgtaaccgttaacccgaccgtaaacgtaacccggaaaccgaacccgtaaccgtaaacctacccggtttaccgtaacgttaccgtacggaacttaacggtaacgtaaccggaccgtaacggtacccgaaggtaagaccggtacggaacggtacggtaaccgttccgttaagtttagttaacgttaagtcgtaaacgaacgtaacctacccgttaaccgttacgttagtttacgttggtaacgtacgg

SEQ ID NO: 231150 - DNA, 446 bp, Homo sapiens
  misc_feature: GYAE6OF01CBNFS.13.11.A11.1.454.CMB.1.raw
  modified_base (416)..(416): a, c, t, g, unknown or other
  misc_feature (416)..(416): n is a, c, g, or t
  modified_base (418)..(446): a, c, t, g, unknown or other
  misc_feature (418)..(446): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcaggtgggtctgggacagcttcactctcaccatcagcagactggaacctgaagtctttgctacttttattctgtcaccagtatggtagtcaccgtactacgtttcggccgagggaccagcgtggagatcaagcgaactggtacgctgcaccatcctgtcttactatccctttcccgacctatcgtagtattacgtcgtcgaacttcggacggcgggtcacggtacgaacgggccgataacgtgancnnnnnnnnnnnnnnnnnnnnnnnnnnnnn

SEQ ID NO: 231151 - DNA, 876 bp, Homo sapiens
  misc_feature: GYAE6OF01BSS3W.13.11.A11.1.454.CMB.1.raw
  modified_base (246)..(246): a, c, t, g, unknown or other
  misc_feature (246)..(246): n is a, c, g, or t
  modified_base (259)..(259): a, c, t, g, unknown or other
  misc_feature (259)..(259): n is a, c, g, or t
  modified_base (263)..(263): a, c, t, g, unknown or other
  misc_feature (263)..(263): n is a, c, g, or t
  modified_base (374)..(374): a, c, t, g, unknown or other
  misc_feature (374)..(374): n is a, c, g, or t
tcagtcacgtactacacgaccggtgctcgatttagctacgactgcaggggagaagagctgctcagttaggacccagagggaaccatggaaaccccagcgcagcttctcttcctcctgctactctggctcccagactaccacggagaattgtgttgacgcgtagtcctccgaggtctagtccgtgttcctttgtccgtaccggaaggggaaagacgccctaccctctccgtcgcgacgggcacgtanagtacttgtacancganactaactacgtacgtcctcgacagcgaggacgcgtaggcccgacggccccagtcctacctacactacgtacgtattacgtacgtcgacgggtacgacctacgtacgtaacnccgtacccgtaagtaccgtaacggttaccgtagggtacggtaacggtacgggttacgggttaccggtaacgggaacgttaacgttaccgtttaccgtaacccgtaccctaaccgtaacgtaaccgttaccgaacggtaaccgtaacgggttaaccggtaacggtaaacccgttaaggttaaaccggtttacgtttaccgttaacgtttttaaccttttaacgtttaccgtaccgtttaacccggtacgtttaacggttacggttacgggttaaaccggttacccgttaacccggtttaccgtttaaccgggttttacccggggaaacccgttaacgggggtaaccccgtaacgggttacccgggtaagtaaccgggtaaaccgttaacggtaaacccgggtacgttaaaccggttcggggttaaccggaacccggtaccgttaacccggtaaaccggtttactttaccggttaccgttttaacccttccgtttaacccccgg

SEQ ID NO: 231152 - DNA, 640 bp, Homo sapiens
  misc_feature: GYAE6OF01A4N3E.13.11.A11.1.454.CMB.1.raw
  modified_base (130)..(130): a, c, t, g, unknown or other
  misc_feature (130)..(130): n is a, c, g, or t
  modified_base (221)..(221): a, c, t, g, unknown or other
  misc_feature (221)..(221): n is a, c, g, or t
  modified_base (544)..(544): a, c, t, g, unknown or other
  misc_feature (544)..(544): n is a, c, g, or t
  modified_base (559)..(559): a, c, t, g, unknown or other
  misc_feature (559)..(559): n is a, c, g, or t
  modified_base (597)..(597): a, c, t, g, unknown or other
  misc_feature (597)..(597): n is a, c, g, or t
  modified_base (600)..(600): a, c, t, g, unknown or other
  misc_feature (600)..(600): n is a, c, g, or t
  modified_base (604)..(605): a, c, t, g, unknown or other
  misc_feature (604)..(605): n is a, c, g, or t
  modified_base (618)..(618): a, c, t, g, unknown or other
  misc_feature (618)..(618): n is a, c, g, or t
  modified_base (620)..(621): a, c, t, g, unknown or other
  misc_feature (620)..(621): n is a, c, g, or t
  modified_base (623)..(624): a, c, t, g, unknown or other
  misc_feature (623)..(624): n is a, c, g, or t
  modified_base (626)..(626): a, c, t, g, unknown or other
  misc_feature (626)..(626): n is a, c, g, or t
  modified_base (630)..(630): a, c, t, g, unknown or other
  misc_feature (630)..(630): n is a, c, g, or t
  modified_base (633)..(633): a, c, t, g, unknown or other
  misc_feature (633)..(633): n is a, c, g, or t
  modified_base (635)..(635): a, c, t, g, unknown or other
  misc_feature (635)..(635): n is a, c, g, or t
  modified_base (637)..(637): a, c, t, g, unknown or other
  misc_feature (637)..(637): n is a, c, g, or t
tcagtcacgtactacacgaccggtgctcgatttagctacgactgcagggccagtcagattgtcagcagcaactacttagcctggtaccagcagaagcctggccaggcccccaggcctcctcatctatggngcactccagcagggtccacgtggccatcccagtacaggttcaggtggctaggtcggggtctggggaccaggtaccttcactctcgacctancagctacgacgtggacgccttagaagttgtttcgactagtcgttatcgtgtcgtagcagttcgtagtacggctcgtaccgtcggtacggttcggaccgtacgggaccgtaagggtagtaacacgtaaagacggtagtacggtcgtaacgcgtaaccacgttacgttaccggtcttacctaacgtttcccttaccccggttacaacgtttccgttaacggtaacggtttaacggttaccgggttacgaaggtttaccgggaacgggttccggggtaccggtaacgggtacggtacccgggtaacggtacgtaacggttaacggngtacggtctaacggngtaccgacgtggtactacgagtcaacgtgcgtgtcgtncgngcgnngacgacgcgtcgngnngnngngtgntancngngac

SEQ ID NO: 231153 - DNA, 472 bp, Homo sapiens
  misc_feature: GYAE6OF01EYVA6.13.11.A11.1.454.CMB.1.raw
  modified_base (209)..(209): a, c, t, g, unknown or other
  misc_feature (209)..(209): n is a, c, g, or t
  modified_base (246)..(246): a, c, t, g, unknown or other
  misc_feature (246)..(246): n is a, c, g, or t
  modified_base (302)..(302): a, c, t, g, unknown or other
  misc_feature (302)..(302): n is a, c, g, or t
  modified_base (428)..(428): a, c, t, g, unknown or other
  misc_feature (428)..(428): n is a, c, g, or t
  modified_base (436)..(436): a, c, t, g, unknown or other
  misc_feature (436)..(436): n is a, c, g, or t
  modified_base (440)..(440): a, c, t, g, unknown or other
  misc_feature (440)..(440): n is a, c, g, or t
  modified_base (443)..(472): a, c, t, g, unknown or other
  misc_feature (443)..(472): n is a, c, g, or t
tcagtcacgtactacacgaccggtgctcgattttagctacgactgcagggccagtcagattgtcagcagcaactacttagcctggtaccagcagaagcctggccaggccccccaggcctcctcatctacgatgtattcgaggaggaccactgacatcccagacaggttcagtgcagtgggtctgggacagacttcactctcaccatcancagactggaacctgaagactttgctacttttatttcngtcacccagtatggtaggtcaccgtacacttttggcctaggggaccaagcgtgganatcaaagcgaaactgtgctgcgaccatacgtgtctttcgtaacttccttcccgcccaattctcggatacggtacgtagacgttcgaagggccggcgttcgggacctaagggccgactaagtaggcngactgatncatnagnnnnnnnnnnnnnnnnnnnnnnnnnnnnnn

SEQ ID NO: 231154 - DNA, 881 bp, Homo sapiens
  misc_feature: GYAE6OF01DVF6X.13.11.A11.1.454.CMB.1.raw
tcagtcacgtactacacgaccggtgctcgatttagctacgactgcgggggtaagaggttgtgtccaccatggcctggactcctctcctcctcctgctcctctctcactgcacacggttccctctcgcaggctgtgctgactcacgtcctcttccctctctgtcttctccgtggacgtcgtcacgcctacgtcctaccaccgtcgcctaccgttcggccgacgtacggtcgacctaaccgtaagttcggtttccggtacccttagtacgtaactaagttaacgttacgttaaccggtaacccggaacgtaacggaaaccggccggtaacggggtaccctttaccccgtccccgtttagttttccctacggttacgggttacggttacccgtaacggttaacctaaaaccgtacgtaaaaggtaaacgtaaaaccggtacggtaacgggtccttaccggtacgggtaacccgtaccccgacggttccccgtacgtttccgttacgtacggggtaacctaccggtaaaggttactaccggttacccggtacccgtaaccggaaccggtacgggttaacgggtttaaacctttaacgttaccgttacccgtagttcccgggtttacgggtcccgggtaccttacccgtaggttacccggaaggtaccgtagtccgggtaacttcgtaaacgtttcttaacgtttacggttgtaaccggtttctaaccggaactaacccgtaacggtaaccctcggttaagtccttacggtaaccggtaccgtacgggtacccgtccgtcgtaaacccggttcgaacgtccggaccccgtaacggaccccgtacccaaccgttctaccgtaccttacccttcgttcccctaccccg

SEQ ID NO: 231155 - DNA, 613 bp, Homo sapiens
  misc_feature: GYAE6OF01CLPQ6.13.11.A11.1.454.CMB.1.raw
  modified_base (536)..(536): a, c, t, g, unknown or other
  misc_feature (536)..(536): n is a, c, g, or t
  modified_base (563)..(563): a, c, t, g, unknown or other
  misc_feature (563)..(563): n is a, c, g, or t
  modified_base (585)..(587): a, c, t, g, unknown or other
  misc_feature (585)..(587): n is a, c, g, or t
  modified_base (591)..(591): a, c, t, g, unknown or other
  misc_feature (591)..(591): n is a, c, g, or t
  modified_base (594)..(594): a, c, t, g, unknown or other
  misc_feature (594)..(594): n is a, c, g, or t
  modified_base (600)..(600): a, c, t, g, unknown or other
  misc_feature (600)..(600): n is a, c, g, or t
  modified_base (607)..(607): a, c, t, g, unknown or other
  misc_feature (607)..(607): n is a, c, g, or t
  modified_base (609)..(609): a, c, t, g, unknown or other
  misc_feature (609)..(609): n is a, c, g, or t
  modified_base (612)..(613): a, c, t, g, unknown or other
  misc_feature (612)..(613): n is a, c, g, or t
tcagtcacgtactacacgaccggtgctcgatttagctacgactgcagggccagtcagattgtcagcagcaactacttagcctggtaccagcagaagcctggccacggccccaggctcctcatctacgatgtattcaggagaccactgacactccagacaggttcagtggcaggtgggtctcgggacacgtacttcactctacaccatcagacgagacgttcggaacctagaagtctttcgacttacttttagtttctacgtcacctagttatagggtacgttacgtaccgttactaccgttttggacccgtacggggaaccgtaaggccgtaggaacgacgttaccaaggtaccgtaacgtggtacggaccgttcgccgtaactacgttccgttacggttaccttacgttaccgttccttttaccccggacttaacgtcctacggttaacttacgtaccggttacgtaacggtcggtacgggacgggtcgtacggggaccttaacgggccgttaacgtacgtacgagtacacggtntaccgatgactgatacgcacagcgaancgcgtaagcgcaatccgaatcnnncgcnctngtcacntctcatncngtnn

SEQ ID NO: 231156 - DNA, 552 bp, Homo sapiens
  misc_feature: GYAE6OF01DMX56.13.11.A11.1.454.CMB.1.raw
  modified_base (533)..(552): a, c, t, g, unknown or other
  misc_feature (533)..(552): n is a, c, g, or t
tcagtcacgtactacacgaccggtgctcgatttagctacgactgcagggccagtcagattgtcagcagcaactacttagcctggtaccagcagaagcctggccaggccccccaggcctcctcatctacgatgtattcaggaggaccactgacatcccagacaggttcaggtggcagtgggtctgggacagacttcactctcaccatcagcagaccgtaggaacctgaacgtactttgacttacttttatttcctgttctacctagttaattggtacggttactaacccgttacttacgtttttacgggccgtaacgggggacctaacggtccgttagggaacgtagtacgaaagccggtaaacgtggtgggtactcgggacctaccgaattccgttagttcccttttcctaactttacccgtttccccggtccctaactttccgttagtacttaacggtttaccggtcgtacgttgggaacgggtccggggtaccgttgggaacccgggaagggtacccgacgaagttaaggnnnnnnnnnnnnnnnnnnnn

SEQ ID NO: 231157 - DNA, 396 bp, Homo sapiens
  misc_feature: GYAE6OF01BCY9N.13.11.A11.1.454.CMB.1.raw
  modified_base (388)..(396): a, c, t, g, unknown or other
  misc_feature (388)..(396): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaacctgaacgtactttgctacttttattctgtcaccagtatggtagtcaccgtactacttttggccaggggaccaagctggagatcaagcgaacgtgtggctgcaccatctgtctcactctcccgcatctgtatagtacgtgactgaggcgggctggacgaggcgacgatagnnnnnnnnn

SEQ ID NO: 231158 - DNA, 464 bp, Homo sapiens
  misc_feature: GYAE6OF01E2WN6.13.11.A11.1.454.CMB.1.raw
  modified_base (244)..(244): a, c, t, g, unknown or other
  misc_feature (244)..(244): n is a, c, g, or t
  modified_base (340)..(340): a, c, t, g, unknown or other
  misc_feature (340)..(340): n is a, c, g, or t
  modified_base (429)..(430): a, c, t, g, unknown or other
  misc_feature (429)..(430): n is a, c, g, or t
  modified_base (433)..(464): a, c, t, g, unknown or other
  misc_feature (433)..(464): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggagaccactgacatcccagacaggttcagtggcagtgggtctgggacagaccttcactctcaccatcagcagactaggaacctagaatactttgctactttattcngtcaccagtatggtagtcaccgtactacttttcggaccgtaggggaccaagccgtaggacgatacgaagccgtaaacgttgtaggctagcaacctntcgtcgtccttcacttcctccccgctatctagtatagtacgtgtaacgtggacggtcgggacgtcggacgaacgggcactagtacgtgnngannnnnnnnnnnnnnnnnnnnnnnnnnnnnnnn

SEQ ID NO: 231159 - DNA, 572 bp, Homo sapiens
  misc_feature: GYAE6OF01AMKUL.13.11.A11.1.454.CMB.1.raw
  modified_base (534)..(534): a, c, t, g, unknown or other
  misc_feature (534)..(534): n is a, c, g, or t
  modified_base (540)..(572): a, c, t, g, unknown or other
  misc_feature (540)..(572): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactcctcaccatcagcagactgaacctgaagtactttgctacttttattctgtcaccagttagtggtaggtctaccgtactactttttcggcccgtaagggggaccctaaaggcgttacgggagtaagttaccgaaacggtccggtaaaacttcgggtcgggtaccgttggaccgtaaaccccgtaattccgttcggtttacctttccgtaactttcccgtttccccggtaccctaacttcccgttaggtaacgttaaggttaccggttacgaacgttacgggacggtccggggtcgtacggacccgaagggtaccggacctaagttacggacgagctagnacgtgnnnnnnnnnnnnnnnnnnnnnnnnnnnnnnnnn

SEQ ID NO: 231160 - DNA, 483 bp, Homo sapiens
  misc_feature: GYAE6OF01CXRBH.13.11.A11.1.454.CMB.1.raw
  modified_base (461)..(483): a, c, t, g, unknown or other
  misc_feature (461)..(483): n is a, c, g, or t
tcagtcacgtactacacgaccggtgctcgatttagctacgactgcagggccagtcagattgtcagcagcaactacttagcctggtaccagcagaagcctggccaggccccccaggcctcctcatctacgatgtattcaggaggaccactgacatcccagacaggttcagtggcagtgggtctgggacagacttcactctcaccatcagcagcctgcagtctgaaagtattttgctagttcttaatttactagtccagactaagttaacttaaggtttactaggaacgaacccttcgggaccaaaggggaacctaacggaacgtggaagtaaagtttaaaaggaacgtgtaggctagccaacctattcgtgtcttacacttccttccccgctaattcacgtaatacggttacgtgtaacgtggacggtcgggactacgggacgaaagggtccataagtagannnnnnnnnnnnnnnnnnnnnnn

SEQ ID NO: 231161 - DNA, 425 bp, Homo sapiens
  misc_feature: GYAE6OF01C5LI4.13.11.A11.1.454.CMB.1.raw
  modified_base (188)..(188): a, c, t, g, unknown or other
  misc_feature (188)..(188): n is a, c, g, or t
  modified_base (199)..(199): a, c, t, g, unknown or other
  misc_feature (199)..(199): n is a, c, g, or t
  modified_base (238)..(238): a, c, t, g, unknown or other
  misc_feature (238)..(238): n is a, c, g, or t
  modified_base (242)..(242): a, c, t, g, unknown or other
  misc_feature (242)..(242): n is a, c, g, or t
  modified_base (335)..(335): a, c, t, g, unknown or other
  misc_feature (335)..(335): n is a, c, g, or t
  modified_base (353)..(353): a, c, t, g, unknown or other
  misc_feature (353)..(353): n is a, c, g, or t
  modified_base (402)..(425): a, c, t, g, unknown or other
  misc_feature (402)..(425): n is a, c, g, or t
tcagtcacgtactacacgaccggtgctcgatttagctacgactgcagggccagtcagattgtcagcagcaactacttagcctggtaccagcagaagcctggccaggccccccaggcctcctcatctacgatgtattcaggaggaccactgacatcccagacaggttcagtggcagtgggtctgggacngacttcactcncaccatcagcagactggaacctgaagtctttgctatttnttcngtcaccagtatggtaggtctaccgtactacttttggaccaggggaccaagtcgtggagactcaagcgaactggtggctgcaccatctgtcttnacttcctcccgccatctnatacgtcgtgactggacggcggtcgtaggccgaacgggcgacgagtagnnnnnnnnnnnnnnnnnnnnnnnn

SEQ ID NO: 231162 - DNA, 558 bp, Homo sapiens
  misc_feature: GYAE6OF01C2TDZ.13.11.A11.1.454.CMB.1.raw
  modified_base (518)..(518): a, c, t, g, unknown or other
  misc_feature (518)..(518): n is a, c, g, or t
  modified_base (522)..(526): a, c, t, g, unknown or other
  misc_feature (522)..(526): n is a, c, g, or t
  modified_base (528)..(558): a, c, t, g, unknown or other
  misc_feature (528)..(558): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggagaccactgacatcccagacaggttcagtggcagtgggtctgggacagacttcactctcaccatccagcagactggaacctgaagtctttgactacttttatttctgttaccacctagttacgtggtacggtactaccggttactaacgtttttcggccgtaacgggggtacccaaaacggtcgttacgggaagtaacgttacaaaggcccgtaaaagttggtgggtccgttaggccaacctaacttcgtcggtttaccttacctaacttcccgtttccccggacctaacgttccttaggaactttaacggtttacgggtacgtacggttacggtaacgggccgggtactcgggaccggaagggttccgacaacgttagngacnnnnngnnnnnnnnnnnnnnnnnnnnnnnnnnnnnnn

SEQ ID NO: 231163 - DNA, 477 bp, Homo sapiens
  misc_feature: GYAE6OF01DDEDN.13.11.A11.1.454.CMB.1.raw
  modified_base (320)..(320): a, c, t, g, unknown or other
  misc_feature (320)..(320): n is a, c, g, or t
  modified_base (448)..(449): a, c, t, g, unknown or other
  misc_feature (448)..(449): n is a, c, g, or t
  modified_base (451)..(453): a, c, t, g, unknown or other
  misc_feature (451)..(453): n is a, c, g, or t
  modified_base (455)..(477): a, c, t, g, unknown or other
  misc_feature (455)..(477): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggctggggacagacttcactctcaccatcagcagactggaacctgaagacctttgctacttttattctgtaccaccaagtatggtagtccaccgtactacttttcggaccgaggggacccaagcgtggagatcaagcgaactgnggctgacaccattctagtcctttcgattcccttacccgccctaattctgaacttaacgtacggttcgaacgttggacggtaccggggcttacgggacccgtaaacgggccgacgtaaacgtaggctanncnnncnnnnnnnnnnnnnnnnnnnnnnn

SEQ ID NO: 231164 - DNA, 622 bp, Homo sapiens
  misc_feature: GYAE6OF01ANEZH.13.11.A11.1.454.CMB.1.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttcggtccctatgacatattattcggtaccgacagaacgccgaaggggacgtccctccctagtttcctccgtgtaggttcaggtacaaactcgagaactaaacgacgagggcctacgtcggacgtccccgagcccgtcttctcgtcgactaccgaaggtatacgtactcccgacgaacgcgagggtattacttactctactcgtacgtgggcctaccgacgtcgtagacgtagtggacgtcgtgtaacttagtttacgttgtttacgtacgttacggacaaactaaccgacgtccgtaggtacttccgttccggaccgtcgggaccgtacggtccgtaccgtaccgtacggtaccacggccccgaacgaccccaacccgtcgtacgacctcgttccgtccgttcccccg

SEQ ID NO: 231165 - DNA, 528 bp, Homo sapiens
  misc_feature: GYAE6OF01C30SK.13.11.A11.1.454.CMB.1.raw
  modified_base (208)..(208): a, c, t, g, unknown or other
  misc_feature (208)..(208): n is a, c, g, or t
  modified_base (253)..(253): a, c, t, g, unknown or other
  misc_feature (253)..(253): n is a, c, g, or t
  modified_base (257)..(257): a, c, t, g, unknown or other
  misc_feature (257)..(257): n is a, c, g, or t
  modified_base (353)..(353): a, c, t, g, unknown or other
  misc_feature (353)..(353): n is a, c, g, or t
  modified_base (358)..(358): a, c, t, g, unknown or other
  misc_feature (358)..(358): n is a, c, g, or t
  modified_base (469)..(469): a, c, t, g, unknown or other
  misc_feature (469)..(469): n is a, c, g, or t
  modified_base (473)..(474): a, c, t, g, unknown or other
  misc_feature (473)..(474): n is a, c, g, or t
  modified_base (480)..(480): a, c, t, g, unknown or other
  misc_feature (480)..(480): n is a, c, g, or t
  modified_base (482)..(482): a, c, t, g, unknown or other
  misc_feature (482)..(482): n is a, c, g, or t
  modified_base (487)..(487): a, c, t, g, unknown or other
  misc_feature (487)..(487): n is a, c, g, or t
  modified_base (491)..(493): a, c, t, g, unknown or other
  misc_feature (491)..(493): n is a, c, g, or t
  modified_base (495)..(496): a, c, t, g, unknown or other
  misc_feature (495)..(496): n is a, c, g, or t
  modified_base (499)..(507): a, c, t, g, unknown or other
  misc_feature (499)..(507): n is a, c, g, or t
  modified_base (509)..(510): a, c, t, g, unknown or other
  misc_feature (509)..(510): n is a, c, g, or t
  modified_base (515)..(515): a, c, t, g, unknown or other
  misc_feature (515)..(515): n is a, c, g, or t
  modified_base (517)..(522): a, c, t, g, unknown or other
  misc_feature (517)..(522): n is a, c, g, or t
  modified_base (524)..(527): a, c, t, g, unknown or other
  misc_feature (524)..(527): n is a, c, g, or t
tcagtcacgtactacacgaccggtgctcgatttagctacgactgcagggccagtcaagattgtcagcagacaactacttaggcctggtaccagcagaagcctggccacggcccccaggcctcctcatctacgatgtattcaggaggaccatgacactcccagactaggttcaggtggcaggtgggtcgtgggacagtacttcactccnccaccatcagcagactggaacctgaacgtactttcgctacttttnttcngtacctactagttacgtggtacgtcctacgttactacgtttcggaccggacggggtaccaaggtcgtagggaagtactagaagtaccgtacgtggngtccngaccactactcgtctctactacgttcccttccgactacgtctaggtacttacgtacggtacacggttaggacgggtcgggtcgtaacggcgacgggtactaactacgtagnacgnngtacgngntcgantcgnnncnngcnnnnnnnnncnnctctncnnnnnnannnnc

SEQ ID NO: 231166 - DNA, 458 bp, Homo sapiens
  misc_feature: GYAE6OF01A1T5T.13.11.A11.1.454.CMB.1.raw
  modified_base (422)..(422): a, c, t, g, unknown or other
  misc_feature (422)..(422): n is a, c, g, or t
  modified_base (430)..(458): a, c, t, g, unknown or other
  misc_feature (430)..(458): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaacctgaagactttgctactttatttctgtcaccagtatggtaggtcaccgtatacttttggcctagggggaccaagcgtcggagtatacgaaggccgtaactgtggctgcaccatctgttcttctactccttcccgcctatccttgtacttacgtacgtgaacgtggacggcgggacgttgggacgaagggccgtacaagttaggntagcatgnnnnnnnnnnnnnnnnnnnnnnnnnnnnn

SEQ ID NO: 231167 - DNA, 490 bp, Homo sapiens
  misc_feature: GYAE6OF01A0TWA.13.11.A11.1.454.CMB.1.raw
  modified_base (178)..(178): a, c, t, g, unknown or other
  misc_feature (178)..(178): n is a, c, g, or t
  modified_base (216)..(216): a, c, t, g, unknown or other
  misc_feature (216)..(216): n is a, c, g, or t
  modified_base (250)..(250): a, c, t, g, unknown or other
  misc_feature (250)..(250): n is a, c, g, or t
  modified_base (371)..(371): a, c, t, g, unknown or other
  misc_feature (371)..(371): n is a, c, g, or t
  modified_base (404)..(404): a, c, t, g, unknown or other
  misc_feature (404)..(404): n is a, c, g, or t
  modified_base (475)..(490): a, c, t, g, unknown or other
  misc_feature (475)..(490): n is a, c, g, or t
tcagtcacgtactacacgaccggtgctcgatttagctacgactgcaggccagtcagattgtcacgcagccaactacttagcctggtaccagcgagaagcctggcccaggccccccaggctcctcatctacgatgtattcaggaggaccacgtgacactcccagacaggttcagtggcngtgggtctgggacagtacttcacctctccaccatcgancagactagaacctgaaagtctttgacttattttnttctcgtactaccgtagttatggttacggtacctaccgttactacgtttttcggaccgtaacggggaacaacgtcgtaggagactacgtaagccgaacgttggtcggtcctgaccaccgtnttcttgttaccttctcttcccgttcccaccttntacgtcgtaagtacgttacgtaggtactagggacggaccgggtccagggtacgacggacggtacagtagcnnnnnnnnnnnnnnnn

SEQ ID NO: 231168 - DNA, 573 bp, Homo sapiens
  misc_feature: GYAE6OF01EUIM9.13.11.A11.1.454.CMB.1.raw
  modified_base (142)..(142): a, c, t, g, unknown or other
  misc_feature (142)..(142): n is a, c, g, or t
  modified_base (525)..(525): a, c, t, g, unknown or other
  misc_feature (525)..(525): n is a, c, g, or t
  modified_base (527)..(527): a, c, t, g, unknown or other
  misc_feature (527)..(527): n is a, c, g, or t
  modified_base (533)..(536): a, c, t, g, unknown or other
  misc_feature (533)..(536): n is a, c, g, or t
  modified_base (538)..(538): a, c, t, g, unknown or other
  misc_feature (538)..(538): n is a, c, g, or t
  modified_base (540)..(541): a, c, t, g, unknown or other
  misc_feature (540)..(541): n is a, c, g, or t
  modified_base (543)..(546): a, c, t, g, unknown or other
  misc_feature (543)..(546): n is a, c, g, or t
  modified_base (548)..(555): a, c, t, g, unknown or other
  misc_feature (548)..(555): n is a, c, g, or t
  modified_base (557)..(557): a, c, t, g, unknown or other
  misc_feature (557)..(557): n is a, c, g, or t
  modified_base (559)..(559): a, c, t, g, unknown or other
  misc_feature (559)..(559): n is a, c, g, or t
  modified_base (561)..(562): a, c, t, g, unknown or other
  misc_feature (561)..(562): n is a, c, g, or t
  modified_base (564)..(573): a, c, t, g, unknown or other
  misc_feature (564)..(573): n is a, c, g, or t
tcagtcacgtactacacgaccggtgctcgatttagctacgactgcagggccagtcagattgtcagcagcaactacttagcctggtaccagcagaagcctggccaggcccccaggctcctcatcgtacgattgtatttcaggnggaccacttgacatcccagacaggttcaggtggcaggtgggtctgggacaggacttcactctcaccatccagcagtacctggaaccctgaaacgtcttttgcttaactttttattctgttcaccgagttattggtacggtctaccgttactacgtttttcggccgacggggacctaacggtcgtagggtagaacgtacgaacggtacgtaaacctggttcgccttagggacctaacctaagtttccgtacgtttcctttaccaaccgtttcccgtaccccggtaccctaactttccgttaggtaacgttacggttaccgtcgtaccgtggaacggtccgggtacgttgggaccgtaaacgggcccggaagtagttaaggctgntngatgannnncngnncnnnntnnnnnnnngngngnngnnnnnnnnnn

SEQ ID NO: 231169 - DNA, 665 bp, Homo sapiens
  misc_feature: GYAE6OF01AN7KA.13.11.A11.1.454.CMB.1.raw
  modified_base (275)..(275): a, c, t, g, unknown or other
  misc_feature (275)..(275): n is a, c, g, or t
  modified_base (447)..(447): a, c, t, g, unknown or other
  misc_feature (447)..(447): n is a, c, g, or t
  modified_base (455)..(455): a, c, t, g, unknown or other
  misc_feature (455)..(455): n is a, c, g, or t
  modified_base (574)..(574): a, c, t, g, unknown or other
  misc_feature (574)..(574): n is a, c, g, or t
tcagtcacgtactacacgaccggtgctcgatttagctacgactgcaggggtctgggagaggagccccagcccctgagattcccaggtgtttccattcagtgatcagcactgaacacagaggactcaccatggaggttgggactgagctggtatttttccttttggacttaattttaaaaggtgtccagtgtgaagtgcagcgtgggtggagtcggtggggggaggtcgttggtacacggccgtgggcgacggtccctggacgtacctctcctggngccacgtccttcgtggtactttcatttcgtttagtattaggtaactttgtcgtacctagtcggtaccgtacggtccgggtccgacgaacgtccgtacggaacggggtaacggccgtgggacggttgggtctacggaaggttatttagggtaggtaagttaggtagtaaacgntaagggtntaagtgtcggtactcggttaggtacggaacgggtcctaagtccaccgtatcctacgagaacgacaaccacaacgtacctcctagtacgtctacgaactaacgtagaacgtagtgtaagngaacgcgtaggacgtacgtaccgttacgtacgttacgttgagtaacgtacgtaaacctcgtacgttaggacccggtagtccggtcgttccg

SEQ ID NO: 231170 - DNA, 888 bp, Homo sapiens
  misc_feature: GYAE6OF01AQJKJ.13.11.A11.1.454.CMB.1.raw
  modified_base (195)..(195): a, c, t, g, unknown or other
  misc_feature (195)..(195): n is a, c, g, or t
tcagtcacgtactacacgaccggtgctcgatttagctacgactgcgggggtaagaggttgtgtccaccatggcctggactcctctcctcctcctgctcctctctcactgcacacggttccctctcgcaggctgtgctgactcagccgttcttccctcttctcgtcttctccgtggacgcgtcagccacgtctccncctcgcctaccttgccgcaggtcgccaacctagttgttcggtccctatgtacagttattacgttacggtaaccgacaaggaccggcgaaggggtaccgttcccctccccgttacgtttttcctccgttaggtaccggtttaccgaacggtaccctaaaactccggtaagtaaacttaaaccggcgtaacggggtccctttcgggacggtacccggtaccccaggtcccccggtctttacctccggtggtaaacccgttccgaaacgggtacgttacgtaccttcccggggaaaccacccggttaaggtaggggttaaactttacgtttaaccgacgtactttaccggtcgttaccggggtcctaccggttacttcgggtaacccacgggtacgttacgggacgtttacgggtcggttaaactttaacgtttaccggtttacggttttacgggttaccggttaaccgtaacgtaaacccgaaccggttacccgtaaccgttcgggtttaaaccttccgggtttaccccggggaacgtttaacccgggggacccgttaaccggtcccccggttaaacccggttccgggtttaaccggacccgttaaccccggaaaccgggaccccggttaaacccgtaacccctacggtacggtttccccccaacgttttcccccggccccgtttaacccccccg

SEQ ID NO: 231171 - DNA, 619 bp, Homo sapiens
  misc_feature: GYAE6OF01CX3T6.13.11.A11.1.454.CMB.1.raw
  modified_base (307)..(307): a, c, t, g, unknown or other
  misc_feature (307)..(307): n is a, c, g, or t
  modified_base (362)..(362): a, c, t, g, unknown or other
  misc_feature (362)..(362): n is a, c, g, or t
tcagtcacgtactacacgaccggtgctcgatttagctacgactgcaggggtctgggagaggagccccagccctgagattcccaggtgttccattcagtgatcagcactgaacacagaggactcaccatggagttgggactgagctggtatttttcctttggacttatttaaaaggtgtccagtgtgaagtgcagctggtggagtcgtgggggagcttggtacagcctggcgagtccctgacgacctctcctgtgccagcctgtcggtattcattcttgatgattatgccagtgccagtcgggtccgnaacgcacggagggacggctgggagtggtctgagttattagtgaatggtagaaacngtacggctagtggacgtatcgtaggtcggaacggtccgtacttcgtaacctactaccgttaccgaagaaaccgtaaccaaccgtaacccaaacggtaaccctcccgttagacttacgtagaaccgtaaagtacgaacgtacgtaccgtaggaacgtacgtcgacggtaacgaaccgtaccggtccgttagtaacgtttacgacggtacgtaacgtaaacggttcttaacggttacacggtagtccggtcgttaccgg

SEQ ID NO: 231172 - DNA, 760 bp, Homo sapiens
  misc_feature: GYAE6OF01BP5WV.13.11.A11.1.454.CMB.1.raw
  modified_base (340)..(340): a, c, t, g, unknown or other
  misc_feature (340)..(340): n is a, c, g, or t
  modified_base (605)..(605): a, c, t, g, unknown or other
  misc_feature (605)..(605): n is a, c, g, or t
tcagtcacgtactacacgaccggtgctcgatttagctacgactgcggggtaagtaggttgtgtccaccatcggcctggactcctctcctcctcctgctcctctctcactgcacaggttccctctcgcaggctggtgctgactcacgtccgttccttccctcttctgtcttctccgtggagtcgtgacgccgagttcctcgtaccgtcgccgtaccgttggccgcgtacggtcggtaccaaccgtaagttcggtttcggtaccctagtacgactaattacgttacgtcggtaaccgaactaggaacgtccggaaggtaccttccctacccgttagtttccncgttcggtacggttccacggtacctaaacgtcgtaacgtaaacgtaaaccggacggtacgggtacttacggtggtacccgtcccgtacgtaccgtcgtttaccgtacgtacggtactaaccgaaggtctacgtaccgtccgaaccctaaggcgtaacggtatttactacgactacgttcctcggtacggtcctaccgtaggtacctaagacgtacgtacgacgttctaacgttaactttgttaaccgttggttaacgtcggtacnccgaacaaccggtacgtccgtgtacttccggtacgggtacctcgggtacctaccgttaccgtaaccggttcggtaaggtccccgaacgtaccccggaaccggtaaccccaacccggttcgttcgacccgaccgtttccgttcccggtaccccccg

SEQ ID NO: 231173 - DNA, 664 bp, Homo sapiens
  misc_feature: GYAE6OF01AGHFJ.13.11.A11.1.454.CMB.1.raw
  modified_base (197)..(197): a, c, t, g, unknown or other
  misc_feature (197)..(197): n is a, c, g, or t
tcagtcacgtactacacgaccggtgctcgatttagctacgactgcagggggagaagagctgctcagttaggacccagagggaaccatggaaaccccagcgcagcttctcttcctcctgctactctggctcccagataccaccggagaattgtgttgacgcagtctccaggcatcgtgtctttgtctccgaggggaancgccaccctctcctgcgagggccagtcagtattgcagcagcaactacttagcctaggtaccagacagaacgccgtggcccacggcccccaggcctcctcactcctacgattgtacttacgagggacgaccactcgaccactcccgagacgtaggtcaggtcggacgtagggtcgggtcgtagggactaggtaccttactacctacctccaacctatccgaacgactacggtaaccgtacggaacctaggtaaacgttacgtttacgtacctttactttttacgtttccgttacgttacctaaccgttacggttagttacgggtttacgtaccgtaacccgtttacgttaccggttttaccgggaccggtaacggggtaaccctagggcgtaggacgtaactacggaacggtccgtagttggtcgtcgacgtacccgtacttacttaccgttcttcttcccgttaccg

SEQ ID NO: 231174 - DNA, 518 bp, Homo sapiens
  misc_feature: GYAE6OF01A328T.13.11.A11.1.454.CMB.1.raw
  modified_base (484)..(484): a, c, t, g, unknown or other
  misc_feature (484)..(484): n is a, c, g, or t
  modified_base (490)..(490): a, c, t, g, unknown or other
  misc_feature (490)..(490): n is a, c, g, or t
  modified_base (492)..(518): a, c, t, g, unknown or other
  misc_feature (492)..(518): n is a, c, g, or t
tcagtcacgtactacacgaccggtgctcgatttagctacgactgcagggccagtcagattgtcagcagcaactacttagcctggccaggctcctcatctacgattgtattcgaggaggaccactgacactcccagaccaggttcagtggcaggtcgggtctgggacagtacttcactctcaccatcgagcagactggaaccctgaacgtactttgacttacgttttacttctgtccacctagtagtgggtacggtccaaccgttactacgttttcggaccgaggggaacccaaggcgtaggacactacgaacggccgtaacgtggtacggccgtcgaccctaccgtacttccgttacgttcctttacctaccctttcccgttcccccggtacctacttaccgttaggtaacttaccggttacgtacggtacgttacgggaccgggtcggggtaccgtcgggaacgaacgggcctacgtaagtancgtagngnnnnnnnnnnnnnnnnnnnnnnnnnnn

SEQ ID NO: 231175 - DNA, 630 bp, Homo sapiens
  misc_feature: GYAE6OF01BC0WD.13.11.A11.1.454.CMB.1.raw
  modified_base (211)..(211): a, c, t, g, unknown or other
  misc_feature (211)..(211): n is a, c, g, or t
  modified_base (259)..(259): a, c, t, g, unknown or other
  misc_feature (259)..(259): n is a, c, g, or t
  modified_base (581)..(581): a, c, t, g, unknown or other
  misc_feature (581)..(581): n is a, c, g, or t
  modified_base (584)..(584): a, c, t, g, unknown or other
  misc_feature (584)..(584): n is a, c, g, or t
  modified_base (586)..(587): a, c, t, g, unknown or other
  misc_feature (586)..(587): n is a, c, g, or t
  modified_base (589)..(591): a, c, t, g, unknown or other
  misc_feature (589)..(591): n is a, c, g, or t
  modified_base (593)..(593): a, c, t, g, unknown or other
  misc_feature (593)..(593): n is a, c, g, or t
  modified_base (595)..(597): a, c, t, g, unknown or other
  misc_feature (595)..(597): n is a, c, g, or t
  modified_base (599)..(600): a, c, t, g, unknown or other
  misc_feature (599)..(600): n is a, c, g, or t
  modified_base (602)..(603): a, c, t, g, unknown or other
  misc_feature (602)..(603): n is a, c, g, or t
  modified_base (605)..(613): a, c, t, g, unknown or other
  misc_feature (605)..(613): n is a, c, g, or t
  modified_base (615)..(630): a, c, t, g, unknown or other
  misc_feature (615)..(630): n is a, c, g, or t
tcagtcacgtactacacgaccggtgctcgattttagctacgactgcagggccagtcagattgtcagcagcaactacttagcctggtaccagcagaagccctggcccagaccccccaggcctcctcatctagatgtattcaggaggaccactgacatcccagacaggttcagtggcgagttgggtctggggacagtacttcacttctcaccntcagcagactaggaacctgaacgtactttgaccttacttttatttcgngtacacctaagtagtggtaggtctaccgttaactacgttttggccgaggggaaccctaaggccgttaggagtagtaccgaacggacggtaaccgtagggttcgggtcttacggacctaacccgtacgtttccgtttacgttacccccgtttacttaacgtttccccgtttcccccggttacccgttaactttacccgtttacggttaaaggtttaacccggttaccgggttaacggttaccggttaacggggtacggggtaacccggggtcgggttacggtaacccgggtaacggggtacttacccgtagtaaacgtcgacncgntnntnnnanannnannanntnnnnnnnnntnnnnnnnnnnnnnnnn

SEQ ID NO: 231176 - DNA, 753 bp, Homo sapiens
  misc_feature: GYAE6OF01AY297.13.11.A11.1.454.CMB.1.raw
tcagtcacgtactacacgaccggtgctcgatttagctacgactgcgggggtaagaggttgtgtccaccatggcctggactcctctcctcctcctgctcctctctcactgcacgaggttccctctcgcaggctgtgctgactcagccgtcttccctctctgcttctcctggagcgtcagccagtctcacctgctaccttgcgcagtcggcacctaattgttcggtcctagtcgaacattattagttcggtaaccgtacgaaggaaacggcccgtaaggggaccttcccctccccgtaagttttcctccgttgggtacggttttcaagggtacccaaaacgttccgaaagaaacgttaaaccggacgtacggggtcttacgtcggacctccccgacgccgtacttcgcgtaggacaccgtaaggctacgtacttcgaccaacgcgtaaggtacttactacgtcctattcgttacggtcgggtccttaccgtagttacgtacggtaacgtaggtacgtacggtaccgtacggttaacttaacgttttaacgttggttttacgacgtttacggacgtaaacctaaaccgaccggttaccgttacggtagtttcccggttaccgggtaccgtcgggtacccgtaccgggtcctaacccggttaccggtacggtaccgaaccggtacccccgaaacggaccccctaaacccccgtcgttacccgtaaccgtacccttccgttaccccggtttacccccc

SEQ ID NO: 231177 - DNA, 567 bp, Homo sapiens
  misc_feature: GYAE6OF01B1Z7G.13.11.A11.1.454.CMB.1.raw
  modified_base (247)..(247): a, c, t, g, unknown or other
  misc_feature (247)..(247): n is a, c, g, or t
  modified_base (527)..(527): a, c, t, g, unknown or other
  misc_feature (527)..(527): n is a, c, g, or t
  modified_base (530)..(530): a, c, t, g, unknown or other
  misc_feature (530)..(530): n is a, c, g, or t
  modified_base (533)..(567): a, c, t, g, unknown or other
  misc_feature (533)..(567): n is a, c, g, or t
tcagtcacgtactacacgaccggtgctcgattttagctacgactgcagggccagtcagattgtcagcagcaactacttagcctggtaccagcagaagcctggccaggccccccaggcctcctcatctacgatgtattcaggaggaccactgacatcccagacaggttcagtggcaggtgggtctgggacagtcttcactctcaccatcagcagactcggaacctgaacgtactttgaccttattttntttcacgttccacctagttagtcggttacggtacctaccgttactacgttttcggaccgacggggaacctaggtccgtagggaacgtactacgaaagtaccggaaacgttggtcgggtacctcggtacctaaccgtacgtttcgttacgttcctttacctacctttcccgttacccctaccgtacttccgttaaggtacttaacgggttaccgtacggttacggtacggaacgggtccgggtcggtcgggaacggtaacgggaccgtagaagttacgcanctnagnnnnnnnnnnnnnnnnnnnnnnnnnnnnnnnnnnn

SEQ ID NO: 231178 - DNA, 700 bp, Homo sapiens
  misc_feature: GYAE6OF01ELM64.13.11.A11.1.454.CMB.1.raw
  modified_base (244)..(244): a, c, t, g, unknown or other
  misc_feature (244)..(244): n is a, c, g, or t
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttcggtccctatgacatatattggtaccganagaagccgagggacgtcctcccagtttctcctgagttcaggtacaactcagaataaacgcgaggctcgtggacgtccccagccgtcttctcgtggtactccgaaaggtactgtaacgttcccgaccgtaaacggcgtaaacggggtaattaacgttacctactaacgtccgttacgtcgggtccttacccgtagttccgttagaacggtaagtaggacgggtacttaggtaacccttaagtttacgttaggttttacgtacgtttcgggactaaccgaaaccgtaaccggtacccgtagggtactttaccgttaccgggtaacccggttacgggaacccgtaaccgggttaccaacccggtttacccgtaacgggtaccgaacggaacccccggaaacggaacccccgaaacccccctacgtaccgtacctaacccttccgtccccggttaccccc

SEQ ID NO: 231179 - DNA, 450 bp, Homo sapiens
  misc_feature: GYAE6OF01B9VOZ.13.11.A11.1.454.CMB.1.raw
  modified_base (410)..(410): a, c, t, g, unknown or other
  misc_feature (410)..(410): n is a, c, g, or t
  modified_base (416)..(450): a, c, t, g, unknown or other
  misc_feature (416)..(450): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaacctgaagactttgctactttattctgtcacctagtatggtagtcaccgtactacttttggccaggggaccaaggctggagatacgaagcgtaactggtggctggacaccatcgtcgtcttcacttcctcccgcctactctagtatagtacgtgacgtggacggtcgggtgaggcgaacggcgacgacgtaggnagtcannnnnnnnnnnnnnnnnnnnnnnnnnnnnnnnnnn

SEQ ID NO: 231180 - DNA, 468 bp, Homo sapiens
  misc_feature: GYAE6OF01CHI25.13.11.A11.1.454.CMB.1.raw
  modified_base (413)..(413): a, c, t, g, unknown or other
  misc_feature (413)..(413): n is a, c, g, or t
  modified_base (439)..(439): a, c, t, g, unknown or other
  misc_feature (439)..(439): n is a, c, g, or t
  modified_base (442)..(468): a, c, t, g, unknown or other
  misc_feature (442)..(468): n is a, c, g, or t
tcagtcacgtactacacgaccggtgctcgatttagctacgactgcagggccagtcagattgtcagcagcaactacttagcctggtaccagcagaagcctggccaggccccccaggcctcctcatctacgatgtattcaggaggaccactgacatcccagacaggttcaggtggctaggtgggtctggggacagacttcactctcaccatcagcagactggaacctagaagtactttgcttacttttattctgtcacctagtatggtagtcaccgttactactttcggccgagggggtacccaaggtcgtggagtactacgaaagcggaaactggtcgctcgccaccattctgtacttctatccctcccgcctatcgtagaattacggtacgtgtacgtgtacgggcgggttcngggaacgtaacggcgtacgagtagcngcnnnnnnnnnnnnnnnnnnnnnnnnnnn

SEQ ID NO: 231181 - DNA, 804 bp, Homo sapiens
  misc_feature: GYAE6OF01ELNU2.13.11.A11.1.454.CMB.1.raw
  modified_base (279)..(279): a, c, t, g, unknown or other
  misc_feature (279)..(279): n is a, c, g, or t
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtgacaccaatggttcgtccctatgacatattagttcggaccgacagaacgccgagggactccctaccctagtttccnccgtggtacggttcgaggtaccaaacgtcgaagtaaacgtaaaacggacgacggggtacctcggtacggaccgttacccccacggcccgttccgtttacctaccgttacgggactaacccggaaaggtactacgtaccgttacccggaacccgtaaacggaccgtaaaggggtactttaacgtttaaccctactacgtttaccgttcggttaccgggtaccccttaacggtacggttccgttaacggaaccggtaaggttacgggaacggttccgttaaggttaacctttaacggttttacgttttacggtttacggttaccgtttacgggacctaaaccgtaacccgtaaaccggtccgttaacgggtactttaccgggttaccggtacccggtacgggaacccggtaacccgggtttaaaccgttcccggtaacggtaccgacccggaaccccgtaaacccgggacccaaacccccgtacgtccgttacccgacctttcccgttacccgtcccccgttacccc

SEQ ID NO: 231182 - DNA, 486 bp, Homo sapiens
  misc_feature: GYAE6OF01ED0ML.13.11.A11.1.454.CMB.1.raw
  modified_base (200)..(200): a, c, t, g, unknown or other
  misc_feature (200)..(200): n is a, c, g, or t
  modified_base (240)..(240): a, c, t, g, unknown or other
  misc_feature (240)..(240): n is a, c, g, or t
  modified_base (244)..(244): a, c, t, g, unknown or other
  misc_feature (244)..(244): n is a, c, g, or t
  modified_base (450)..(486): a, c, t, g, unknown or other
  misc_feature (450)..(486): n is a, c, g, or t
tcagtcacgtactacacgaccggtgctcgatttagctacgactgcagggccagtcagattgtcagcagcaactacttagcctggtaccagcagaagccctggccaggccccccaggctcctcatctacgatgtattcgaggagaccactgacatcccagacaggttcagtggcaggtgggtctgggacagacttcactcncaccatcagcagactggaacctgaacgtacttgctatttnttcngtcacagtatggtacgtcaccgttactacgtttggaccgaggggtactcgaagctagggagtaactacgaaggccgtaactgggtcggctggacctacccgtatccgtcgttccttctaactcccgttccccacctacttcgtcgtaattacgtacggtgtaacgtggacgccggggcgtaggacggaacggcgactaagtgacgnnnnnnnnnnnnnnnnnnnnnnnnnnnnnnnnnnnnn

SEQ ID NO: 231183 - DNA, 473 bp, Homo sapiens
  misc_feature: GYAE6OF01CLP9H.13.11.A11.1.454.CMB.1.raw
  modified_base (437)..(473): a, c, t, g, unknown or other
  misc_feature (437)..(473): n is a, c, g, or t
tcagtcacgtactacacgaccggtgctcgatttagctacgactgcagggccagtcagattgtcagcagcaactacttagcctggtaccagcagaagcctggccaggccccccaggcctcctcatctacgatgtattcaggagaccactgacatcccagacaggttcagtgcagtgggtctgggacagtacttcactctcaccatcagcagctaggaacctagaacgtactttgctacttttattctgtcacctagtagtggtaacggtcctaccgtatactttcggaccgaggggaccaagtcgtaggacatacgaagacgtaacgtgtggctgaccactagtctcgtccttcacttcctcccactattctggtaacttacgtacgtcgacgtggacggtcggcgtcggaccggtaaggccgtacgagtagcgtcannnnnnnnnnnnnnnnnnnnnnnnnnnnnnnnnnnnn

SEQ ID NO: 231184 - DNA, 690 bp, Homo sapiens
  misc_feature: GYAE6OF01B79FT.13.11.A11.1.454.CMB.1.raw
  modified_base (255)..(255): a, c, t, g, unknown or other
  misc_feature (255)..(255): n is a, c, g, or t
  modified_base (636)..(636): a, c, t, g, unknown or other
  misc_feature (636)..(636): n is a, c, g, or t
  modified_base (686)..(686): a, c, t, g, unknown or other
  misc_feature (686)..(686): n is a, c, g, or t
  modified_base (688)..(688): a, c, t, g, unknown or other
  misc_feature (688)..(688): n is a, c, g, or t
tcagtcacgtactacacgaccggtgctcgatttagctacgactgcagggccagtcagattgtcagcagcaactacttagcctggtaccagcagaagcctggccaggcccccaggctcctcatctagatgtattcaggagaccactgacatcccagacaggttcagtggcagtggtctgggacagacttcactctcaccatccagcacgcctgactagtactagaacgtattttgactagttctattactgtcagnagtataactaactggtacctaccgtaactacgtagttaactaccgtttttcggaccgaaacccggtacaaccgtcggtaacgaacgtaccgggtaaccgaacgttcggtacggacgttaccggtaccgtaaccacgttaccgttacgtttaccgtttaccgttaaccgttaccctttaccccggtaccctaacgttaccgttaacggtaaacgtttaaacggtttaacccggttacggtaaacccgttttaaggggaccgggtaccgggggtacccgttaacggggaacccggttaacgggtacccgggaaccctaagttaaacggacggtaccacgaacggactacgacgtacgacgtacacgtacgacgtacgacgtanacgacgtcaccgtacgtacgtacacgacactacacgacagtacgacatangnga

SEQ ID NO: 231185 - DNA, 510 bp, Homo sapiens
  misc_feature: GYAE6OF01E3WFL.13.11.A11.1.454.CMB.1.raw
  modified_base (423)..(423): a, c, t, g, unknown or other
  misc_feature (423)..(423): n is a, c, g, or t
  modified_base (455)..(455): a, c, t, g, unknown or other
  misc_feature (455)..(455): n is a, c, g, or t
  modified_base (463)..(463): a, c, t, g, unknown or other
  misc_feature (463)..(463): n is a, c, g, or t
  modified_base (465)..(465): a, c, t, g, unknown or other
  misc_feature (465)..(465): n is a, c, g, or t
  modified_base (468)..(468): a, c, t, g, unknown or other
  misc_feature (468)..(468): n is a, c, g, or t
  modified_base (474)..(485): a, c, t, g, unknown or other
  misc_feature (474)..(485): n is a, c, g, or t
  modified_base (487)..(488): a, c, t, g, unknown or other
  misc_feature (487)..(488): n is a, c, g, or t
  modified_base (490)..(510): a, c, t, g, unknown or other
  misc_feature (490)..(510): n is a, c, g, or t
tcagtcacgtactacacgaccggtgctcgatttagctacgactgcaggccagtccagattgtcagcagcaactacttagcctggtaccagcagaagcctggccaggcccccaggctccctcatcctacgactgtattcaaggacgaccactgacatccccgagaccaggttcagtggcagtgggtctgggacagtaccttcactctcaccatcagcagtactggaacctgaacgtactttgcttactttttagttcctgtacaccctaggttattgggtacgtccaccgtactacgttttcggccgaggggaaccaaggtctgggatacgtcaaacgcgtaaacttggtacgcgttgaaccactactcttcgttccttctaccttcccttccccgcctactctcgtaagtacggtactgtacnggtaacgcgggtcgtacgcgtaaaggccgaanactagatnangcngacgtnnnnnnnnnnnncnncnnnnnnnnnnnnnnnnnnnnn

SEQ ID NO: 231186 - DNA, 760 bp, Homo sapiens
  misc_feature: GYAE6OF01E5AYD.13.11.A11.1.454.CMB.1.raw
tcagtcacgtactacacgaccggtgctcgatttagctacgactgcaggggtctgggagaggagccccagccctgagattcccaggtgtttccattcagtgatcagcactgaacacagaggactcaccatggagttgggactgagcttggtatttttccgtttggacttaagttttaaaaggtgtcctagtgtagaagtgcagtcgtgggtggagtcggtggggggtagtcttaggtacagcctaggcgtacggtccctagacgtacctcgtcctggtcgctacgtcctacgtggtactttcactttcgtttagattaggtatttacgtcgacctagtacggccgtaacggtccgggggtacccacgtaacggtccggtaccgggaagggggtaccgggtccgtggggtacggttcgggtcgttagtaacgggtttaagtttacgggtaagggtaagttaacgggttaggtaaaccgtagttacgggattacggtcgggtaccggtacgttggtacgggtaacgggtaacgggtcccgttaacttcccgtaaccgtacgtcccgttaaccgaaggaacgtaaacccgaacccgaacgtaaaccgtaaccctccgttagtactaccgtacgaactaagtaacgaacgtacgtgaggtacgagtacggacgacggtaccgttaccggtcttaaggtcttacgggtagtggtacggagtacggtacggtacgggtaaccccgtaaggttaacccgttcgtacgg

SEQ ID NO: 231187 - DNA, 824 bp, Homo sapiens
  misc_feature: GYAE6OF01BWEVC.13.11.A11.1.454.CMB.1.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcacgccgtcttccctctctgccttctccgtggagcgtcgacgccagtcctccacctcggtcctaccgttgcggctacggtggacctaaccgtaagttcggttccggttaccctatacgaactattagttaggttcggaaccaagaggacgccggaaggtacgtccctacccgttagttcctccgtagtacggttacgaacggtacaaaccgtcaaacgaacgtaaaccgacggagggtacctacggtaggtaacccgtccccgacggtccgttcgttacctacgtacggtacgtaaccgaggtacgtaacgttacctacccggaccgtaacggtacggaacggttaacttaacgttacctacttaccgttcggtcgtcgggtaccttccgtagttacccgtacggtaaacgtacggtacgtacggtaccgttaacgtaacgttttaacgtttacggttttacggtttacgttacggtaccggttaacccaaaccgggtaaaccgtacccggtccgggtttaccgtaaccgtttacccggggtttaccgaacccggtaccgggaaccgttacccgggtaaacgtcccggttaccggtacgtacccgacccggaaccccgtaaccccggtacccgtaacccgttaccgtacggttacccaccgtttcccggtaaccctttcccccg

SEQ ID NO: 231188 - DNA, 704 bp, Homo sapiens
  misc_feature: GYAE6OF01B7B44.13.11.A11.1.454.CMB.1.raw
  modified_base (645)..(645): a, c, t, g, unknown or other
  misc_feature (645)..(645): n is a, c, g, or t
  modified_base (661)..(661): a, c, t, g, unknown or other
  misc_feature (661)..(661): n is a, c, g, or t
  modified_base (663)..(663): a, c, t, g, unknown or other
  misc_feature (663)..(663): n is a, c, g, or t
  modified_base (669)..(670): a, c, t, g, unknown or other
  misc_feature (669)..(670): n is a, c, g, or t
  modified_base (672)..(672): a, c, t, g, unknown or other
  misc_feature (672)..(672): n is a, c, g, or t
  modified_base (676)..(679): a, c, t, g, unknown or other
  misc_feature (676)..(679): n is a, c, g, or t
  modified_base (681)..(682): a, c, t, g, unknown or other
  misc_feature (681)..(682): n is a, c, g, or t
  modified_base (684)..(684): a, c, t, g, unknown or other
  misc_feature (684)..(684): n is a, c, g, or t
  modified_base (686)..(694): a, c, t, g, unknown or other
  misc_feature (686)..(694): n is a, c, g, or t
  modified_base (696)..(698): a, c, t, g, unknown or other
  misc_feature (696)..(698): n is a, c, g, or t
  modified_base (700)..(704): a, c, t, g, unknown or other
  misc_feature (700)..(704): n is a, c, g, or t
tcagtcacgtactacacgaccggtgctcgatttagctacgactgcagggccagtcagattgtcagcagcaactacttagcctggtaccagcagaagcctggccagaccccccaggctcctcatctacgatgtattcaggagaccactgacatcccagacaggttcagtggcaggtgggtctgggacagtacttcactctacaccatcagcaagactaggaaccctagtaacgtcttttgaccttaacttttatttccgtagttaccaaccgttaaggttaagttgggttaacggttcctaacccggttaccgttaccgtttttacgggacccgtaacggggggtaacccctaaaaggtccgtttaggggaacgtaacttaccgaaaacggtaccgggtaaaccgtagggttcgggacctttacgggaccctaaaccccgtactttaccgtttcggtttacccttttacgtaccctttaccccgtttacccccgggccttaacgtttcccggttaaggttaaaccgtttaaccgggttaaccggttcggttaaaccggttacggggaaccggggttaccccggggggttacgttaccgggggtaacccgtaaacccgggggtaccgtaacgtaacggttaggacgngtactgactgcgcganangacganncngcgnnnncnncntnnnnnnnnnannnannnnn

SEQ ID NO: 231189 - DNA, 828 bp, Homo sapiens
  misc_feature: GYAE6OF01CCCCK.13.11.A11.1.454.CMB.1.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagcccgtcttccctctctgcttctcctggagcgtcagccagtctcacctgccaccttgcgcagtggcaccaatgttcggtccctatgactagtatagttacggtaccgacagaacgccgaagggacgtccctcccgtagtttcctccgtaggtaggttcgaacggttacaaactcgaagaacgtaaaccgacgacgggaccttcgtaggacccgtaccccgacggtccgtccttcgtcgtgggactaccgaagggtactacggtaacgttccccggaaccgaaccgacgtaagggtactttaacttaacccttacgtacttaccgtccggtttcgggaccctttaccggagttcctacgggtaacgtacggtacggacgggttaccttaggtaacctttttaagtttaaaccggttttcggttttaacgggttaccgtttaacgggaaccctaaacccgggttaaaaccctaaacccgggttccgttacggggttaaaacctttttcccgggtaaccccggggtacccgttaccgggggtaacccgttaacccgggttacccgtaaccccgggtttaccgtacgggtaccccgaaccgggtaccccctaaacccggtaaaccccccggtaacccccttacgggttcccttaaccgttccgtttccccgtcccggtttaccccccccg

SEQ ID NO: 231190 - DNA, 420 bp, Homo sapiens
  misc_feature: GYAE6OF01E1JAP.13.11.A11.1.454.CMB.1.raw
  modified_base (244)..(244): a, c, t, g, unknown or other
  misc_feature (244)..(244): n is a, c, g, or t
  modified_base (269)..(269): a, c, t, g, unknown or other
  misc_feature (269)..(269): n is a, c, g, or t
  modified_base (296)..(296): a, c, t, g, unknown or other
  misc_feature (296)..(296): n is a, c, g, or t
  modified_base (393)..(393): a, c, t, g, unknown or other
  misc_feature (393)..(393): n is a, c, g, or t
  modified_base (396)..(420): a, c, t, g, unknown or other
  misc_feature (396)..(420): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccatgacatcccagacaggttcagtggcaggtgggtctgggacagacttcactctcaccatcagcagactggaacctgaagtactttgctattttattctntcaccagtatggtaggtcaccgtanacttttggccaggggaccaagctgganatcaagcgaatgtggctgcaccatctgtcttcatcctcccgccactctgactagtacgtcgactggacgcgggctggacgaacggtcgacacgtagncgnnnnnnnnnnnnnnnnnnnnnnnnn

SEQ ID NO: 231191 - DNA, 692 bp, Homo sapiens
  misc_feature: GYAE6OF01DZJJ8.13.11.A11.1.454.CMB.1.raw
  modified_base (580)..(580): a, c, t, g, unknown or other
  misc_feature (580)..(580): n is a, c, g, or t
  modified_base (597)..(597): a, c, t, g, unknown or other
  misc_feature (597)..(597): n is a, c, g, or t
  modified_base (603)..(603): a, c, t, g, unknown or other
  misc_feature (603)..(603): n is a, c, g, or t
  modified_base (612)..(612): a, c, t, g, unknown or other
  misc_feature (612)..(612): n is a, c, g, or t
  modified_base (678)..(678): a, c, t, g, unknown or other
  misc_feature (678)..(678): n is a, c, g, or t
tcagtcacgtactacacgaccggtgctcgatttagctacgactgcagggccagtcagattgtcagcagcaactacttagcctggtaccagcagaagcctggccacggcccccaggcctcctcatcctacgatgtattcaaggacgaccatcgaacactcccagacaggttcagtgctagtcgggtctagggacacgtacttcactctccaccatcagcagtacctgaacctgaacgtctttacgacttaacttttacgttcgtacgtactacctaagtacgttacggttacggtacctaacccgttaacgtaccgtttttacgggaccgtaacggggaccctaaacggtcgtacgggagtaacgtaccgaaacggaccgtaacgtaggtacggtacttacggaacctaccgtactcggttacgttccgtttacctacgttacccgttaccccgtacctaacgtttcgtaacgttacgttaacggtaccggttacgtaccggtacggtacgggtaccggggtacttacgggaaccggtaccggtaaccggtacgtaactaagggtactaccgagtccgtancgttaagctagtacgtnactagngtacgtacngacgtacgacgtacgtacacagacgtacgtacgagtacggtacgtatatagacgtcgagtacgtancgtacgtgtcgacg

SEQ ID NO: 231192 - DNA, 552 bp, Homo sapiens
  misc_feature: GYAE6OF01AZKVK.13.11.A11.1.454.CMB.1.raw
  modified_base (178)..(178): a, c, t, g, unknown or other
  misc_feature (178)..(178): n is a, c, g, or t
  modified_base (192)..(192): a, c, t, g, unknown or other
  misc_feature (192)..(192): n is a, c, g, or t
  modified_base (207)..(207): a, c, t, g, unknown or other
  misc_feature (207)..(207): n is a, c, g, or t
  modified_base (211)..(211): a, c, t, g, unknown or other
  misc_feature (211)..(211): n is a, c, g, or t
  modified_base (512)..(512): a, c, t, g, unknown or other
  misc_feature (512)..(512): n is a, c, g, or t
  modified_base (523)..(552): a, c, t, g, unknown or other
  misc_feature (523)..(552): n is a, c, g, or t
tcagtcacgtactacacgaccggtgctcgatttagctacgactgcagggccagtcagattgtcagcagcaactacttagcctggtaccagcagaagcctggccaggccccccaggcctcctcactctacgatgtattcgaggagaccactgacactaccagactaggttcaggtgcgngtgggtcgtggganaggtacttcgactcncacntcagcagacttcggaacctggaaacgtacgtttcgtacttacttttaggttctcggttactaaccctagttaagttcgggttaacggtcctaaccggttacgtttaacgttttcggtacggaccggggtaacaacgtagttcgggaagttagaaccgtaagtacggtacgtacggtggtactggacccacttacgtcgttacgtacgttctacgttccctacgtcccaatttccgagttacgttagtacgttacgtcgtggaacgtccggggtactgggaccacggacgtagtacacggtnaagcgatcgcnnnnnnnnnnnnnnnnnnnnnnnnnnnnnn

SEQ ID NO: 231193 - DNA, 575 bp, Homo sapiens
  misc_feature: GYAE6OF01E05HX.13.11.A11.1.454.CMB.1.raw
  modified_base (129)..(129): a, c, t, g, unknown or other
  misc_feature (129)..(129): n is a, c, g, or t
  modified_base (545)..(575): a, c, t, g, unknown or other
  misc_feature (545)..(575): n is a, c, g, or t
tcagtcacgtactacacgaccggtgctcgattttagctacgactgcagggccagtcagattgtcagcagcaactacttagcctggaccagcagaagcctggccaggccccccaggctcctcatctacgntgtattcaggacgaccactgacactccccagacgtaggttcaggtggcgtagggttgggtcgtagggacacggtacctttcacctcctaccgaccatacgagcaacgtacgacggtaacctaggaaacgttctttgcctttactttttcgtttcctagtaccacgtagttcgtacggtacgtacctaaccgttcgttacgtttcggaccggtaacgggaccaggtcgtggaatacgtaccgaggtaccgtacggttgggtacgtccgtcgacctaaccgttcttcggttcgtttccttaccgtaccgtttccctacccggtcttacgttcgtacggttaacgtacggttaacggttcaacgggttcgaccgggccggtacggtacggaccgtgggacctagtaacgtgcagctgannnnnnnnnnnnnnnnnnnnnnnnnnnnnnn

SEQ ID NO: 231194 - DNA, 719 bp, Homo sapiens
  misc_feature: GYAE6OF01BR8MY.13.11.A11.1.454.CMB.1.raw
  modified_base (198)..(198): a, c, t, g, unknown or other
  misc_feature (198)..(198): n is a, c, g, or t
tcagtcacgtactacacgaccggtgctcgatttagctacgactgcaggggagaagagctgctcagttaggacccagagggaaccatggaaaccccagcgcagcttctcttcctcctgctactctggctcccagataccaccggagaaattgtgttgacgcagtctccaggcatcgtgttctttgtctacgaggggaancgcccaccctctcctgcagggccagtcagtattgcagcagcaacttatagcctaggtaccaggcaggaacgccgtggccacggccccaggtcctcctcatcctaggacttgtattcgaggacggaccacgtgaaccacttaccccgaagtaccgtaggtttacgaggtcggacgtagggtcgggttacgtaggggtacaaccggttacttacccgtacgttaccgtacctaaaccctagttccgtaacgtaccgtaacgtaaccgtaacggtaacccgttacggtaaacgttaccgtttacgtacctttacgttttacgtttcgtacgttaccgtaacgttaacgtttacgttacggttacgttaaccgtaaccgttacgttaaccgttttcgggaccggtaacgggtaacccgtaacggtaccgtacgggtaacgtacggtaacgtaacggtacgtaaccggttaggtcggaccgttacggacctaccgtacgttcctttacgttccgttaccgttaccg

SEQ ID NO: 231195 - DNA, 543 bp, Homo sapiens
  misc_feature: GYAE6OF01DHID5.13.11.A11.1.454.CMB.1.raw
  modified_base (521)..(543): a, c, t, g, unknown or other
  misc_feature (521)..(543): n is a, c, g, or t
tcagtcacgtactacacgaccggtgctcgatttagctacgactgcagggccagtcagattgtcagcagcaactacttagcctggtaccagcagaagcctggccaggccccccaggcctcctcatctacgatgtattcgaggaggaccactgacactcccagacaggttcaggtggcaggtgggtcgtgggacagaccttcacctctcaccatcagcagactggaacctgaacgtactttgacctacttttattcgtgtaccacctagttagtgggttacggtcctaaccgttacgtacttttcgggaccgaacggggacccaaggtccgtaggacggtaactacgaaacggaccgtaacgtgggtcggtacgtacggtcccaaccctacttccgttcgttccttacctaccgttccccgttacccccgcttacttcgtacgtaacgttaccggttaccgtcgtaacgtacgggacggtaccggggtgtaccgggacgtaacggggccacggtaactgctgnnnnnnnnnnnnnnnnnnnnnnn

SEQ ID NO: 231196 - DNA, 949 bp, Homo sapiens
  misc_feature: GYAE6OF01CTF6P.13.11.A11.1.454.CMB.1.raw
tcagtcacgtactacacgaccggtgctcgatttagctacgactgcgggggtaagaggttgtgtccaccatggcctggactcctctcctcctcctgctcctctctcactgctacacggttccctctcgcaggtctgtgctagactcacgtccgtcttccctctctgtcttcctccgtggacgtccgtcgacgtcccgagttctccaccgtgacctacgtgaccgcaggtacggacctaacgtagttcggttacgtaccctagtacgaactaattaacgttacgttaccgggtaaccgacgtaacggtaaccgaccggaacggggtacctacccccgttacccggttacgttacccgtccggtaggttaccggttacgtaaccggttaacctaaaccgttacgtaaacgtaaacggtaaaccggaccggtaagggtccttaccgggtacgggtaacccccgttccccgggaacggttccccgactttccggtagtaccgtacgtacgtaaaggttcgtaccgtaacccttacccggaacctaaaccggaccgggtaacggttaacttaaccggtttaacctccgtaacggtttccgtaccgggttacccgggttaacccgttacccgggttacggttaccggtaacggtaacccgggtaagttaccgggtacgttacgttaacggttacccgtttaagtttacccgggtttggttttaaccgtacgttaacggtaacctaaaccgggtaaccgtaacccgggtttcccgggtacggttaaccggtttccgtaaccccggggtaccgtaaccgggtacccccggttaaccggttaccccgaccggtaccgtttaaccggccctaacccggggaaccccgtaacccccgtaaccctaccccggtaaccgtttacgtacccccgtaccgttccccgttaaaccccgttcccccc

SEQ ID NO: 231197 - DNA, 763 bp, Homo sapiens
  misc_feature: GYAE6OF01AWCBH.13.11.A11.1.454.CMB.1.raw
  modified_base (445)..(445): a, c, t, g, unknown or other
  misc_feature (445)..(445): n is a, c, g, or t
tcagtcacgtactacacgaccggtgctcgatttagctacgactgcaggggtctgggagaggagccccagccctgagattcccaggtgtttccattcagtgatcagcactgaacacagaggactcaccatggagttgggactgagctggtattttcctttggacttaagttttaaaaggtgtccagtgtagaagtgcagcgtggtggagtcgtgggggagtcgttggtacacggtccgtggccgtacggttcccctaggacgtaccttccgtccgttggtcgaccgacgtcccctgtggtaatttcctaagtttcgtttagattagtatttagccgactagtcgctacggtcgggtaccagacgccgtacggacggggtacggctgggaggttgggtctaggtaggttattagggtggtaaatagggtagtaacgtagtaacggtnttaacgtcggtacgtacttggtagggttacggaccgggtcgtaactaccgtacctacgttacccgacgaacggtaacgtaacccgaaccgaccgtaaaccgtaccctaccccgttagtaccttacgtacgtaacgtaacgaacggtaaacccgtagtaccgtaagggtactaacggtacgtaacgggaacggtacccggttacggtacccgtttaacggttaaccgtttacggtacgggtttaaaccgaaaccggttaaaccgttaccgttaacgtttacggacggttacgggttaccggttacggtttaaccccggg

SEQ ID NO: 231198 - DNA, 590 bp, Homo sapiens
  misc_feature: GYAE6OF01CCZ12.13.11.A11.1.454.CMB.1.raw
  modified_base (200)..(200): a, c, t, g, unknown or other
  misc_feature (200)..(200): n is a, c, g, or t
  modified_base (505)..(505): a, c, t, g, unknown or other
  misc_feature (505)..(505): n is a, c, g, or t
  modified_base (518)..(518): a, c, t, g, unknown or other
  misc_feature (518)..(518): n is a, c, g, or t
  modified_base (521)..(521): a, c, t, g, unknown or other
  misc_feature (521)..(521): n is a, c, g, or t
  modified_base (528)..(528): a, c, t, g, unknown or other
  misc_feature (528)..(528): n is a, c, g, or t
  modified_base (536)..(536): a, c, t, g, unknown or other
  misc_feature (536)..(536): n is a, c, g, or t
  modified_base (538)..(538): a, c, t, g, unknown or other
  misc_feature (538)..(538): n is a, c, g, or t
  modified_base (540)..(540): a, c, t, g, unknown or other
  misc_feature (540)..(540): n is a, c, g, or t
  modified_base (542)..(542): a, c, t, g, unknown or other
  misc_feature (542)..(542): n is a, c, g, or t
  modified_base (548)..(548): a, c, t, g, unknown or other
  misc_feature (548)..(548): n is a, c, g, or t
  modified_base (552)..(552): a, c, t, g, unknown or other
  misc_feature (552)..(552): n is a, c, g, or t
  modified_base (554)..(554): a, c, t, g, unknown or other
  misc_feature (554)..(554): n is a, c, g, or t
  modified_base (556)..(556): a, c, t, g, unknown or other
  misc_feature (556)..(556): n is a, c, g, or t
  modified_base (565)..(566): a, c, t, g, unknown or other
  misc_feature (565)..(566): n is a, c, g, or t
  modified_base (569)..(569): a, c, t, g, unknown or other
  misc_feature (569)..(569): n is a, c, g, or t
  modified_base (577)..(577): a, c, t, g, unknown or other
  misc_feature (577)..(577): n is a, c, g, or t
  modified_base (585)..(585): a, c, t, g, unknown or other
  misc_feature (585)..(585): n is a, c, g, or t
  modified_base (587)..(587): a, c, t, g, unknown or other
  misc_feature (587)..(587): n is a, c, g, or t
tcagtcacgtactacacgaccggtgctcgatttagctacgactgcagggccagtcagattgtcagcagcaactacttagcctggtaccagcagaagcctggccaggcccccaggcctcctcatctacgatgtattcaggagaccactgacactcccagacaggttcagtggcaggtgggtctgggacagtacttcactcncaccatcagcagacgtaggaacctgaagtactttgactaacttttatttcagtaccaacctagtatcggtacgtacaccgttactacgtttcggaccgtacgggacagtcgtaggagactacgaagcggtaacgtggtacggctacgacctaaccaattccgttagtttaccttacgtaccttcccgtttacccccggactaactttcgtaacgtaagtttaaccggttacgtacgtaacggtacgggaacgggtaccggggtaccgtacgggaacggaaaccgggccgtaacgtaaagtagganacgtgagacaganacngcgaganagacacananananagaganaganananagtagagannacnatagacanacagtagngngac

SEQ ID NO: 231199 - DNA, 995 bp, Homo sapiens
  misc_feature: GYAE6OF01ECE3O.13.11.A11.1.454.CMB.1.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcacgtccgtcttccctctctcgtcttctcctggagtccgtcagccagttctccacctcgacctaccgttgccgcaggtcggacctaacctaagttcggtttaccggttaccccttagtacgaacctaagttaacgtttacgtttaccggtaacccgaacgaaggaacggtacccggtaacggggtacctcccccttaccccgttaagttttcctccgttaggtacggtttaccgaacggttaaccaaacgtacgaagtaaacgtaaaaccggacggtacgggtaccttcggtacggtaccggtcccccgtaacggtcccgttaccgtttccgtcggtaggtaactaccggaaaggttacgtacgtaccgttcccggaaccgtaacggacgtaacgggtactttaacgttacctacgttacgttaccgttcggtaccgggttacccttaccggtagttaccgttaacggtaaccggtaagttcgggtaaccggttacgtttacggttaacgtttttaacgttttccggttttaacggttttaccgggtaacgtttaccgggaaacccttaaacccggtaaaccgtaccccggttaccggtttaccggtttaaacccgtttacccgggtttaccccgggaaccggttaccccgggggttaaaccccgttacccggggtttaaccccgttaaaccccgggttttaccccgggttaacgggttaaacccccgtaccccgggaaaccccccgttaaaccccggggtaacccccccctaaaaccccggtttcggttaacccccggttaacccgtttacccccggtttacccccggtttaacccccgggtttcccccccccg

SEQ ID NO: 231200 - DNA, 867 bp, Homo sapiens
  misc_feature: GYAE6OF01A53I5.13.11.A11.1.454.CMB.1.raw
tcagtcacgtactacacgaccggtgctcgatttagctacgactgcaggggtctgggagaggagccccagcccctgagattcccaggttgtttccattcagtgatcagcactgaacacagaggactcaccagtggagttggactgagcgtggtactttttccgtttggacttaagttttaaaggtgtaccagtgtagaagtgacgagtcgtggtaggtacgtcggtggggacgtccgttaggtacgacgtccgtggacgtacggttccctaggacgtccgtccttccgtagtccgccgaccgtccgttcgtaggttacttccgtactttcgtttagtaattagttaactttacgtccgaccgttagtaccggtccgtacggttccggggtaccccgtacgaacggttcccgtaaccggggaacggggtaaccggtccggtacgggtacggttcggttaccgttaaggttaacgggtttaagtttacggggttaaggtaaaggttaccggttaaggtaaccgtaaggttccgtacgttaggtcggtaccggtaacgtttcggtaagggtaccgggtaacggtcccgttaactcccgtaacccgtacgttaccccgaaccgaaggtaaacccgaacccgaacccgtaacccgtaacggttacccgtaccgttaaccttcggttaacccaaacggttaaccgtaaagtaacccgtacggtaaccgttagaaccgggttaactccggtaacggtacgggaacccgtaacggttacccggtttaccgttaagttccgttaagtagggttaaccgaaaaccgttacgttaccgttacggttaacggactttacgggtcccgttagttaccccgg

SEQ ID NO: 231201 - DNA, 466 bp, Homo sapiens
  misc_feature: GYAE6OF01AV0ZS.13.11.A11.1.454.CMB.1.raw
  modified_base (237)..(237): a, c, t, g, unknown or other
  misc_feature (237)..(237): n is a, c, g, or t
  modified_base (380)..(380): a, c, t, g, unknown or other
  misc_feature (380)..(380): n is a, c, g, or t
  modified_base (449)..(466): a, c, t, g, unknown or other
  misc_feature (449)..(466): n is a, c, g, or t
tcagtcacgtactacacgaccggtgctcgatttagctacgactgcagggccagtcagattgtcagcagcaactacttagcctggtaccagcagaagcctggccacggcccccaggcctcctcatcctacgatgtattcgaggacgaccactgacactcccaagactaggttcagtggcaggtgggtcgtgggacagtacttcactctcacatcagcagacgtgaacctgaattcttnacttactttatttcgcgtactacctagttagtggtacggtacaccgttactacgttttacggaccgaacggggaccaagtcgtaggagactacgaacgtacgtacgttggtcggctcaccgtacctagttctcgttccttacnccttcccttcccgcctatccgtgaattacgtcgtacgtagtggacgcgggtgtcgacggacgcctgacnnnnnnnnnnnnnnnnnn

SEQ ID NO: 231202 - DNA, 693 bp, Homo sapiens
  misc_feature: GYAE6OF01CJQQN.13.11.A11.1.454.CMB.1.raw
  modified_base (136)..(136): a, c, t, g, unknown or other
  misc_feature (136)..(136): n is a, c, g, or t
  modified_base (201)..(201): a, c, t, g, unknown or other
  misc_feature (201)..(201): n is a, c, g, or t
  modified_base (206)..(206): a, c, t, g, unknown or other
  misc_feature (206)..(206): n is a, c, g, or t
  modified_base (611)..(611): a, c, t, g, unknown or other
  misc_feature (611)..(611): n is a, c, g, or t
  modified_base (614)..(614): a, c, t, g, unknown or other
  misc_feature (614)..(614): n is a, c, g, or t
  modified_base (628)..(628): a, c, t, g, unknown or other
  misc_feature (628)..(628): n is a, c, g, or t
  modified_base (637)..(637): a, c, t, g, unknown or other
  misc_feature (637)..(637): n is a, c, g, or t
  modified_base (640)..(640): a, c, t, g, unknown or other
  misc_feature (640)..(640): n is a, c, g, or t
  modified_base (644)..(645): a, c, t, g, unknown or other
  misc_feature (644)..(645): n is a, c, g, or t
  modified_base (647)..(647): a, c, t, g, unknown or other
  misc_feature (647)..(647): n is a, c, g, or t
  modified_base (649)..(649): a, c, t, g, unknown or other
  misc_feature (649)..(649): n is a, c, g, or t
  modified_base (652)..(652): a, c, t, g, unknown or other
  misc_feature (652)..(652): n is a, c, g, or t
  modified_base (656)..(656): a, c, t, g, unknown or other
  misc_feature (656)..(656): n is a, c, g, or t
  modified_base (659)..(659): a, c, t, g, unknown or other
  misc_feature (659)..(659): n is a, c, g, or t
  modified_base (687)..(687): a, c, t, g, unknown or other
  misc_feature (687)..(687): n is a, c, g, or t
tcagtcacgtactacacgaccggtgctcgatttagctacgactgcagggccagtcagattgtcagcagcaactacttagcctggtaccagcagaagccctggcccaggcccccagcctcctcatctacgatgtatnaggacgaccactgacatccccagactaggttcagtggcaggtggtctgggacagtcttcacctcncaccntcagccagtacgtacgggaaccctaggtaacgtaccgttttgaccctttaacgtttttactttccgttcgtacctaacccgtaggttaacgttcgggtaggttacccgtaacccggtaccttaccggtttttcgggaacccggtacgggggaacctaaggtccggtgggtaacggtaccttacgaaaccggtccgtaaacggttacggtcgggtaccgtcggtacccaacccgtaacgtttccgttacgtttccgtacccttacgtttcccccttaccccggtacttacctttacgtacgtacgtttaccggttaacgggtaccgaggttacggggtaaccggtcggggtaccgttacgggaccggtaaaacgggccgtaacccgtagtaacggtctaaggtcgntcncggatcgatcggancctggcctncgncggnngntntgngtgntcntcgtctgctgcgagctctcgtacgtcgngcgtcg

SEQ ID NO: 231203 - DNA, 546 bp, Homo sapiens
  misc_feature: GYAE6OF01EKFF3.13.11.A11.1.454.CMB.1.raw
  modified_base (244)..(244): a, c, t, g, unknown or other
  misc_feature (244)..(244): n is a, c, g, or t
  modified_base (508)..(508): a, c, t, g, unknown or other
  misc_feature (508)..(508): n is a, c, g, or t
  modified_base (510)..(518): a, c, t, g, unknown or other
  misc_feature (510)..(518): n is a, c, g, or t
  modified_base (520)..(546): a, c, t, g, unknown or other
  misc_feature (520)..(546): n is a, c, g, or t
tcagtcacgtactacacgaccggtgctcgatttagctacgactgcagggccagtcagattgtcagcagcaactacttagcctggtaccagcagaagcctggccaggccccccaggcctcctcatctacgatgttattcaggagaccactgacatcccagacaggttcagtggcagtggtctgggacagacttcactctcaccatcagcagactcggaacctgaacgtactttgacttacttttnttctgtcaccagtatgtaggtcaccgtactcttttcggccaggggacctaaaggctagggacgtaatcgaacggtccgaacgttggtaggtcctcgaccgtaacctaacgttcgttcgttcctttaccttaccgttttttccccccggacccttaactttaccgtttacgtaaacgtttagggtaacccggtttacgtaacgtttacgggaacgggtcccggggtacccgtgggaccgtaacggggtcctaacgagttacggangnnnnnnnnngnnnnnnnnnnnnnnnnnnnnnnnnnnn

SEQ ID NO: 231204 - DNA, 572 bp, Homo sapiens
  misc_feature: GYAE6OF01B41FK.13.11.A11.1.454.CMB.1.raw
  modified_base (193)..(193): a, c, t, g, unknown or other
  misc_feature (193)..(193): n is a, c, g, or t
  modified_base (206)..(206): a, c, t, g, unknown or other
  misc_feature (206)..(206): n is a, c, g, or t
  modified_base (217)..(217): a, c, t, g, unknown or other
  misc_feature (217)..(217): n is a, c, g, or t
  modified_base (241)..(241): a, c, t, g, unknown or other
  misc_feature (241)..(241): n is a, c, g, or t
  modified_base (507)..(507): a, c, t, g, unknown or other
  misc_feature (507)..(507): n is a, c, g, or t
  modified_base (533)..(533): a, c, t, g, unknown or other
  misc_feature (533)..(533): n is a, c, g, or t
  modified_base (538)..(538): a, c, t, g, unknown or other
  misc_feature (538)..(538): n is a, c, g, or t
  modified_base (540)..(572): a, c, t, g, unknown or other
  misc_feature (540)..(572): n is a, c, g, or t
tcagtcacgtactacacgaccggtgctcgatttagctacgactgcagggccagtcagattgtcagcagcaactacttagcctggtaccagcagaagcctggcccacggccccccaggcctcctcatctacgatgtattcaggaggaccatgacactcccgagacaggttcaggtggctaggtgggtctggganagtacttcactcncaccatcagcncgtcctgcacgccgtagtaagttnttttcgacttaactttacttactgtacttaaacaagtaactaccaacttaatttacgttccggtacgggtacccggttaccgggaacccgtaaaacgggggtaaccggtaaagggtaaggtaaaaccttaaccgtaaaaaccgtacggttagtacggtactaccgacctaacccgtattccgttactttacctttcctacttcccgtttaccccgacttacgtacgtgtaacgtacgtacgtcgtaacggtggtacgggccgggtntaacgggcgtaacgcgatacgtagcngcagncnnnnnnnnnnnnnnnnnnnnnnnnnnnnnnnnn

SEQ ID NO: 231205 - DNA, 940 bp, Homo sapiens
  misc_feature: GYAE6OF01BBY7U.13.11.A11.1.454.CMB.1.raw
  modified_base (198)..(198): a, c, t, g, unknown or other
  misc_feature (198)..(198): n is a, c, g, or t
tcagtcacgtactacacgaccggtgctcgatttagctacgactgcaggggagaagagctgctcagttaggacccagagggaaccatggaaaccccagcgcagcttctcttcctcctgctactctggctcccagactaccaccggagaaattgtgttgacgcagtctccaggcatcgtgtctttgtctcgaggggaaancgcccacctctacctgcgacgggccagtcagtatttcgcagtacagcctaacttacttacgccgtacggtaccagacgacggaacgccggtacggacccgaccggacccccgaggtcccctaccctcctaacgttaccgttaaccgtacgttacgtttaccgtttaccggaacgggttacccgggaacccgtaaccgttacggtaaacctacccttacccccggtaaacggtaccggttaacggggttacccgtaaggttaccgggaaccgtacggggttcggggttaccggtacggggtaaaccgtacggttaacccgttttaccggaaccccttccggtaaccctaacccgtaacgttacccgtaacggacccgtaacgtaaccggttaaccgggtaaacccgttaacgggtaaacgtttaccggttttaacccggtacctttttaaacccgttttttaccgttttcccgttaacggttttaacccgttaacccgttaaacgggtttaacggttaccgggggtttaaccggttaaccccggtttaaacccggttttaccggtttaacccgggtttttccggggaaccccgggttaacggggtaaacccgtacgggttaaccgggtacgggtaaacttaacggtaaccgggtaacgtaacgggttaacgttacgggttccgggtactaccggtaaccctacgtttacgttacgtttaccgtttccgtttacgttacccccg

SEQ ID NO: 231206 - DNA, 880 bp, Homo sapiens
  misc_feature: GYAE6OF01ENQWA.13.11.A11.1.454.CMB.1.raw
tcagtcacgtactacacgaccggtgctcgatttagctacgactgcgggggtaagaggttgtgtccaccatggcctggactcctctcctcctcctgctcctctctcactgcacaggttccctctcgcaggctgtcgctgacttcgacgccgttcttccctctctcgtcttcctccgtggacgtcgtcacgcctagtctcctaccgtgccgtaccgttcggccgcgtaggtcggaccaaccgtagttcggtttaccggtacccttagtacgtaactagtttaaagtttacgtttaccggggtaaccgtaacgtaaggtaaccggaccggaacggggttacccgttccccgttaccccgttacgttttccgttcgtacggttacggttaccggtacggttaaccaaaacgtacgaagtaaacgtaaaccggacggtaacgggtcctacggtacggtacccgtccccgtacgtcccggttaccttccgtacggtacggtaacgttacccggtaaaggtcgtacggtacccgttacccggaaccgtaaccggacggttaacgggtaactttaaccggttaaccttactacgttccgttacggtccgggtacttaccccggtagttacccggttaacggaaacggttcggtaacggtaaccggtttacgttaacgttaaccttttacgtttacccggtttagttaccggttacgttcgaaccgtaacgaaccgtacggtaccggtacggttaccgttaccggtaccggtacggaccgttaccggacgttcccgggtaacccgttacgggtaccgtacgtacccgaaccgtaaccccgtacccgaaacccgttcgtaccgtcctacgttcccgttcccgtaaccccg

SEQ ID NO: 231207 - DNA, 606 bp, Homo sapiens
  misc_feature: GYAE6OF01AW87X.13.11.A11.1.454.CMB.1.raw
  modified_base (240)..(240): a, c, t, g, unknown or other
  misc_feature (240)..(240): n is a, c, g, or t
  modified_base (573)..(573): a, c, t, g, unknown or other
  misc_feature (573)..(573): n is a, c, g, or t
  modified_base (577)..(606): a, c, t, g, unknown or other
  misc_feature (577)..(606): n is a, c, g, or t
tcagtcacgtactacacgaccggtgctcgatttagctacgactgcagggccagtcagattgtcagcagcaactacttagcctggtaccagcagaagcctggccaggcccccaggcctcctcatttatggtgcatccacgtacgggccacgtggtcgtcccagtcaggttcagcggcaggtgggtctgggacagtacttcactctccactagtcagcacgtcctgctagtctagtaagttnttttggctagttcttattacgttgtacgagtctaaggttatttaaggttacctagggaaacgtaaccccggtttcgggacccgtaaaggggacctaaaccgggtaccgaaggggtaaacgtaaaacgggtttaaaacggtaaccgtggggtttacggaccggtttacgacccgtaaccgttaacctttgttacccggttttccttttaacttaaccgtttcccccggtttacccccgtaacttacgtttacgtacggtaagtttaaccggttaacgtcggtaaacggtgggtacggccgggtagtcgggaacgtaccgggcgtaacagttagngcgnnnnnnnnnnnnnnnnnnnnnnnnnnnnnn

SEQ ID NO: 231208 - DNA, 654 bp, Homo sapiens
  misc_feature: GYAE6OF01BL6L8.13.11.A11.1.454.CMB.1.raw
  modified_base (317)..(317): a, c, t, g, unknown or other
  misc_feature (317)..(317): n is a, c, g, or t
  modified_base (371)..(371): a, c, t, g, unknown or other
  misc_feature (371)..(371): n is a, c, g, or t
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgctaccttgcgcagtgcaccatgttcgtcctatgacatatattcggtacgacaggaagccgagggacttccctcccctagtttcctccgtaggtacggttcacggtacaactcgaagaacgtaaacgngaggctcgtaggaccgtcccagtccctctttacgtcgtcggactaccgaaaggnttcgaccttccgaccgaacggacgagggtacttagttaccacgtactcttcggtcggtacctccgagttcgagaacgtagtggacgtctaacggtaacttattaccgttggtttacgtacgttacggacaaaccaaccgtacgtccggtagtacgttccggtacggtaccggtacggaccgtaccggtaccgtaacccgttcggtaccgaccgacccggtacccgaaccgggtaccccaacccgtcgttacggtacccctacttccgttacccgttacccccc

SEQ ID NO: 231209 - DNA, 442 bp, Homo sapiens
  misc_feature: GYAE6OF01EGHBJ.13.11.A11.1.454.CMB.1.raw
  modified_base (304)..(304): a, c, t, g, unknown or other
  misc_feature (304)..(304): n is a, c, g, or t
  modified_base (326)..(326): a, c, t, g, unknown or other
  misc_feature (326)..(326): n is a, c, g, or t
  modified_base (330)..(330): a, c, t, g, unknown or other
  misc_feature (330)..(330): n is a, c, g, or t
  modified_base (334)..(334): a, c, t, g, unknown or other
  misc_feature (334)..(334): n is a, c, g, or t
  modified_base (339)..(339): a, c, t, g, unknown or other
  misc_feature (339)..(339): n is a, c, g, or t
  modified_base (349)..(349): a, c, t, g, unknown or other
  misc_feature (349)..(349): n is a, c, g, or t
  modified_base (352)..(352): a, c, t, g, unknown or other
  misc_feature (352)..(352): n is a, c, g, or t
  modified_base (383)..(383): a, c, t, g, unknown or other
  misc_feature (383)..(383): n is a, c, g, or t
  modified_base (409)..(410): a, c, t, g, unknown or other
  misc_feature (409)..(410): n is a, c, g, or t
  modified_base (412)..(442): a, c, t, g, unknown or other
  misc_feature (412)..(442): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccatgacactcccagacaggttcagtggcaggtgggtctgggacagtaccttcactctccaccatcagcagactggaacctgaagtactttgactatttattctgtcaccagtagtggtacgtcctaccgtactacgttttggaccgagggaccaagtcgnggagagtcaagtcgatgtgctncacntctnttctnactcctcccnccntctagagtagtcgagtactggacggtcgggngtacggacgacgggtcgacagtacgnngnnnnnnnnnnnnnnnnnnnnnnnnnnnnnnn

SEQ ID NO: 231210 - DNA, 680 bp, Homo sapiens
  misc_feature: GYAE6OF01DW7VE.13.11.A11.1.454.CMB.1.raw
  modified_base (546)..(546): a, c, t, g, unknown or other
  misc_feature (546)..(546): n is a, c, g, or t
  modified_base (559)..(559): a, c, t, g, unknown or other
  misc_feature (559)..(559): n is a, c, g, or t
tcagtcacgtactacacgaccggtgctcgatttagctacgactgcagggccagtcagattgtcagcagcaactacttagcctggtaccagcagaagcctggccacggcccccaggcctcctcatctacgatgtattcaggacgaccactgacactcccagactaggttcaggtgctaggtgggtctagggacagtaccttcactcctacaccatccgacgcgaagtacgtacggaaacctaggtaacgtccttttaggacttactttttattcgtcgtacaaccgtaagttacgtacggttacggtaccgtaccgttacttaccggttttacggaccggtaacggggtaacctaaggtccgttaggacgtactacggaacgacggtaacgtggtacggcttcgacaccgtacgttcgttcgtaccttcgtaccttcccgttacccgccttactcgtacggtacgttacgtacgtaccgtacggtacgggtacggtaccgggtaccgtacgggaaccgtacgggtaccgtaacggtacgtagtacgntacgcgtgacgtncgtacgtgcgtactagacgtacgtacgcgtacgtacgtactacgtacgtacgagtcgtacgtacgtaggtacgtcgtagtacgtcgtacgtacgtacgtacgtacgtacgctcgtcgtacg

SEQ ID NO: 231211 - DNA, 741 bp, Homo sapiens
  misc_feature: GYAE6OF01CLZSP.13.11.A11.1.454.CMB.1.raw
  modified_base (172)..(172): a, c, t, g, unknown or other
  misc_feature (172)..(172): n is a, c, g, or t
tcagtcacgtactacacgaccggtgctcgatttagctacgactgcgggggtaagaggttgtgtccaccatggcctggactcctctcctcctcctgctcctctctcactgcacagttccctctcgcaggctgtgctgactcagccgtcttccctctctgtctctcctgggacncgtcagccagttctccacctgcctaccttgcgcaggtcgacaactaattggttcggtaccctagtcgactattatagttcggaccgaagagaagccaggggacctccctcccttacgtttcctccgtagtacggttctaacggtactaactcgaagtaacgtaaccgacgtaggctcggtaggtaccgtcccgacgcgtcttctcgcgtactacgagacgtgacctccgaccgtagacgacggtatacgttactctacgtcgtcgtcggtaccgtacctacggtacgtacgtaacggtagtacggtacggtactagttaaccctttacgttttaacgttacggttttacgtaccggttagacctaaaccgtaacctaaccggttaaccgtacggtaccgtttaccggttacccgggtaccggtaacccgggtacccggtaccggttacccggtacccggttacccggttaccggtacccggaacccggtaaccccgaacccggaacccccctacccgtaccgttacccgttaccctttacccgtacccgtttccccgttaacccccccg

SEQ ID NO: 231212 - DNA, 864 bp, Homo sapiens
  misc_feature: GYAE6OF01AT36S.13.11.A11.1.454.CMB.1.raw
  modified_base (251)..(251): a, c, t, g, unknown or other
  misc_feature (251)..(251): n is a, c, g, or t
tcagtcacgtactacacgaccggtgctcgatttagctacgactgcaggggtctgggagaggagccccagccctgagattcccaggtgtttccattcagtgatcagcactgaacacagaggactcaccatggagttgggactgagctggattttcctttggctattttaaaggtgtccagtgtgagtgcagctggtggagtcgtgggggagcttggtacagcctggcacggtccctgagacctctacctgtncgagcctcgtggacttcgattcttttgatgtattacgttcgacctatcggccgtacgttccggggtaccccggacgtaacggtacccgttacccggaacgggggtaaacgggtccccgtggggtaacggtttgggggttacctacggaagggttttaacgtttaacgggtttcggtaaaaaggttaccggttacgggttaaaacgtaacgttacgggggtacccttttaaagacggggtacccccggggttaatttcccggggtttagggtaacggggtaaacccggggtaccccggtaagttttcccccggaaccccgttaggttacccccgttacccggaaacggggttaaacgaacccgtaaaccccgggtacccgtaaaaaccggtaccccctttaacccccggtagtttaacccgttaccgttaacgaaaccggttaaaactaaccggggtaacctaaccgttccgtaaggttcggaacgtacccgtgggtaacccgggtaccgtaaaccgggttcccctttagggtttacccttacgtcggtttaacggaacccgttaaaccggttccttaacggtttacgaccgtaggttcggtccgtttaccggg

SEQ ID NO: 231213 - DNA, 696 bp, Homo sapiens
  misc_feature: GYAE6OF01EPFE6.13.11.A11.1.454.CMB.1.raw
  modified_base (687)..(687): a, c, t, g, unknown or other
  misc_feature (687)..(687): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtggtctgggacagacttcactctcaccatcagcagactggaacctgaagtattttagctagtgtattactgtcagcagtatggtagctcaccgtcggacgttccggaccaaggggaccgaaagggttcgggaaaacttacgaaaaaccggtaacgttacgggtaggtaccgttacggaccaaccccgtaagttccttacggttaccttttacctaacgtttccccgtttacccccgtaccccggttaactttacccgttaggtaacgttaacggtttaacccgggttacgtaacccgtttacgggaaaccgggtcccgggggtaccgtttacgggggaacccggtaaaagggggtcccggtacccgtaaacgggtttaacgggacgacgtacgtacgtacgtacgtacgtacgagagacgacgtacgtcgacgtacgtacgacgtacgtacgtaccgtactacgacgtcgtacgactacgacgtacgtagtacgcacgtcgagtacgtacaganacgagtacg

SEQ ID NO: 231214 - DNA, 794 bp, Homo sapiens
  misc_feature: GYAE6OF01C8H5Q.13.11.A11.1.454.CMB.1.raw
  modified_base (113)..(113): a, c, t, g, unknown or other
  misc_feature (113)..(113): n is a, c, g, or t
  modified_base (186)..(186): a, c, t, g, unknown or other
  misc_feature (186)..(186): n is a, c, g, or t
  modified_base (284)..(284): a, c, t, g, unknown or other
  misc_feature (284)..(284): n is a, c, g, or t
tcagtcacgtactacacgaccggtgctcgatttagctacgactgcgggggtaagaggttgtgtccaccatggcctggactcctctcctcctcctgctcctctctcactgcacncggttccctctcgcgaggctgtcgctgactcacgccgttcttccctctctgcttctcgtggagcgtcacgccngtctccacctgcctaccttcgaccgctagggtcacctaaccgagtttcggttccggtaccctagtacgaactaattagttaacgttacggaaccgaanaaggacgaccgtacgggtacgtcccctacccgtttattccgttcgaggtacgttacgacggtaactaactacgaacgtaacaacggacggacggctacggcgaaccgtcccgacgcccgttccttagcgtagacacggaagttcgtacgtcccgttacgaacccgaacgacggacggtactttaacttacgtaccgtacttccgtacgggtccggtacccttacggtacgtaccggtagtaaccgtggtcgtacggcgttacttaaaccgtttacgtttacggtttcgtttaaggtaccgttacgaacccgtaaaccgtaacccggtactttaccgggtcgtaacccgttacgggttacccggcgggttaacccgggacccgtaccggtaccgttacccgtaccgggtacgacccgggttaccgaacccccggaaacccggtaccccctaaacggccctttacccgggtacccgtttacccgttcccggttccccctttaaaccccccgg

SEQ ID NO: 231215 - DNA, 586 bp, Homo sapiens
  misc_feature: GYAE6OF01DICVD.13.11.A11.1.454.CMB.1.raw
  modified_base (207)..(207): a, c, t, g, unknown or other
  misc_feature (207)..(207): n is a, c, g, or t
  modified_base (267)..(267): a, c, t, g, unknown or other
  misc_feature (267)..(267): n is a, c, g, or t
  modified_base (536)..(536): a, c, t, g, unknown or other
  misc_feature (536)..(536): n is a, c, g, or t
  modified_base (543)..(544): a, c, t, g, unknown or other
  misc_feature (543)..(544): n is a, c, g, or t
  modified_base (548)..(586): a, c, t, g, unknown or other
  misc_feature (548)..(586): n is a, c, g, or t
tcagtcacgtactacacgaccggtgctcgatttagctacgactgcagggccagtcaagattgtcagcagcaactacttagcctggtaccagcagaagcctggccaggcccccagctcctcatcagatgtattcaggagacactgacatcccagcagttcagtggcaggtgggctagggacacgtacttcactctacacctagccaancgtaacggtaacgtcggtaaaaccgtagtaacggttactttacggtactttaactttttntttacctacgtcttaaacccgtagttacggttacgggttaaggttacccgtaaccgtttacgttcgttttaaccggaccggtaacgggtaaccgtaacggaggtacggaagttacaccggaaagtccggtaaacgtcgtcggtactacggacctaactaagttcctagtttcctacgtacctaccgttcccacgtcgtttacaaggtacttaaggtactacggacgttcggaccgggtaggtccggaggaaccggagggacctaacgtntaacggnngacnnnnnnnnnnnnnnnnnnnnnnnnnnnnnnnnnnnnnnn

SEQ ID NO: 231216 - DNA, 768 bp, Homo sapiens
  misc_feature: GYAE6OF01AX4IM.13.11.A11.1.454.CMB.1.raw
tcagtcacgtactacacgaccggtgctcgatttagctacgactgcaggggggacacagcctactctgaggcatcccttccagaagtcactatacagtaggagacatgcaaatggggtcctccctctgccgatgaaaaccagcccagccctgaccctgcagctctgggagaggagccccagccctgagacttcccacgtgttcgcctattcggtgatcagcactgaacacagacgactcaccagtggtagttttggctgagtcgttgggttttccttgttgtcttaagttttaaaggcgtccctagtgtggaggtcgcagtcgtggtggtagtcgtgggaggaggtcttgactccgacggtccggtcgggggtccctggtacgtacgtccgtccgtcggtcgcgacggtcccgttcgttcgggttacctacccggtacgtacgttccaaccgtacccgtactacgtacggtacgtccggttccggggtaccccgtacccggaccggtccccgtaacccgggaaggggggtaacggggtccggtacggggttaacggttccggttacccggtttccgttttacgttttttaacgttttaacgggtttaacgggtttaacggtttagggtttaaccggttaaccgttaaccgttaacccgtacccgggtaccgtaacgggttaccccggttccgggttacggggacccggggttacccgttaaccgttcccgaacccttaacgttccccgtaaccggtaacgtaaacccgg

SEQ ID NO: 231217 - DNA, 801 bp, Homo sapiens
  misc_feature: GYAE6OF01ASXOR.13.11.A11.1.454.CMB.1.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcacgccgtcttccctctctgcttctccgtggacgcgtcagccagtctcacctgcctacctgcgcaggtcgaccactattcgttcggtccctatacgactattagtacttcggtaaccgacgagaacgccgtaagggaccttcccctacccgtagtttcctaccgtaggtacggtttacaggtaccaaactcgaacgaactaaaccggtacgagggtccttcggtacggaccgtccccgaggtcccttacgtttcacgtcggtaacgtaccgaaaggtctacggaccgttacccgaccggaacggcgtaaggtacttaacttactacgttactccgtcggtcgggtccctacgtacggttacgttacgacgttaagtcgggtacgtaccgttaggttaacctttacgtttacgtttgggttttacctaacgggtaacccgaacgtaaacccaaacgggttaccccgtcggttaaccgttccggttacccgttacccggtaaccggggtaccggttacccggtaccgggttaccgtaaccccgggttaccggtaccgggtacccgtaaccccggggtaacccccaaccgggtaaccccccttaacccccgtaccggtttacccacccgtttaccccttcccgggttccccgtttaccccccgg

SEQ ID NO: 231218 - DNA, 884 bp, Homo sapiens
  misc_feature: GYAE6OF01DJP26.13.11.A11.1.454.CMB.1.raw
  modified_base (639)..(639): a, c, t, g, unknown or other
  misc_feature (639)..(639): n is a, c, g, or t
tcagtcacgtactacacgaccggtgctcgatttagctacgactgcgggggtaagaggttgtgtccaccatggcctggactcctctcctcctcctgctcctctctcactgcacaggttcccctctcgcaggctgtgctgactacacgtcccgttccttccctctctcgtccttctccgtggagccgtcgacgcctacgtcctacacccgtcgaccttaccgttggccgacgtacggtcggaccctaaacccgttaaagttcggtttaccggttacccctagttacgtaaccttaattaacttagggtttaccgggtaacccaaacgaaacggaaacggacccggtaaccgggggtaacctttccccccgttacccgtttaccgttttcccttaccggttaggttaacggttaccgtaacggttaacctaaaaccgttacgaaacggtaaaaccgaaaaccggtaccggtaacgggtccgttaccggttaccgggtacccgtacccccggaacgtccccgttccttccggtcgtacgaccgttaccgaaagggtactcgaaccgttcccgaacccgaacgtaccgtagggtaacttacttaccgtactactccgttacgtcgtcctacgtacgtgaccggngtaagtcggacgtacgtcttaaagttacccgtttagttcggtttacgtacgttaccgaaccaacgtaacccgtacgtcggttacgtacgttacccggttacggaccggtccgtaaaccccgggtacgtaccccgttaccggttaccggtaacccggtccgaacccggtacccccgaaaccgtaccccctaaacccgttcctaacccgttaccctaaccccttccggttcccccttaaaccccccg

SEQ ID NO: 231219 - DNA, 566 bp, Homo sapiens
  misc_feature: GYAE6OF01EO39W.13.11.A11.1.454.CMB.1.raw
  modified_base (208)..(208): a, c, t, g, unknown or other
  misc_feature (208)..(208): n is a, c, g, or t
  modified_base (219)..(219): a, c, t, g, unknown or other
  misc_feature (219)..(219): n is a, c, g, or t
  modified_base (488)..(488): a, c, t, g, unknown or other
  misc_feature (488)..(488): n is a, c, g, or t
  modified_base (522)..(523): a, c, t, g, unknown or other
  misc_feature (522)..(523): n is a, c, g, or t
  modified_base (525)..(525): a, c, t, g, unknown or other
  misc_feature (525)..(525): n is a, c, g, or t
  modified_base (532)..(533): a, c, t, g, unknown or other
  misc_feature (532)..(533): n is a, c, g, or t
  modified_base (535)..(566): a, c, t, g, unknown or other
  misc_feature (535)..(566): n is a, c, g, or t
tcagtcacgtactacacgaccggtgctcgatttagctacgactgcagggccagtcagattgtcagcagcaactacttagcctggtaccagcagaagcctggcccaggccccccaggcctcctcatcctacgatgtattcgaggagaccactgaacactcccaagaccgtaggttcaggtggcaggtgggtcgtagggacagtacttcnctcctccaacntcagcaagacgtaggaacctgaaacgttcgtttgaccttaacgttttattcgcgtaccaccgtagtacgttggtacgtacctaaccgttacttaccgttttacgggaccggaacgggtaaccgacgtacggtagggtaactaagtaacgaacggtacggtaacgttgggtacggtccttacggcctaaccgtacgttccgtttcttaccttcccgtactttcccgtacccctagtacttacgtacgtagtacgtacgtgcgtaggcggngggtcgaggaacgtacgacgacgtagtcgatganncngtgctcnngnnnnnnnnnnnnnnnnnnnnnnnnnnnnnnnn

SEQ ID NO: 231220 - DNA, 456 bp, Homo sapiens
  misc_feature: GYAE6OF01A4UQX.13.11.A11.1.454.CMB.1.raw
  modified_base (414)..(427): a, c, t, g, unknown or other
  misc_feature (414)..(427): n is a, c, g, or t
  modified_base (429)..(441): a, c, t, g, unknown or other
  misc_feature (429)..(441): n is a, c, g, or t
  modified_base (443)..(456): a, c, t, g, unknown or other
  misc_feature (443)..(456): n is a, c, g, or t
tcagtcacgtactacacgaccggtgctcgatttagctacgactgcagggccagtcagattgtcagcagcaactacttagcctggtaccagcagaagcctgggcccaggccccccaggctcctcatctacgatgtattcaggaggaccactgacatcccagacaggttcagtggcaggtgggtctggggacagacttcactctcaccatcagcagactggaacctgaagacttttgctactttattctgtcaccagtatggtaggtcaccgtacacttttggactaggggacaacgctggagtagtacaagtcgaaactgtggctagcacccaattctgttctcatccttcccgcctatctagtatagttacgtagacttggaagcgggtctggactaagggcgactagaagtannnnnnnnnnnnnnannnnnnnnnnnnnannnnnnnnnnnnnn

SEQ ID NO: 231221 - DNA, 456 bp, Homo sapiens
  misc_feature: GYAE6OF01DBQW9.13.11.A11.1.454.CMB.1.raw
  modified_base (426)..(427): a, c, t, g, unknown or other
  misc_feature (426)..(427): n is a, c, g, or t
  modified_base (429)..(456): a, c, t, g, unknown or other
  misc_feature (429)..(456): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagtactttgctactttattctgtcaccagtagtggtacgtctaccgttactacgttttcggaccgtaggggaccaaggctaggagatacgaagacgaacgtggtcggctgacactactctgtccttcacttccttccccgcctatctagacttacggtaccgtgacgtaggcgcgggtcgtacgggacgaacggcgacgataggnngnnnnnnnnnnnnnnnnnnnnnnnnnnnn

SEQ ID NO: 231222 - DNA, 527 bp, Homo sapiens
  misc_feature: GYAE6OF01B5ZL6.13.11.A11.1.454.CMB.1.raw
  modified_base (320)..(320): a, c, t, g, unknown or other
  misc_feature (320)..(320): n is a, c, g, or t
  modified_base (441)..(441): a, c, t, g, unknown or other
  misc_feature (441)..(441): n is a, c, g, or t
  modified_base (444)..(444): a, c, t, g, unknown or other
  misc_feature (444)..(444): n is a, c, g, or t
  modified_base (454)..(455): a, c, t, g, unknown or other
  misc_feature (454)..(455): n is a, c, g, or t
  modified_base (457)..(458): a, c, t, g, unknown or other
  misc_feature (457)..(458): n is a, c, g, or t
  modified_base (460)..(461): a, c, t, g, unknown or other
  misc_feature (460)..(461): n is a, c, g, or t
  modified_base (463)..(463): a, c, t, g, unknown or other
  misc_feature (463)..(463): n is a, c, g, or t
  modified_base (465)..(465): a, c, t, g, unknown or other
  misc_feature (465)..(465): n is a, c, g, or t
  modified_base (473)..(473): a, c, t, g, unknown or other
  misc_feature (473)..(473): n is a, c, g, or t
  modified_base (481)..(481): a, c, t, g, unknown or other
  misc_feature (481)..(481): n is a, c, g, or t
  modified_base (487)..(487): a, c, t, g, unknown or other
  misc_feature (487)..(487): n is a, c, g, or t
  modified_base (489)..(489): a, c, t, g, unknown or other
  misc_feature (489)..(489): n is a, c, g, or t
  modified_base (493)..(493): a, c, t, g, unknown or other
  misc_feature (493)..(493): n is a, c, g, or t
  modified_base (506)..(506): a, c, t, g, unknown or other
  misc_feature (506)..(506): n is a, c, g, or t
  modified_base (508)..(508): a, c, t, g, unknown or other
  misc_feature (508)..(508): n is a, c, g, or t
  modified_base (517)..(517): a, c, t, g, unknown or other
  misc_feature (517)..(517): n is a, c, g, or t
  modified_base (519)..(519): a, c, t, g, unknown or other
  misc_feature (519)..(519): n is a, c, g, or t
  modified_base (521)..(521): a, c, t, g, unknown or other
  misc_feature (521)..(521): n is a, c, g, or t
  modified_base (525)..(525): a, c, t, g, unknown or other
  misc_feature (525)..(525): n is a, c, g, or t
tcagtcacgtactacacgaccggtgctcgatttagctacgactgcagggccagtcagattgtcagcagcaactacttagcctggtaccagcagaagcctggccaggcccccaggctcctcatcctagatgtacttcaggagaccatgacatcccagacagttcagtggcagtggctgggacagacttcactctacgacctagccaggctaaggaccttgggaaccttggaaactcttttagactacgtttttatttccgagttcaaccagtatggtagttacacgtacacgttttggaccagggaccaagctaggagtancaagctaagtgtaggctgactaccagtacctgtctaccagtcctttccgacccaatctacggtactagtaacgttgaccttaggacggacgggtacgacggcgaaacggcgacgagttagnganaaccgtgaannannannananagtacganacagaganatagananaganacagatagacganancagagacananantgtnac

SEQ ID NO: 231223 - DNA, 491 bp, Homo sapiens
  misc_feature: GYAE6OF01CCKS5.13.11.A11.1.454.CMB.1.raw
  modified_base (259)..(259): a, c, t, g, unknown or other
  misc_feature (259)..(259): n is a, c, g, or t
  modified_base (323)..(323): a, c, t, g, unknown or other
  misc_feature (323)..(323): n is a, c, g, or t
  modified_base (457)..(457): a, c, t, g, unknown or other
  misc_feature (457)..(457): n is a, c, g, or t
  modified_base (462)..(462): a, c, t, g, unknown or other
  misc_feature (462)..(462): n is a, c, g, or t
  modified_base (464)..(464): a, c, t, g, unknown or other
  misc_feature (464)..(464): n is a, c, g, or t
  modified_base (467)..(491): a, c, t, g, unknown or other
  misc_feature (467)..(491): n is a, c, g, or t
tcagtcacgtactacacgaccggtgctcgatttagctacgactgcagggccagtcagattgtcagcagcaactacttagcctggtaccagcagaagccctggcccaggccccccaggcctcctcatctacgatgtattcagggagaccactgacatccccagacaggttcagtcggctaggtgggtctggggacaggaccttcactcgtccaccatcagcaagactggaacctgaacgtctttgcttacttttttaccngtacactagtagtggtaggtcctaccgttacttcgtttcggaccgacgggaaccagtcgtgganatacaagccgtaagtggtcgcgtcgcaccgtacttctcgttctcctaccgttcccttccccggcttactaccgtgtaaacgtttcggtacgtagacggttaggacgggccggtacggtcggacgaaggccgtanaggtncntannnnnnnnnnnnnnnnnnnnnnnnn

SEQ ID NO: 231224 - DNA, 622 bp, Homo sapiens
  misc_feature: GYAE6OF01B0BH8.13.11.A11.1.454.CMB.1.raw
  modified_base (374)..(374): a, c, t, g, unknown or other
  misc_feature (374)..(374): n is a, c, g, or t
  modified_base (519)..(519): a, c, t, g, unknown or other
  misc_feature (519)..(519): n is a, c, g, or t
  modified_base (526)..(526): a, c, t, g, unknown or other
  misc_feature (526)..(526): n is a, c, g, or t
  modified_base (544)..(544): a, c, t, g, unknown or other
  misc_feature (544)..(544): n is a, c, g, or t
  modified_base (567)..(567): a, c, t, g, unknown or other
  misc_feature (567)..(567): n is a, c, g, or t
  modified_base (578)..(578): a, c, t, g, unknown or other
  misc_feature (578)..(578): n is a, c, g, or t
  modified_base (622)..(622): a, c, t, g, unknown or other
  misc_feature (622)..(622): n is a, c, g, or t
tcagtcacgtactacacgaccggtgctcgatttagctacgactgcagggccagtcagattgtcagcagcaactacttagcctggtaccagcagaacgcctggcaaggcccccaggcctcctcatctacgatgtattcaggacgaccactgacactcccagacctaggttcaggtgcaggttggtcgtgggacagtacttcacgttcacgacctatcgagcgtaacgacgttacgaaccgtgtaacgtacgtttgacctttacgttttattcgacgtactacctagtatcggtacgtctaccgttacgttacgtttcggaccgtacgggtaacctacggtacgtggactactacgaacgacgtaacgtggtacgntcggacctactacgtctcgtactcttacgtccgtttacccgacttagttacggtacgtaacggttacgacggtacgtacggtcgggacggtacggtaccgttacggagggtacccggtaagtcaaacggtcgtacacggtgagtntcggaancgtacggtctagaacgcnttacccgttaggatccaaggtcncgatcgctagngcgattcgtaatgtgcgttcaagttcgactacgtagcttagcgn

SEQ ID NO: 231225 - DNA, 385 bp, Homo sapiens; identical to SEQ ID NO: 230972
  misc_feature: GYAE6OF02IRL7Y.13.11.A11.1.454.CMB.1.raw
  modified_base (380)..(385): a, c, t, g, unknown or other
  misc_feature (380)..(385): n is a, c, g, or t

SEQ ID NO: 231226 - DNA, 384 bp, Homo sapiens
  misc_feature: GYAE6OF02IV8T8.13.11.A11.1.454.CMB.1.raw
  modified_base (378)..(384): a, c, t, g, unknown or other
  misc_feature (378)..(384): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttattctgtcaccagtatggtaggtcaccgtacacttttggccagggaccaagctggagatcaagcgaactgtggctgcaccatctgtcttcatcttcccgccatctgatagtacgtgactgagcgggctggcaaggcgcatagnnnnnnn

SEQ ID NO: 231227 - DNA, 383 bp, Homo sapiens
  misc_feature: GYAE6OF02FUISS.13.11.A11.1.454.CMB.1.raw
  modified_base (378)..(383): a, c, t, g, unknown or other
  misc_feature (378)..(383): n is a, c, g, or t
tcagtcacgtactacacgaccggtgctcgatttagctacgactgcagggccagtcagattgtcagcagcaactacttagcctggtaccagcagaagcctggccaggccccaggctcctcatctacgatgtattcaggaggaccactgacatcccagacaggttcagtggcagtgggtctgggacagacttcactctcaccatcagcagactggaacctgaagactttgcactttatttctgtcaccagtatggtaggtcaccgtacacttttggccaggggaccaagctggagatcaagcgaactgtggctgcaccatctgtcttcatcttcccgccatctgatagtactgactgagcgggctggcaaggcgcatagnnnnnn

SEQ ID NO: 231228 - DNA, 381 bp, Homo sapiens
  misc_feature: GYAE6OF02HYWTP.13.11.A11.1.454.CMB.1.raw
  modified_base (377)..(381): a, c, t, g, unknown or other
  misc_feature (377)..(381): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttattctgtcaccagtatggtaggtcaccgtacacttttgcccagggaccaagctggagatcaagcgaactgtggctgcaccatctgtcttcatcttcccgccatctgatagtactgactgagcgggctggcaaggcgcatagnnnnn

SEQ ID NO: 231229 - DNA, 402 bp, Homo sapiens
  misc_feature: GYAE6OF02JAZL2.13.11.A11.1.454.CMB.1.raw
  modified_base (385)..(402): a, c, t, g, unknown or other
  misc_feature (385)..(402): n is a, c, g, or t
tcagtcacgtactacacgaccggtgctcgatttagctacgactgcagggccagtcagggattgtcagcagcaactacttagcctggtaccagcagaagcctggccaggcccccaggctcctcatctacgatgtattcagggaggaccacgtgacatcccagacaggttcagtggcagtgggtctgggacagacttcactctcaccatcagcagactggaacctgaagactttgcactttattctgtcaccagtaatggtaggtcaccgtacacttttggccaggggaccaagctcggagatcaagcgaactgtggctgcaccatctgtcttcatcttccgccatctgatagtacgtgactgagcgggctggcaaggcgcgatagnnnnnnnnnnnnnnnnnn

SEQ ID NO: 231230 - DNA, 386 bp, Homo sapiens
  misc_feature: GYAE6OF02GUTK3.13.11.A11.1.454.CMB.1.raw
  modified_base (380)..(386): a, c, t, g, unknown or other
  misc_feature (380)..(386): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttatttctgtcaccagtatggtaggtcaccgtacacttttggccaggggaccaagctggagatcaagcgaactgtggctgcaccatctgtcttcatcttcccgccatctgatagtacgtgactgagcgggctggcaaggcgcatagnnnnnnn

SEQ ID NO: 231231 - DNA, 385 bp, Homo sapiens; identical to SEQ ID NO: 230961
  misc_feature: GYAE6OF02I6UZN.13.11.A11.1.454.CMB.1.raw
  modified_base (379)..(385): a, c, t, g, unknown or other
  misc_feature (379)..(385): n is a, c, g, or t

SEQ ID NO: 231232 - DNA, 384 bp, Homo sapiens; identical to SEQ ID NO: 230962
  misc_feature: GYAE6OF02IW3L1.13.11.A11.1.454.CMB.1.raw
  modified_base (379)..(384): a, c, t, g, unknown or other
  misc_feature (379)..(384): n is a, c, g, or t

SEQ ID NO: 231233 - DNA, 384 bp, Homo sapiens; identical to SEQ ID NO: 230979
  misc_feature: GYAE6OF02F8JW5.13.11.A11.1.454.CMB.1.raw
  modified_base (380)..(384): a, c, t, g, unknown or other
  misc_feature (380)..(384): n is a, c, g, or t

SEQ ID NO: 231234 - DNA, 212 bp, Homo sapiens
  misc_feature: GYAE6OF02G5VZV.13.11.A11.1.454.CMB.1.raw
  modified_base (211)..(212): a, c, t, g, unknown or other
  misc_feature (211)..(212): n is a, c, g, or t
tcagtcacgtactacacgaccggtgctcgatttagctacgactgcagggccagggagccctggtcaccgtctcctcagcctccaccaagggcccatcggtcttcccctggcgccctgctccaggagcacctctggggcacagcggccctgggctgcctggtcaaggactacttcctagtacgtgactgagcgggctggcaaggcgcatagnn

SEQ ID NO: 231235 - DNA, 384 bp, Homo sapiens
  misc_feature: GYAE6OF02HOA6V.13.11.A11.1.454.CMB.1.raw
  modified_base (379)..(384): a, c, t, g, unknown or other
  misc_feature (379)..(384): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagactttcactctcaccatcagcagactggaacctgaagactttgcactttattcctgtcaccagtatggtaggtcaccgtacacttttggccagggaccaagctggagatcaagcgaactgtggctgcaccatctgtcttcatcttccgccatctgatagtacgtgactgagcgggctggcaaggcgcatagnnnnnn

SEQ ID NO: 231236 - DNA, 367 bp, Homo sapiens
  misc_feature: GYAE6OF02H249P.13.11.A11.1.454.CMB.1.raw
  modified_base (360)..(367): a, c, t, g, unknown or other
  misc_feature (360)..(367): n is a, c, g, or t
tcagtcacgtactacacgaccggtgctcgatttagctacgactgcagggccagtcagattgtcagcagcaactacttagcctggccaggcccccaggctcctcatctacgatgtattcaggaggaccactgacatcccagacaggttcagtggcagtgggtctgggacagacttcactctcaccatcagcagactggaacctgaagactttgcactttattctgtcaccagtatggtaggtcaccgtacacttttggccaggggaccaagctggagatcaagcgaactgtgctgcaccatctgtcttcatcttcccgcatctgatagtacgtgactgagcgggctggcaaggcgcatagnnnnnnnn

SEQ ID NO: 231237 - DNA, 386 bp, Homo sapiens
  misc_feature: GYAE6OF02HF8LH.13.11.A11.1.454.CMB.1.raw
  modified_base (378)..(386): a, c, t, g, unknown or other
  misc_feature (378)..(386): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttattctgtcaccagtatggtaggtcaccgtacacttttggccaggggaccaagctggagatcaagcgaactgtggctgcaccatctgtcttcatcttccgccatctgatagtacgtgactgagcgggctggcaaggcgcatagnnnnnnnnn

SEQ ID NO: 231238 - DNA, 241 bp, Homo sapiens
  misc_feature: GYAE6OF02HIPG1.13.11.A11.1.454.CMB.1.raw
  modified_base (239)..(241): a, c, t, g, unknown or other
  misc_feature (239)..(241): n is a, c, g, or t
tcagtcacgtactacacgaccggtgctcgatttagctacgactgcagggatattactcatctctgggctccagtctgacgatgaggctgactattactgtttgacttggcacaacaacgcctggatcttcggacctgggaccacggtcaccgtcctaggtcagcccaaggccaacccactgtcactctgttcccaccctcctctagtacgtgactgagcgggctggcaaggcgcatagnnn

SEQ ID NO: 231239 - DNA, 382 bp, Homo sapiens
  misc_feature: GYAE6OF02GH4UJ.13.11.A11.1.454.CMB.1.raw
  modified_base (378)..(382): a, c, t, g, unknown or other
  misc_feature (378)..(382): n is a, c, g, or t
tcagtcacgtactacacgaccggtgctcgatttagctacgactgcagggccagtcagattgtcagcagcaactacttagcctggtaccagcagaagcctggccaggccccaggctcctcatctacgatgtattcaggaggaccactgacatcccagacaggttcagtggcagtgggtctgggacagacttcactctcaccatcagcagactggaacctgaagactttgcactttattctgtcaccagtatggtaggtcaccgtacacttttggccaggggaccaagctggagatcaagcgaactgtggctgcaccatctgtcttcatcttcccgccatctgatagtacgtgactgagcgggctggcaaggcgcatagnnnnn

SEQ ID NO: 231240 - DNA, 388 bp, Homo sapiens
  misc_feature: GYAE6OF02HANWP.13.11.A11.1.454.CMB.1.raw
  modified_base (380)..(388): a, c, t, g, unknown or other
  misc_feature (380)..(388): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttattctgtcaccagtatggtaggtcaccgtacacttttggccaggggaccaagctggagatcaagcgaactgtggctgcaccatctgtcttcatcttcccgccatctgatagtacgtgactgagcgggctggcaaggcgcatagnnnnnnnnn

SEQ ID NO: 231241 - DNA, 501 bp, Homo sapiens
  misc_feature: GYAE6OF02IDMOG.13.11.A11.1.454.CMB.1.raw
  modified_base (498)..(498): a, c, t, g, unknown or other
  misc_feature (498)..(498): n is a, c, g, or t
tcagtcacgtactacacgaccggtgctcgatttagctacgactgcaggggagaagagctgctcagttaggacccagagggaaccatggaaaccccagcgcagcttctcttcctcctgctactctggctcccagataccaccggagaaattgtgttgacgcagtctccaggcatcgtgtctttgtctccaggggaaagagcccaccctctcctgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagacttgctactttatttctgtctacctagtatggtagtcaccgtactacgtttggcctagggaccagctggagatacgaagcgaacgtgtggctgcacatctgtctntac

SEQ ID NO: 231242 - DNA, 383 bp, Homo sapiens
  misc_feature: GYAE6OF02GLIW4.13.11.A11.1.454.CMB.1.raw
  modified_base (378)..(383): a, c, t, g, unknown or other
  misc_feature (378)..(383): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggagcctgaagattttgcagtgtattactgtcagcagtatggtagctcacctcggacgttcggccaagggaccaaggtggaaatcaaacgaactgtggctgcacatctgtcttcatcttcccgccatctgatagtactgactgagcgggctggcaaggcgcatagnnnnnn

SEQ ID NO: 231243 - DNA, 239 bp, Homo sapiens
  misc_feature: GYAE6OF02HBLI9.13.11.A11.1.454.CMB.1.raw
  modified_base (224)..(239): a, c, t, g, unknown or other
  misc_feature (224)..(239): n is a, c, g, or t
tcagtcacgtactacacgaccggtgctcgatttagctacgactgcaggggccagggagccctggtcaccgtctcctcagcctccaccaagggcccatcggtccttcccctggccgccctgcctccgaggacgcacctccgagagcacaggccggcccgtgggctgcctggtcaaggacttacttcctagtacgtgactgagcgggctggacaaggcgcagtagnnnnnnnnnnnnnnnn

SEQ ID NO: 231244 - DNA, 217 bp, Homo sapiens
  misc_feature: GYAE6OF02GOQ2U.13.11.A11.1.454.CMB.1.raw
  modified_base (213)..(217): a, c, t, g, unknown or other
  misc_feature (213)..(217): n is a, c, g, or t
tcagtcacgtactacacgaccggtgctcgatttagctacgactgcaggggccagggaaccctggtcaccgtctcctctgcctccaccaagggcccatcggtcttcccctggcgccctgctccaggagcacctccgagagcacagcggccctgggctgcctggtcaaggactacttcctagtacgtgactgagcgggctggcaaggcgcatagnnnnn

SEQ ID NO: 231245 - DNA, 366 bp, Homo sapiens
  misc_feature: GYAE6OF02GHTL5.13.11.A11.1.454.CMB.1.raw
  modified_base (359)..(366): a, c, t, g, unknown or other
  misc_feature (359)..(366): n is a, c, g, or t
tcagtcacgtactacacgaccggtgctcgatttagctacgactgcagggccagtcagattgtcagcagcaactacttagcctggccaggcccccaggctcctcatctacgatgtattcaggaggaccactgacatcccagacaggttcagtggcagtgggtctgggacagacttcactctcaccatcagcagactggaacctgaagactttgcactttattctgtcaccagtatggtaggtcaccgtacacttttggccaggggaccaagctggagatcaagcgaactgtggctgcaccatctgtcttcatcttccgcatctgatagtacgtgactgagcggctggcaaggcgcatagnnnnnnnn

SEQ ID NO: 231246 - DNA, 386 bp, Homo sapiens; identical to SEQ ID NO: 231230
  misc_feature: GYAE6OF02HF6KD.13.11.A11.1.454.CMB.1.raw
  modified_base (380)..(386): a, c, t, g, unknown or other
  misc_feature (380)..(386): n is a, c, g, or t

SEQ ID NO: 231247 - DNA, 385 bp, Homo sapiens; identical to SEQ ID NO: 230972
  misc_feature: GYAE6OF02GJ87F.13.11.A11.1.454.CMB.1.raw
  modified_base (380)..(385): a, c, t, g, unknown or other
  misc_feature (380)..(385): n is a, c, g, or t

SEQ ID NO: 231248 - DNA, 385 bp, Homo sapiens
  misc_feature: GYAE6OF02IXQPV.13.11.A11.1.454.CMB.1.raw
  modified_base (380)..(385): a, c, t, g, unknown or other
  misc_feature (380)..(385): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaacctgaagactttgcactttattctgtcaccagtatggtaggtcaccgtacacttttggccaggggaccaagctggagatcaagcgaactgtggctgcaccatctgtcttcatcttcccgccatctgatagtacgtgactgagcgggctggcaaggcgcatagnnnnnn

SEQ ID NO: 231249 - DNA, 380 bp, Homo sapiens
  misc_feature: GYAE6OF02GWJDR.13.11.A11.1.454.CMB.1.raw
  modified_base (376)..(380): a, c, t, g, unknown or other
  misc_feature (376)..(380): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttattctgtcaccagtatggtaggtcaccgtacacttttggccagggaccaagctggagatcaagcgaactgtggctgcaccatctgtcttcatcttccgcatctgatagtacgtgactgagcgggctggcaaggcgcatagnnnnn

SEQ ID NO: 231250 - DNA, 383 bp, Homo sapiens; identical to SEQ ID NO: 231021
  misc_feature: GYAE6OF02GLG7X.13.11.A11.1.454.CMB.1.raw
  modified_base (379)..(383): a, c, t, g, unknown or other
  misc_feature (379)..(383): n is a, c, g, or t

SEQ ID NO: 231251 - DNA, 382 bp, Homo sapiens
  misc_feature: GYAE6OF02IVLOZ.13.11.A11.1.454.CMB.1.raw
  modified_base (376)..(382): a, c, t, g, unknown or other
  misc_feature (376)..(382): n is a, c, g, or t
tcagtcacgtactacacgaccggtgctcgatttagctacgactgcagggccagtcagattgtcagcagcaactacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctcggacgttcggccaagggaccaaggtggaaatcaaacgactgtggctgcacatctgtcttcatcttcccgcatctgatagtcgtgactgagcgggctggcaaggcgcatagnnnnnnn

SEQ ID NO: 231252 - DNA, 509 bp, Homo sapiens
  misc_feature: GYAE6OF02HA8XC.13.11.A11.1.454.CMB.1.raw
  modified_base (491)..(491): a, c, t, g, unknown or other
  misc_feature (491)..(491): n is a, c, g, or t
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctcgtggacgtccccagccgcttctctggactccaaggatgattcccgcaacgcagggatattactcatctcgtgggctcagtctgacgatgagctgactattacttgttgacttggcacaacaacgcctagactcgttcggactcgggacacggtcacgtctaggccacgccaacgccacccnctcgcactctcgtccccg

SEQ ID NO: 231253 - DNA, 386 bp, Homo sapiens
  misc_feature: GYAE6OF02H0YUK.13.11.A11.1.454.CMB.1.raw
  modified_base (383)..(386): a, c, t, g, unknown or other
  misc_feature (383)..(386): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctacttttatttctgttcaccagtatggtaggtcaccgtacacttttggccaggggaccaagctggagatcaagcgaactgtggctgcaccatctgtcttcatcttcccgccatctgatagtacgtgactgagcgggctggcaaggcgcatagnnnn

SEQ ID NO: 231254 - DNA, 384 bp, Homo sapiens; identical to SEQ ID NO: 230967
  misc_feature: GYAE6OF02FMK2R.13.11.A11.1.454.CMB.1.raw
  modified_base (379)..(384): a, c, t, g, unknown or other
  misc_feature (379)..(384): n is a, c, g, or t

SEQ ID NO: 231255 - DNA, 383 bp, Homo sapiens
  misc_feature: GYAE6OF02ID2L1.13.11.A11.1.454.CMB.1.raw
  modified_base (379)..(383): a, c, t, g, unknown or other
  misc_feature (379)..(383): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttattctgtcaccagtatggtaggtcaccgtacacttttggccaggggaccaagctggagatcaagcgaactgtggctgcaccatctgtcttcatcttcccgccatctgatagtacgtgactgagcgggctggcaaggcgcatagnnnnn

SEQ ID NO: 231256 - DNA, 334 bp, Homo sapiens
  misc_feature: GYAE6OF02GUE0J.13.11.A11.1.454.CMB.1.raw
  modified_base (324)..(324): a, c, t, g, unknown or other
  misc_feature (324)..(324): n is a, c, g, or t
  modified_base (330)..(334): a, c, t, g, unknown or other
  misc_feature (330)..(334): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttattctgtcaccagtatggaactgtggctgcaccatctgtcttcatcttcccgcatctgatagtacgtgactgagcgggctggcaaggcncatagnnnnn

SEQ ID NO: 231257 - DNA, 367 bp, Homo sapiens
  misc_feature: GYAE6OF02F5ZFH.13.11.A11.1.454.CMB.1.raw
  modified_base (362)..(367): a, c, t, g, unknown or other
  misc_feature (362)..(367): n is a, c, g, or t
tcagtcacgtactacacgaccggtgctcgatttagctacgactgcagggccagtcagattgtcagcagcaactacttagcctggccaggcccccaggctcctcatctacgatgtattcaggaggaccactgacatcccagacaggttcagtggcagtgggtctgggacagacttcactctcaccatcagcagactggaacccgagactttgcactttatttctgtcaccagtatggtaggtcaccgtacacttttggccaggggaccaagctggagatcaagcgaactgtggctgcaccatctgtcttcatcttcccgccatctgatagtacgtgactgagcgggctggcaaggcgcatagnnnnnn

SEQ ID NO: 231258 - DNA, 396 bp, Homo sapiens
  misc_feature: GYAE6OF02F97DK.13.11.A11.1.454.CMB.1.raw
  modified_base (386)..(396): a, c, t, g, unknown or other
  misc_feature (386)..(396): n is a, c, g, or t
tcagtcacgtactacacgaccggtgctcgatttagctacgactgcaagggtccgagtcagattgtcagcagcaactacttagcctggtaccagcagaagcctggccaggcccccaggctcctcatctacgatgtattcaggaggaccactgacatcccagacaggttcagtggcagtgggtctgggacagacttgactctcaccatcagcagactggaacctgaagactttgcactttattctgttcaccagtatggtaggtcaccgtacacttttggccaggggaccaagcctggagaatcaagcgaactgtaggctgcaccgatctgtcttcgatcttccgccatctgatagtacgtgactgagcggctggcaaggcgcatagnnnnnnnnnnn

SEQ ID NO: 231259 - DNA, 384 bp, Homo sapiens; identical to SEQ ID NO: 230967
  misc_feature: GYAE6OF02I9NIS.13.11.A11.1.454.CMB.1.raw
  modified_base (379)..(384): a, c, t, g, unknown or other
  misc_feature (379)..(384): n is a, c, g, or t

SEQ ID NO: 231260 - DNA, 384 bp, Homo sapiens; identical to SEQ ID NO: 230962
  misc_feature: GYAE6OF02GOT51.13.11.A11.1.454.CMB.1.raw
  modified_base (379)..(384): a, c, t, g, unknown or other
  misc_feature (379)..(384): n is a, c, g, or t

SEQ ID NO: 231261 - DNA, 383 bp, Homo sapiens
  misc_feature: GYAE6OF02HPZRE.13.11.A11.1.454.CMB.1.raw
  modified_base (378)..(383): a, c, t, g, unknown or other
  misc_feature (378)..(383): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttattctgtcaccagtatggtaggtcaccgtacacttttggccaggggaccaagctggagatcaagcgaactgtggctgcaccatctgtcttcatcttccgccatctgatagtacgtgactgagcgggctggcaaggcgcatagnnnnnn

SEQ ID NO: 231262 - DNA, 386 bp, Homo sapiens; identical to SEQ ID NO: 231230
  misc_feature: GYAE6OF02FPTYS.13.11.A11.1.454.CMB.1.raw
  modified_base (380)..(386): a, c, t, g, unknown or other
  misc_feature (380)..(386): n is a, c, g, or t

SEQ ID NO: 231263 - DNA, 507 bp, Homo sapiens
  misc_feature: GYAE6OF02JBHTG.13.11.A11.1.454.CMB.1.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccaggggagtcctccccagtttctcctgaggttcaggtcaaactcagataaacgacagggctctggacgtccccagccgcttctctggatccaaggatgattccgacaacgcagggatattactcatctctgggctccagtctgacgatggagctgactattactgttgacttggcacaacacgctggatcgttcggactgggaccacggtcaccgtctacggtcacgcccagccaacccactcgtcactctcgtcccc

SEQ ID NO: 231264 - DNA, 388 bp, Homo sapiens
  misc_feature: GYAE6OF02FYIT2.13.11.A11.1.454.CMB.1.raw
  modified_base (379)..(388): a, c, t, g, unknown or other
  misc_feature (379)..(388): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttattctgtcaccagtatggtaggtcaccgtacacttttggccaggggaccaagctggagatcaagcgaactgtggctgcaccatctgtcttcatcttctcgccatctgatagtacgtgactgagcgggctggcaaggcgcatagnnnnnnnnnn

SEQ ID NO: 231265 - DNA, 389 bp, Homo sapiens
  misc_feature: GYAE6OF02H870X.13.11.A11.1.454.CMB.1.raw
  modified_base (368)..(368): a, c, t, g, unknown or other
  misc_feature (368)..(368): n is a, c, g, or t
  modified_base (384)..(389): a, c, t, g, unknown or other
  misc_feature (384)..(389): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttattctgtcaccagtatggtaggtcaccgtacacttttggccaggggacccaagctggagatcaagcgaactgtggctgcactatctgtcttcattctttcccgctctaactgattgtactgactgagcgggntggcaaggcgcatagnnnnnn

SEQ ID NO: 231266 - DNA, 389 bp, Homo sapiens
  misc_feature: GYAE6OF02HGEV1.13.11.A11.1.454.CMB.1.raw
  modified_base (382)..(389): a, c, t, g, unknown or other
  misc_feature (382)..(389): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttatttctgtcaccagtatggtaggtcaccgtacacttttggcctaggggaccaagctggagatcaagcgaactgtggctgcaccatctgtcttcatcttcccgccatctgatagtacgtgactgagcgggctggcaaggcgcatagnnnnnnnn

SEQ ID NO: 231267 - DNA, 381 bp, Homo sapiens
  misc_feature: GYAE6OF02G9RII.13.11.A11.1.454.CMB.1.raw
  modified_base (373)..(381): a, c, t, g, unknown or other
  misc_feature (373)..(381): n is a, c, g, or t
tcagtcacgtactacacgaccggtgctcgatttagctacgactgcagggccagtcagagtgttcccaacaactacttagcctggtaccagcaaaggcctggccaggctcccaggcgcctcatctatgctgcttccagtagggccactggcgtcccagacaggttcagtggcagtgggtctgggacagacttcaccctcaccatcagcagactggagcctgaagatttgcagtctattactgtcagcagtatggtagccgaaagacgttcggccaagggaccaaggtggaaatcaaacgactgtggctgcaccatctgtcttcatcttccgcatctgatagtacgtgactgagcgggctggcaaggcgcatagnnnnnnnnn

SEQ ID NO: 231268 - DNA, 385 bp, Homo sapiens
  misc_feature: GYAE6OF02HWYS4.13.11.A11.1.454.CMB.1.raw
  modified_base (380)..(385): a, c, t, g, unknown or other
  misc_feature (380)..(385): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttatttctgtcaccagtatggtaggtcaccgtacacttttggccaggggaccaagctggagatcaagcgaactgtggctgcaccatctgtcttcatcttcccgcatctgatagtacgtgactgagcgggctggcaaggcgcatagnnnnnn

SEQ ID NO: 231269 - DNA, 506 bp, Homo sapiens
  misc_feature: GYAE6OF02HA7GZ.13.11.A11.1.454.CMB.1.raw
  modified_base (416)..(416): a, c, t, g, unknown or other
  misc_feature (416)..(416): n is a, c, g, or t
  modified_base (455)..(455): a, c, t, g, unknown or other
  misc_feature (455)..(455): n is a, c, g, or t
  modified_base (490)..(490): a, c, t, g, unknown or other
  misc_feature (490)..(490): n is a, c, g, or t
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctccctgaggttcaggtcaaactcagataaacgacagggctctggagtccccagccgcttctctggatccaaggatgatttccgccaacgcagggatattactcatctctgggctccagtctgacgatgagctgactattactgttnacttggcacaacacgcctggatcttcggacctgggaccncggtcaccgtcctaggtcagcccaggcccaacccnctgtccactctgtccc

SEQ ID NO: 231270 - DNA, 384 bp, Homo sapiens
  misc_feature: GYAE6OF02HK1ZX.13.11.A11.1.454.CMB.1.raw
  modified_base (379)..(384): a, c, t, g, unknown or other
  misc_feature (379)..(384): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcacttttatttctgtcaccagtatggtaggtcaccgtacacttttggccaggggaccaagctggagatcaagcgaactgtggctgcaccatctgtcttcatcttccgcatctgatagtacgtgactgagcgggctggcaaggcgcatagnnnnnn

SEQ ID NO: 231271 - DNA, 387 bp, Homo sapiens
  misc_feature: GYAE6OF02F4IB4.13.11.A11.1.454.CMB.1.raw
  modified_base (380)..(387): a, c, t, g, unknown or other
  misc_feature (380)..(387): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttatttctgtcaccagtatggtaggtcaccgtacacttttggccaggggaccaagctggagatcaagcgaactgtggctgcaccatctgtcttcatcttcccgccatctgatagtacgtgactgagcgggctggcaaggcgcatagnnnnnnnn

SEQ ID NO: 231272 - DNA, 385 bp, Homo sapiens
  misc_feature: GYAE6OF02H6CKS.13.11.A11.1.454.CMB.1.raw
  modified_base (380)..(385): a, c, t, g, unknown or other
  misc_feature (380)..(385): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcacttttattctgtcaccagtatggtaggtcaccgtacacttttggccaggggaccaagctggagatcaagcgaactgtggctgcaccatctgtcttcatcttcccgccatctgatagtacgtgactgagcgggctggcaaggcgcatagnnnnnn

SEQ ID NO: 231273 - DNA, 387 bp, Homo sapiens
  misc_feature: GYAE6OF02IEDVZ.13.11.A11.1.454.CMB.1.raw
  modified_base (378)..(387): a, c, t, g, unknown or other
  misc_feature (378)..(387): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcacttttattctgtcaccagttatggtaggtcaccgtacacttttggccaggggaccaagctggagatcaagcgaactgtggctgcaccatctgtcttcatcttcccgcatctgatagtactgactgagcggctggcaaggcgcatagnnnnnnnnnn

SEQ ID NO: 231274 - DNA, 398 bp, Homo sapiens
  misc_feature: GYAE6OF02HWOXH.13.11.A11.1.454.CMB.1.raw
  modified_base (392)..(398): a, c, t, g, unknown or other
  misc_feature (392)..(398): n is a, c, g, or t
tcagtcacgtactacacgaccggtgctcgatttagctacgactgcagggccagtcagattgtcagcagcaactacttagcctggtaccagcagaagcctggccaggcccccaggctcctcatctatggtgcatccaccagggccactggtatcccagaccggttcagtggcagtgggtctgggacagacttcactctcaccatcagcagtctgcagtctgaagatttttgcagttttattactgttcagcagtataataactggcctccgtacatgtacacttttggccaggggaccaacctggagatcagacgaactgtggctgcaccatctgtcttcatcttcccgccatctgatagtacgtgactgagcgggctggcaaggcgcatagnnnnnnn

SEQ ID NO: 231275 - DNA, 385 bp, Homo sapiens
  misc_feature: GYAE6OF02GP5SE.13.11.A11.1.454.CMB.1.raw
  modified_base (380)..(385): a, c, t, g, unknown or other
  misc_feature (380)..(385): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcacttttatttctgtcaccagtatggtaggtcaccgtacacttttggccaggggaccaagctggagatcaagcgaactgtggctgcaccatctgtcttcatcttcccgcatctgatagtacgtgactgagcgggctggcaaggcgcatagnnnnnn

SEQ ID NO: 231276 - DNA, 393 bp, Homo sapiens
  misc_feature: GYAE6OF02GKPQH.13.11.A11.1.454.CMB.1.raw
  modified_base (382)..(382): a, c, t, g, unknown or other
  misc_feature (382)..(382): n is a, c, g, or t
  modified_base (387)..(393): a, c, t, g, unknown or other
  misc_feature (387)..(393): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagtctgcagtctgaagattttgcagttttattactgtcagcagtataataactggcctcgtacatgtacacttttggccaggggaccaaccgtggagatcagacgaactgtggctgcacatctgtcttcatcttcccgcatctgatagtacgtgactgagcgggctggcaaggcncatgnnnnnnn

SEQ ID NO: 231277 - DNA, 393 bp, Homo sapiens
  misc_feature: GYAE6OF02H3G05.13.11.A11.1.454.CMB.1.raw
  modified_base (386)..(386): a, c, t, g, unknown or other
  misc_feature (386)..(386): n is a, c, g, or t
  modified_base (390)..(393): a, c, t, g, unknown or other
  misc_feature (390)..(393): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagcctgcaggctgaagatgtggctagttttattactgtcagcaatattatagtactcctccgagctcactttcggcggagggaccaaggtggagatacaaaacgactgtggctgcacatctgtcttcatcttcccgcatctgatagtacgtgactgacgcgggtctgggacaaggcgnatgnnnn

SEQ ID NO: 231278 - DNA, 385 bp, Homo sapiens
  misc_feature: GYAE6OF02IBBD8.13.11.A11.1.454.CMB.1.raw
  modified_base (379)..(385): a, c, t, g, unknown or other
  misc_feature (379)..(385): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttatttctgtcaccagtatggtaggtcaccgtacacttttggccaggggaccaagctggagatcaagcgaactgtggctgcaccatctgtcttcatcttcccgcatctgatagtacgtgactgagcgggctggcaaggcgcatagnnnnnnn

SEQ ID NO: 231279 - DNA, 394 bp, Homo sapiens
  misc_feature: GYAE6OF02GLK4R.13.11.A11.1.454.CMB.1.raw
  modified_base (241)..(241): a, c, t, g, unknown or other
  misc_feature (241)..(241): n is a, c, g, or t
  modified_base (342)..(342): a, c, t, g, unknown or other
  misc_feature (342)..(342): n is a, c, g, or t
  modified_base (381)..(381): a, c, t, g, unknown or other
  misc_feature (381)..(381): n is a, c, g, or t
  modified_base (383)..(394): a, c, t, g, unknown or other
  misc_feature (383)..(394): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtgacagtgggtctgggacagacttcactctcaccatcagcagactggaacctgaagactttgcacttttattcngtcaccagtatggtaggtcaccgtacacttttggccaggggaccaagctggagatcaagcgaactgtggctgcaccatctgtctcatcttcccgctatctnatagtacgtgactgagcgggctggacaaggcgcagtagnannnnnnnnnnnn

SEQ ID NO: 231280 - DNA, 409 bp, Homo sapiens
  misc_feature: GYAE6OF02H1Y5K.13.11.A11.1.454.CMB.1.raw
  modified_base (250)..(250): a, c, t, g, unknown or other
  misc_feature (250)..(250): n is a, c, g, or t
  modified_base (353)..(353): a, c, t, g, unknown or other
  misc_feature (353)..(353): n is a, c, g, or t
  modified_base (390)..(409): a, c, t, g, unknown or other
  misc_feature (390)..(409): n is a, c, g, or t
tcagtcacgtactacacgaccggtgctcgattttagctacgactgcagggtccggagtcagattgtcagcagcaactacttagcctggtaccagcagaagcctggccaggcccccaggctcctcatctacgatgtattcagggaggaccactgacatccccagacaggttcagtggcagtgggtctgggacagacttcactctcaccatcagcagactggaacctgaagactttgcacttttattctgtnacctagtatggtaggtcaccgtacacttttggccaggggaccaagcctaggagatcaagcgaactgtggctgcaccatcgtgtacttcactcttcccgcatcngatgtacgtgactgagcgggctggcaaggcgcatagnnnnnnnnnnnnnnnnnnnn

SEQ ID NO: 231281 - DNA, 393 bp, Homo sapiens
  misc_feature: GYAE6OF02IP0J0.13.11.A11.1.454.CMB.1.raw
  modified_base (383)..(383): a, c, t, g, unknown or other
  misc_feature (383)..(383): n is a, c, g, or t
  modified_base (388)..(393): a, c, t, g, unknown or other
  misc_feature (388)..(393): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaaaccctgaagacttttgctacttttattctgttcaccagtatggtaggtcaccgtacacttttggccaggggaccaagctggagatcaagcgaaactgtggctgcaccatctgtcttcatcttcccgccatctgatagtacgtgacttgagcgggctggcaaggcgnatagnnnnnn

SEQ ID NO: 231282 - DNA, 403 bp, Homo sapiens
  misc_feature: GYAE6OF02F4UGD.13.11.A11.1.454.CMB.1.raw
  modified_base (273)..(273): a, c, t, g, unknown or other
  misc_feature (273)..(273): n is a, c, g, or t
  modified_base (380)..(380): a, c, t, g, unknown or other
  misc_feature (380)..(380): n is a, c, g, or t
  modified_base (386)..(403): a, c, t, g, unknown or other
  misc_feature (386)..(403): n is a, c, g, or t
tcagtcacgtactacacgaccggtgctcgatttagctacgactgcagggccgagtcagattgtcagcagcaactacttagcctggtaccagcagaagcctggccaggcccccaggctcctcatctacgatgtattcaggaggaccactgactatcccagacaggtttcagtggcagtgggtctgggacagacttcactctcaccagtcagcagactggaaccctgaagactttgctactttatttctgtcaccagtatggtaggtcaccgtanacttttggccaggggaccaagctggagatcaagcgaactgtggctgcaccatctgtcttcatcttccgcatctgatagtacgtgactggagcgggctggacaaggcncatagnnnnnnnnnnnnnnnnnn

SEQ ID NO: 231283 - DNA, 387 bp, Homo sapiens
  misc_feature: GYAE6OF02F5CXJ.13.11.A11.1.454.CMB.1.raw
  modified_base (380)..(387): a, c, t, g, unknown or other
  misc_feature (380)..(387): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcacttttattctgtcaccagtatggtaggtcaccgtacacttttggcctaggggaccaagctggagatcaagcgaactgtggctgcaccatctgtcttcatcttcccgcatctgatagtacgtgactgagcgggctggcaaggcgcatagnnnnnnnn

SEQ ID NO: 231284 - DNA, 387 bp, Homo sapiens
  misc_feature: GYAE6OF02H2PL1.13.11.A11.1.454.CMB.1.raw
  modified_base (374)..(374): a, c, t, g, unknown or other
  misc_feature (374)..(374): n is a, c, g, or t
  modified_base (379)..(387): a, c, t, g, unknown or other
  misc_feature (379)..(387): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagacttttgctactttatttctgtcaccagtatggtaggtcaccgtacacttttggccaggggaccaagctggagatcaagcgaactgtggctgcaccatctgtcttcatcttccgccatctgatagtacgtgactgagcggctggcaggcgnatagnnnnnnnnn

SEQ ID NO: 231285 - DNA, 422 bp, Homo sapiens
  misc_feature: GYAE6OF02IXMAG.13.11.A11.1.454.CMB.1.raw
  modified_base (383)..(386): a, c, t, g, unknown or other
  misc_feature (383)..(386): n is a, c, g, or t
  modified_base (388)..(422): a, c, t, g, unknown or other
  misc_feature (388)..(422): n is a, c, g, or t
tcagtcacgtactacacgaccggtgctcgatttagctacgactgcagggccgagtcgagattgtcagcagcaactacttagcctggtaccagcagaagcctggccaggcccccaggctcctcatctacgatgtattcaggaggacctactgacatcccagacaggttcagtggcagtgggtctggggacagacttcactctcaccatcaggcagactggaacctgaagctttgctactttattctgtcaccagtatggtagtcacgtacactttggccagggaccaagctggacgatcaagcgaactgtggctgacacatctgtcttcatcttcccgcatctgactagtacgtgactgacgcgggctggcaaggcgacatagnnnnannnnnnnnnnnnnnnnnnnnnnnnnnnnnnnnnnn

SEQ ID NO: 231286 - DNA, 387 bp, Homo sapiens
  misc_feature: GYAE6OF02HE8LD.13.11.A11.1.454.CMB.1.raw
  modified_base (381)..(387): a, c, t, g, unknown or other
  misc_feature (381)..(387): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttatttctgtcaccagtatggtaggtcaccgtacacttttggccaggggaccaagctggagatcaagcgaactgtggctgcaccatctgtcttcatcttcccgccatctgatagtacgtgactgagcgggctgggcaaggcgcatagnnnnnnn

SEQ ID NO: 231287 - DNA, 391 bp, Homo sapiens
  misc_feature: GYAE6OF02ISKEC.13.11.A11.1.454.CMB.1.raw
  modified_base (381)..(391): a, c, t, g, unknown or other
  misc_feature (381)..(391): n is a, c, g, or t
tcagtcacgtactacacgaccggtgctcgatttagctacgactgcagggccagtcagattgtcagcagcaactacttagcctggtaccagcagaagcctggccaggcccccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctcggacgttcgggccaaggggaccaagggtggaaaatcaaacgaactgtggctgcacatctgcttcatcttcccgcatctgatagtactgatgagcgggctgggcaagggcgcatagnnnnnnnnnnn

SEQ ID NO: 231288 - DNA, 500 bp, Homo sapiens
  misc_feature: GYAE6OF02GMD53.13.11.A11.1.454.CMB.1.raw
  modified_base (198)..(198): a, c, t, g, unknown or other
  misc_feature (198)..(198): n is a, c, g, or t
  modified_base (465)..(465): a, c, t, g, unknown or other
  misc_feature (465)..(465): n is a, c, g, or t
  modified_base (489)..(489): a, c, t, g, unknown or other
  misc_feature (489)..(489): n is a, c, g, or t
  modified_base (497)..(497): a, c, t, g, unknown or other
  misc_feature (497)..(497): n is a, c, g, or t
tcagtcacgtactacacgaccggtgctcgatttagctacgactgcaggggagaagagctgctcagttaggacccagagggaaccatggaaaccccagcgcagcttctcttcctcctgctactctggctcccagataccaccggagaaattgtgttgacgcagtctccaggcatcgtgtctttgtctccagggggaaangccaccctctcctgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggacctgaagactttgctactttattctgtcacctagtatggtagtctaccgtactactttggacctaggggaccaagctagganatcgaagcgaactgtggctgcacntctgtctntac

SEQ ID NO: 231289 - DNA, 384 bp, Homo sapiens
  misc_feature: GYAE6OF02HCZZM.13.11.A11.1.454.CMB.1.raw
  modified_base (379)..(384): a, c, t, g, unknown or other
  misc_feature (379)..(384): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctacttttatttctgtcaccagtatggtaggtcaccgtacacttttggccaggggaccaagctggagatcaagcgaactgtggctgcacatctgtcttcatcttccgccatctgatagtacgtgactgagcggctggcaaggcgcatagnnnnnn

SEQ ID NO: 231290 - DNA, 416 bp, Homo sapiens
  misc_feature: GYAE6OF02JMCQ2.13.11.A11.1.454.CMB.1.raw
  modified_base (402)..(416): a, c, t, g, unknown or other
  misc_feature (402)..(416): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctggggacagacttcactctcaccatcagcggcctgcagtctgaagattttgcagtctattactgtcagcagtattaagtactgagacgtcggacgaaggacgacgacgtaggagaagtaaaggaacgtagtaggcgtgcacctatctgtcttctactccttccctcctactctcgtatagtacgtagtacgtgagcgggcgtcggacgaacggacgcgatagnnnnnnnnnnnnnnn

SEQ ID NO: 231291 - DNA, 412 bp, Homo sapiens
  misc_feature: GYAE6OF02IJPKP.13.11.A11.1.454.CMB.1.raw
  modified_base (247)..(247): a, c, t, g, unknown or other
  misc_feature (247)..(247): n is a, c, g, or t
  modified_base (390)..(395): a, c, t, g, unknown or other
  misc_feature (390)..(395): n is a, c, g, or t
  modified_base (397)..(412): a, c, t, g, unknown or other
  misc_feature (397)..(412): n is a, c, g, or t
tcagtcacgtactacacgaccggtgctcgatttagctacgactgcagggccagtcagattgtcagcagcaactacttagcctggtaccagtcagaagcctggccaggccccccaggctcctcatctacgatgtattcaggaggaccactgacattcccagacaggtttcagtggcagtgggtctgggacagacttcacgtctcaccagtcagcagactggaacctgaagactttgctactttattcngtcaccagtatggtaggtcaccgtacacttttggccaggggacctaagctggagatcaagcgaactggtggctggcaccgatctgtcttcatctttcccgcatctgatagtacgtgactgagcgggctggcaaggcgcatagnnnnnnannnnnnnnnnnnnnnn

SEQ ID NO: 231292 - DNA, 391 bp, Homo sapiens
  misc_feature: GYAE6OF02GD32O.13.11.A11.1.454.CMB.1.raw
  modified_base (385)..(391): a, c, t, g, unknown or other
  misc_feature (385)..(391): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagatttcactctcaccatcagcagcctgcaggctgaagatgtggcagtttattactgtcagcaatattatagtactcctccgaggctcactttcggcggagggaccaaggtggagatcaaacgaactgtggctgcaccatctgtcttcatcttcccgcatctgatagtacgtgactgagcgggctggcaaggcgcatagnnnnnnn

SEQ ID NO: 231293 - DNA, 365 bp, Homo sapiens
  misc_feature: GYAE6OF02FO6S5.13.11.A11.1.454.CMB.1.raw
  modified_base (361)..(365): a, c, t, g, unknown or other
  misc_feature (361)..(365): n is a, c, g, or t
tcagtcacgtactacacgaccggtgctcgatttagctacgactgcagggccagtcagattgtcagcagcaactacttagcctggccaggccccaggctcctcatctacgatgtattcaggaggaccactgacatcccagacaggttcagtggcagtgggtctgggacagacttcactctcaccatcagcagactggaacctgaagactttgcactttattctgtcaccagtatggtaggtcaccgtacacttttggcctaggggaccaagctggagatcaagcgaactgtggctgcaccatctgtcttcatcttcccgccatctgatagtactgactgagcgggctggcaaggcgcatagnnnnn

SEQ ID NO: 231294 - DNA, 386 bp, Homo sapiens; identical to SEQ ID NO: 231230
  misc_feature: GYAE6OF02FRC7Z.13.11.A11.1.454.CMB.1.raw
  modified_base (380)..(386): a, c, t, g, unknown or other
  misc_feature (380)..(386): n is a, c, g, or t

SEQ ID NO: 231295 - DNA, 393 bp, Homo sapiens
  misc_feature: GYAE6OF02H0YY3.13.11.A11.1.454.CMB.1.raw
  modified_base (356)..(356): a, c, t, g, unknown or other
  misc_feature (356)..(356): n is a, c, g, or t
  modified_base (387)..(393): a, c, t, g, unknown or other
  misc_feature (387)..(393): n is a, c, g, or t
tcagtcacgtactacacgaccggtgctcgatttagctacgactgcagggccagtcagattgtcagcagcaactacttagcctggtaccagcagaagcctggccaggccccaggctcctcatctacgatgtattcaggaggaccactgacatcccagacaggttcagtggcagtgggtctgggacagacttcactctcaccatcagcagactggaacctgaagactttgctattttattctgttcaccagtatggtaggttcaccgtacactttttggccaggggaccaagcttggagatcaagcgaactgtggctgcaccatctgtcttcatctttcccgcatctgatagtacgtnacttgagcgggctggctaaaggcgcagtagnnnnnnn

SEQ ID NO: 231296 - DNA, 398 bp, Homo sapiens
  misc_feature: GYAE6OF02JJZWS.13.11.A11.1.454.CMB.1.raw
  modified_base (295)..(295): a, c, t, g, unknown or other
  misc_feature (295)..(295): n is a, c, g, or t
  modified_base (387)..(398): a, c, t, g, unknown or other
  misc_feature (387)..(398): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcacttttattctagtcaccagtatggtaggtcaccgtacacttttggccaggggaccaagctgganatcaaagcgaactgtggctgcaccatctgtcttcatccttcccgctatctgattacgtacgtgactggagcgggctggcaaggcgcagtagnnnnnnnnnnnn

SEQ ID NO: 231297 - DNA, 387 bp, Homo sapiens
  misc_feature: GYAE6OF02IPNI1.13.11.A11.1.454.CMB.1.raw
  modified_base (380)..(387): a, c, t, g, unknown or other
  misc_feature (380)..(387): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttattctgtcaccagtatggtaggtcaccgtacacttttggccaggggaccaagctggagatcaagcgaactgtggctgcaccatctgtcttcatcttcccgccatctgatagtacgtgacttgagcgggctggcaaggcgcatagnnnnnnnn

SEQ ID NO: 231298 - DNA, 379 bp, Homo sapiens
  misc_feature: GYAE6OF02IGU8W.13.11.A11.1.454.CMB.1.raw
  modified_base (375)..(379): a, c, t, g, unknown or other
  misc_feature (375)..(379): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttattctgtcaccagtatgtaggtcaccgtacacttttggccagggaccaagctggagatcaagcgaactgtggctgcaccatctgtcttcatcttcccgccatctgatagtactgactgagcggctggcaaggcgcatagnnnnn

SEQ ID NO: 231299 - DNA, 607 bp, Homo sapiens
  misc_feature: GYAE6OF02IE2RL.13.11.A11.1.454.CMB.1.raw
  modified_base (193)..(193): a, c, t, g, unknown or other
  misc_feature (193)..(193): n is a, c, g, or t
  modified_base (240)..(240): a, c, t, g, unknown or other
  misc_feature (240)..(240): n is a, c, g, or t
  modified_base (308)..(308): a, c, t, g, unknown or other
  misc_feature (308)..(308): n is a, c, g, or t
  modified_base (354)..(354): a, c, t, g, unknown or other
  misc_feature (354)..(354): n is a, c, g, or t
  modified_base (460)..(460): a, c, t, g, unknown or other
  misc_feature (460)..(460): n is a, c, g, or t
tcagtcacgtactacacgaccggtgctcgatttagctacgactgcggggtaaggaggttgtgtccaccatggcctggactcctctcctcctcctgctcctctctcactgcacagttcctctcgcaggctgtgctgactcagccgtcttcctctctgcttctcctggagcgtcagccagtctcactgcaccttncgcagtggcaccaatgttggtccatgacattatatttgggaaccganagaacgcctaggggatcctcccctagtttctcctgaggttcaggttacaaactcaagataaacgaacngggctacgtggactccccgagccgtcttctctaggactccaaaggntgactttccgcaaacgcaaggattaattctacattcctcgtcgggtactccaagtccgtgtacgacgtgaggtctgtaactatttaacttgtttgacgtttcgganaaccgtaaactaccgacttcgggactttacgttccggaccggttacggacgttaaccggccgttaaccgtccgtaaggtaccctaggaccccgaacggacccgtaaccccaacgttccggtacctaacctccgttcggttaaccccc

SEQ ID NO: 231300 - DNA, 385 bp, Homo sapiens; identical to SEQ ID NO: 230972
  misc_feature: GYAE6OF02HN6RH.13.11.A11.1.454.CMB.1.raw
  modified_base (380)..(385): a, c, t, g, unknown or other
  misc_feature (380)..(385): n is a, c, g, or t

SEQ ID NO: 231301 - DNA, 389 bp, Homo sapiens
  misc_feature: GYAE6OF02HIN4T.13.11.A11.1.454.CMB.1.raw
  modified_base (383)..(389): a, c, t, g, unknown or other
  misc_feature (383)..(389): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttatttctgtcaccagtatggtaggtcaccgtacactttttggccaggggaccaagctggagatcaagcgaactgtggctgcaccatctgtcttcatcttcccgccatctgatagtacgtgactgagcgggctgggcaagggcgcatagnnnnnnn

SEQ ID NO: 231302 - DNA, 384 bp, Homo sapiens; identical to SEQ ID NO: 230979
  misc_feature: GYAE6OF02GR748.13.11.A11.1.454.CMB.1.raw
  modified_base (380)..(384): a, c, t, g, unknown or other
  misc_feature (380)..(384): n is a, c, g, or t

SEQ ID NO: 231303 - DNA, 386 bp, Homo sapiens
  misc_feature: GYAE6OF02HGJUH.13.11.A11.1.454.CMB.1.raw
  modified_base (375)..(375): a, c, t, g, unknown or other
  misc_feature (375)..(375): n is a, c, g, or t
  modified_base (380)..(386): a, c, t, g, unknown or other
  misc_feature (380)..(386): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttatttctgtcaccagtatggtaggtcaccgtacacttttggccaggggaccaagctggagatcaagcgaactgtggctgcaccatctgtcttcatcttcccgccatctgatagtacgtgactgagcgggctggcaaggcgnatagnnnnnnn

SEQ ID NO: 231304 - DNA, 390 bp, Homo sapiens
  misc_feature: GYAE6OF02IMMI5.13.11.A11.1.454.CMB.1.raw
  modified_base (242)..(242): a, c, t, g, unknown or other
  misc_feature (242)..(242): n is a, c, g, or t
  modified_base (340)..(340): a, c, t, g, unknown or other
  misc_feature (340)..(340): n is a, c, g, or t
  modified_base (378)..(390): a, c, t, g, unknown or other
  misc_feature (378)..(390): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagctagactggaacctgaagactttgcactttatttcngtcaccagtatggtagtcaccgtactattttggccaggggaccaagctggagatcaagcaactgtggctgcaccatctgtctcatcttcccgcatccngatagtgtcgactgagcgggctggcaaggcgcataggnnnnnnnnnnnnn

SEQ ID NO: 231305 - DNA, 384 bp, Homo sapiens
  misc_feature: GYAE6OF02I70EI.13.11.A11.1.454.CMB.1.raw
  modified_base (240)..(240): a, c, t, g, unknown or other
  misc_feature (240)..(240): n is a, c, g, or t
  modified_base (377)..(384): a, c, t, g, unknown or other
  misc_feature (377)..(384): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttattcngtcaccagtatggtaggtcaccgtacacttttggccagggaccaagctggagatcaagcgaactgtggctgcacatctgtcttcatcttcccgccatctgatagtacgtgactgagcgggctggcaaggcgcatagnnnnnnnn

SEQ ID NO: 231306 - DNA, 561 bp, Homo sapiens
  misc_feature: GYAE6OF02H5G1L.13.11.A11.1.454.CMB.1.raw
  modified_base (370)..(370): a, c, t, g, unknown or other
  misc_feature (370)..(370): n is a, c, g, or t
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctcgtggagtccccagccgcttctctggatccaaggatgattccgccaacgcaggatattacncattctctgggctcagtctgacgatgaggtctgactattactgtttgacttggacacaacacgtcctggacttcgttcggaccgtgggaccctacggtcctacccggtacctagggttacccaaggaccccgaagggccccaaacccccgtactccgttacccgaacctttcccgtacggtttaccccccc

SEQ ID NO: 231307 - DNA, 387 bp, Homo sapiens
  misc_feature: GYAE6OF02HHHSK.13.11.A11.1.454.CMB.1.raw
  modified_base (381)..(387): a, c, t, g, unknown or other
  misc_feature (381)..(387): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcacttttatttctgtcaccagtatggtaggtcaccgtacacttttggccaggggaccaagcctggagatcaagcgaactgtggctgcaccatctgtctcatcttccgccatctggatagtacgtgactgagcgggctggcaaggcgcatagnnnnnnn

SEQ ID NO: 231308 - DNA, 383 bp, Homo sapiens
  misc_feature: GYAE6OF02FYGW7.13.11.A11.1.454.CMB.1.raw
  modified_base (379)..(383): a, c, t, g, unknown or other
  misc_feature (379)..(383): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttatttctgtcaccagtatggtaggtcaccgtacacttttggccaggggaccaagctggagatcaagcgaactgtggctgcaccatctgtcttcatcttccgccatctgatagtacgtgactgagcgggctggcaaggcgcatagnnnnn

SEQ ID NO: 231309 - DNA, 387 bp, Homo sapiens
  misc_feature: GYAE6OF02FPBAI.13.11.A11.1.454.CMB.1.raw
  modified_base (376)..(376): a, c, t, g, unknown or other
  misc_feature (376)..(376): n is a, c, g, or t
  modified_base (382)..(387): a, c, t, g, unknown or other
  misc_feature (382)..(387): n is a, c, g, or t
tcagtcacgtactacacgaccggtgctcgatttagctacgactgcagggccagtcagattgtcagcagcaactacttagcctggtaccagcagaagcctggtcaggcccccaggctcctcatctacgatgtattcaggaggaccactgacatcccagacaggttcagtggcagtgggtctgggacagacttcactctcaccatcagcagactggaacctgaagactttgctactttatttctgttcaccagtatggtaggtcaccgtacacttttggccaggggaccaagctggagatcaagcgaactgtggctgcaccatctgtcttcatcttcccgccatctgatagtacgtgactgagcgggctggcaaggcncatagnnnnnn

SEQ ID NO: 231310 - DNA, 387 bp, Homo sapiens
  misc_feature: GYAE6OF02INYPB.13.11.A11.1.454.CMB.1.raw
  modified_base (380)..(387): a, c, t, g, unknown or other
  misc_feature (380)..(387): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaacctgaagactttgctactttatttctgtcaccagtatggtagtcaccgtacacttttggccaggggaccaagctggagatcaagcgaactgtggctgcacatctgtcttcatcttcccgcctatctgatagtacgtgactgagcggctggcaaggcgcatagnnnnnnnn

SEQ ID NO: 231311 - DNA, 382 bp, Homo sapiens
  misc_feature: GYAE6OF02JRPKC.13.11.A11.1.454.CMB.1.raw
  modified_base (371)..(382): a, c, t, g, unknown or other
  misc_feature (371)..(382): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcacttttattctgtcaccagtatggtagtcacgtacactttggccagggaccaagctggagatcaagcgaactgtgtgcacatctgtctcatctccgcatctgatagtacgtgactgagcgggtctggcaaggcgcagtagnnnnnnnnnnnn

SEQ ID NO: 231312 - DNA, 384 bp, Homo sapiens
  misc_feature: GYAE6OF02JPYGX.13.11.A11.1.454.CMB.1.raw
  modified_base (371)..(371): a, c, t, g, unknown or other
  misc_feature (371)..(371): n is a, c, g, or t
  modified_base (376)..(384): a, c, t, g, unknown or other
  misc_feature (376)..(384): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctacttttattctgtcaccagtatggtaggtcaccgtcacttttggccaggggaccaagctggagatcaagcgaactgtggctgcaccatctgtctcatcttcccgcatctgatagtactgactgagcggctggcaaggcgnatagnnnnnnnnn

SEQ ID NO: 231313 - DNA, 392 bp, Homo sapiens
  misc_feature: GYAE6OF02IB2UD.13.11.A11.1.454.CMB.1.raw
  modified_base (386)..(392): a, c, t, g, unknown or other
  misc_feature (386)..(392): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagacctggaacctgaagactttgcacttttattctgtcaccagtatggtaggtcaccgtacacttttggccaggggaccaagctggagatcaagcgaactgtggctgcaccatctgtcttcatcctttcccgccatctgatagtacgtgactgagcgggctggcgaaggcgcagtagnnnnnnn

SEQ ID NO: 231314 - DNA, 388 bp, Homo sapiens; identical to SEQ ID NO: 231001
  misc_feature: GYAE6OF02I65AG.13.11.A11.1.454.CMB.1.raw
  modified_base (380)..(388): a, c, t, g, unknown or other
  misc_feature (380)..(388): n is a, c, g, or t

SEQ ID NO: 231315 - DNA, 386 bp, Homo sapiens; identical to SEQ ID NO: 230986
  misc_feature: GYAE6OF02F6U2P.13.11.A11.1.454.CMB.1.raw
  modified_base (381)..(386): a, c, t, g, unknown or other
  misc_feature (381)..(386): n is a, c, g, or t

SEQ ID NO: 231316 - DNA, 561 bp, Homo sapiens
  misc_feature: GYAE6OF02GYQ15.13.11.A11.1.454.CMB.1.raw
  modified_base (206)..(206): a, c, t, g, unknown or other
  misc_feature (206)..(206): n is a, c, g, or t
  modified_base (214)..(214): a, c, t, g, unknown or other
  misc_feature (214)..(214): n is a, c, g, or t
  modified_base (538)..(561): a, c, t, g, unknown or other
  misc_feature (538)..(561): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatccccagacgtgttcagtcggacagggtcggtcgtagggacagtctttcacttcnccaacctntcagcagacgtcgaacctaggaacttacctttgaccttaatttttatttccgagttacccaacgaagtttaagttcgggtacggtacctaaacccggttaactttcggttttcggacccgggtaaacggggaacccgtaactccgttgggggaactacttaacccgaaaggccgtaaacttgggtttggaccttcgaacccgactaaggttccttggttccttacctaacggttccccctttacccggccttaagtttccgtaagaaggtttaccgtacgttcgaacgttggacggtcgggtcgccgtagacggctactagtcnnnnnnnnnnnnnnnnnnnnnnnn

SEQ ID NO: 231317 - DNA, 389 bp, Homo sapiens
  misc_feature: GYAE6OF02HTOIL.13.11.A11.1.454.CMB.1.raw
  modified_base (354)..(354): a, c, t, g, unknown or other
  misc_feature (354)..(354): n is a, c, g, or t
  modified_base (381)..(389): a, c, t, g, unknown or other
  misc_feature (381)..(389): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtggtctgggacagacttcactctcaccatcagcagactggaacctgaagactttgctactttatttctgtcaccagtatggtaggtcaccgtacacttttggccaggggaccaagctggagatcaagcgaactgtggctgcaccatctgtcttcattcttcccgccatctgatagtacgtnactgagcggctgggcaaggcgcatagnnnnnnnnn

SEQ ID NO: 231318 - DNA, 593 bp, Homo sapiens
  misc_feature: GYAE6OF02JTQUE.13.11.A11.1.454.CMB.1.raw
  modified_base (337)..(337): a, c, t, g, unknown or other
  misc_feature (337)..(337): n is a, c, g, or t
  modified_base (351)..(351): a, c, t, g, unknown or other
  misc_feature (351)..(351): n is a, c, g, or t
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtcctatgacatatattggtaaccgacagaacgccaggggacgtcctcccctagtttctcctgaggttcaggtcaaactcagataaacgacagggctcgtggacgtccccagccgtcttcnctggactccaaggntgattccgacaacgcaggatactctacatctacgtgggctccgagtctagacgtatggagctaggacttatttacgtgtttgactttcggactaacgaaccaacgtccgtaggtacttcttaccgggactacggggtaccaccggtcctaaccggttcccgtaacgggttccaacggacccccgtaaacggcccctaaccccgaccgtcggtaccctaccgttccgttacccgttacccccc

SEQ ID NO: 231319 - DNA, 386 bp, Homo sapiens
  misc_feature: GYAE6OF02IKDZB.13.11.A11.1.454.CMB.1.raw
  modified_base (381)..(386): a, c, t, g, unknown or other
  misc_feature (381)..(386): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaacctgaagactttgctactttattctgtcaccagtatggtaggtcaccgtacacttttggccaggggaccaagctggagatcaagcgaactgtggctgcaccatctgtcttcatcttcccgccatctgatagtacgtgactgagcgggctggcaaggcgcatagnnnnnn

SEQ ID NO: 231320 - DNA, 387 bp, Homo sapiens
  misc_feature: GYAE6OF02GVQ0E.13.11.A11.1.454.CMB.1.raw
  modified_base (382)..(387): a, c, t, g, unknown or other
  misc_feature (382)..(387): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcacttttatttctgtcaccagtatggtaggtcaccgtacacttttggccaggggaccaagctggagatcaagcgaactgtggctgcaccatctgtcttcatcttcccgccatctgatagtacgtgactgagcgggctgggcaaggcgcatagnnnnnn

SEQ ID NO: 231321 - DNA, 520 bp, Homo sapiens
  misc_feature: GYAE6OF02ILJME.13.11.A11.1.454.CMB.1.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatattactcatctctgggctccagtctgacgatgaggctgacttattactgtttgacttggcacaacacgcctggatcgttcgacctgggaccacggtcaccgttcgtaggtccacgcccaaggacccaacccgtacgtcgccactcctcgttccccg

SEQ ID NO: 231322 - DNA, 390 bp, Homo sapiens
  misc_feature: GYAE6OF02JI82S.13.11.A11.1.454.CMB.1.raw
  modified_base (351)..(351): a, c, t, g, unknown or other
  misc_feature (351)..(351): n is a, c, g, or t
  modified_base (379)..(390): a, c, t, g, unknown or other
  misc_feature (379)..(390): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttattctgtcaccagtatggtaggtcaccgtacacttttggccaggggaccaagctggagatcaagcgaactgtggctgcacatctgtcttcatcttcccgccatctgatagtacgtnactgagcgggctggcaaggcgcagtagnnnnnnnnnnnn

SEQ ID NO: 231323 - DNA, 626 bp, Homo sapiens
  misc_feature: GYAE6OF02IQBBU.13.11.A11.1.454.CMB.1.raw
  modified_base (240)..(240): a, c, t, g, unknown or other
  misc_feature (240)..(240): n is a, c, g, or t
  modified_base (587)..(587): a, c, t, g, unknown or other
  misc_feature (587)..(587): n is a, c, g, or t
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttcctctctgcttctcctggagcgtcagccagtctcacctgcaccttgcgcagtgcaccatgttggtcctatgacatatattcggtaccganagaagccagggagtcctcccagttctctgaggttcaggtcaaactcagataaacgacaggctactaggacgtcccagtcctctttctcgtggactaccgaaggactgacttcccgaccaacggcaagggtattaacttactcactcgtcgtgggacctcccgaagtccgtgacgtagtggaggcttgaacttattacgtgtttacgacgttcggactaaccgtaaacaccgtactagggtacttaccggtttaccggaacccgtcggggaacccttaccgggtacctacccggttacgttaacgggtacccaacgtacccccggaaacggtccccctaaaaccccgngttaccgtaccgtaccgttaccgttcccggttacccccg

SEQ ID NO: 231324 - DNA, 393 bp, Homo sapiens
  misc_feature: GYAE6OF02JB32K.13.11.A11.1.454.CMB.1.raw
  modified_base (382)..(393): a, c, t, g, unknown or other
  misc_feature (382)..(393): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttatttctgtcaccagtatggtagtcaccgtacacttttggccaggtgaccaagctggagatcaagcgaactgtggctgcaccatctgtcttcatcttcccgcatctgatagtacgtgactgagcgggctggcaagggcgacatacgnnnnnnnnnnnn

SEQ ID NO: 231325 - DNA, 386 bp, Homo sapiens
  misc_feature: GYAE6OF02GFOEM.13.11.A11.1.454.CMB.1.raw
  modified_base (241)..(241): a, c, t, g, unknown or other
  misc_feature (241)..(241): n is a, c, g, or t
  modified_base (379)..(386): a, c, t, g, unknown or other
  misc_feature (379)..(386): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcacttttattcngtcaccagtatggtagtcaccgtacacttttggccaggggaccaagctggagatcaagcgaactgtggctgcaccatctgtcttcatcttcccgccatctgatagtacgtgactgagcgggctggcaaggcgcatagnnnnnnnn

SEQ ID NO: 231326 - DNA, 383 bp, Homo sapiens
  misc_feature: GYAE6OF02I0VK9.13.11.A11.1.454.CMB.1.raw
  modified_base (375)..(375): a, c, t, g, unknown or other
  misc_feature (375)..(375): n is a, c, g, or t
  modified_base (379)..(383): a, c, t, g, unknown or other
  misc_feature (379)..(383): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctacttttatttctgtcaccagtatggtagtcaccgtacacttttggccaggggaccaagctggagatcaagcgaactgtggctgcaccatctgtcttcatcttcccgcatctgatagtacgtgactgagcgggctggcaaggcgnatgnnnnn

SEQ ID NO: 231327 - DNA, 504 bp, Homo sapiens
  misc_feature: GYAE6OF02F8V7W.13.11.A11.1.454.CMB.1.raw
  modified_base (488)..(488): a, c, t, g, unknown or other
  misc_feature (488)..(488): n is a, c, g, or t
  modified_base (499)..(499): a, c, t, g, unknown or other
  misc_feature (499)..(499): n is a, c, g, or t
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgcaacgcagggatattactcatctcgtggctccagtctgacgatgaggctagactattactgttgtactggcacaacacgcctggactcgttcggacctggaccacggtcaccgtctaggcacgcccaagccaacccnctcgcactctntcccc

SEQ ID NO: 231328 - DNA, 389 bp, Homo sapiens
  misc_feature: GYAE6OF02GDCB5.13.11.A11.1.454.CMB.1.raw
  modified_base (381)..(389): a, c, t, g, unknown or other
  misc_feature (381)..(389): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctacttttattctgtcaccagtatggtaggtcaccgtacacttttggccaggggaccaagctggagatcaagcgaactgtggctgcacatctgtcttcatcttccgccatctgatagtacgtgactggagcgggctggcaaggcgcagtagnnnnnnnnn

SEQ ID NO: 231329 - DNA, 425 bp, Homo sapiens
  misc_feature: GYAE6OF02GKEFL.13.11.A11.1.454.CMB.1.raw
  modified_base (393)..(398): a, c, t, g, unknown or other
  misc_feature (393)..(398): n is a, c, g, or t
  modified_base (400)..(425): a, c, t, g, unknown or other
  misc_feature (400)..(425): n is a, c, g, or t
tcagtcacgtactacacgaccggtgctcgattttagctacgactgcagggccgagtcagattgtcagcagcaactacttagcctggtaccagcagaagcctggcccaggcccccaggctcctcatctacgatgtattcgaggaaggaccactgacatcccagacaggttcagtggcagtgggtctgggacaggacttcactctcaccatcagcagactggaacctgaagactttgactacttttatttctgtcaccagtatggtaggtcaccgtacacttttggcctaggggaccaagctggagatcaagcgaactgtaggctgccaccatctgtcttcatcttcccgcctatctgatagtacgtgactgagcgggctggcaaggcgcatagnnnnnntnnnnnnnnnnnnnnnnnnnnnnnnnn

SEQ ID NO: 231330 - DNA, 384 bp, Homo sapiens
  misc_feature: GYAE6OF02GO77J.13.11.A11.1.454.CMB.1.raw
  modified_base (378)..(384): a, c, t, g, unknown or other
  misc_feature (378)..(384): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttattctgtcaccagtatggtaggtcaccgtacacttttggccaggggaccaagctggagatcaagcgaactgtggctgcaccatctgtcttcatcttcccgccatctgatagtacgtgactgagcggctggcaggcgcatagnnnnnnn

SEQ ID NO: 231331 - DNA, 492 bp, Homo sapiens
  misc_feature: GYAE6OF02GU1NJ.13.11.A11.1.454.CMB.1.raw
  modified_base (197)..(197): a, c, t, g, unknown or other
  misc_feature (197)..(197): n is a, c, g, or t
  modified_base (458)..(458): a, c, t, g, unknown or other
  misc_feature (458)..(458): n is a, c, g, or t
  modified_base (489)..(489): a, c, t, g, unknown or other
  misc_feature (489)..(489): n is a, c, g, or t
tcagtcacgtactacacgaccggtgctcgatttagctacgactgcaggggagaagagctgctcagttaggacccagagggaaccatggaaaccccagcgcagcttctcttcctcctgctactctggctcccagataccaccggagaaattgtgttgacgcagtctccaggcatcgtgtctttgtctccaggggaaangccaccctctcctgcagggccagtcagattgtcagcagcaactacttagcctggtaccagcagaagcctggccaggcccccaggctcctcatctacgatgtattcaggaggaccactgacatcccagacaggttcagtggcagtggtctgggacagacttcactctcaccatcagcagactggaacctgaagtactttgctactttattctgtcactagtatggtagtcacgtactactttggccagggaccagtctgganatcaagcgtaatgtggctgcacatctgtctntac

SEQ ID NO: 231332 - DNA, 391 bp, Homo sapiens
  misc_feature: GYAE6OF02IM73E.13.11.A11.1.454.CMB.1.raw
  modified_base (242)..(242): a, c, t, g, unknown or other
  misc_feature (242)..(242): n is a, c, g, or t
  modified_base (376)..(376): a, c, t, g, unknown or other
  misc_feature (376)..(376): n is a, c, g, or t
  modified_base (381)..(391): a, c, t, g, unknown or other
  misc_feature (381)..(391): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaacctgaagactttgcactttatttcngtcaccagtatggtaggtcaccgtacacttttggccaggggaccaagctggagatcaagcgaactgtggctgcaccatctgtcttcatcttcccgccatctgatagtacgtgactgagcgggctggcaaggcgnatagnnnnnnnnnnn

SEQ ID NO: 231333 - DNA, 388 bp, Homo sapiens
  misc_feature: GYAE6OF02FG7NJ.13.11.A11.1.454.CMB.1.raw
  modified_base (380)..(388): a, c, t, g, unknown or other
  misc_feature (380)..(388): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctacttttattctgtcaccagtatggtaggtcaccgtacactttggcctaggggaccaagctggagatcaagcgaactgtggctgcaccatctgtcttcatcctccgcctatctgatagtacgtgactgagcgggctggcaggcgcatagnnnnnnnnn

SEQ ID NO: 231334 - DNA, 410 bp, Homo sapiens
  misc_feature: GYAE6OF02H16Z5.13.11.A11.1.454.CMB.1.raw
  modified_base (227)..(227): a, c, t, g, unknown or other
  misc_feature (227)..(227): n is a, c, g, or t
  modified_base (263)..(263): a, c, t, g, unknown or other
  misc_feature (263)..(263): n is a, c, g, or t
  modified_base (282)..(282): a, c, t, g, unknown or other
  misc_feature (282)..(282): n is a, c, g, or t
  modified_base (356)..(356): a, c, t, g, unknown or other
  misc_feature (356)..(356): n is a, c, g, or t
  modified_base (382)..(382): a, c, t, g, unknown or other
  misc_feature (382)..(382): n is a, c, g, or t
  modified_base (387)..(410): a, c, t, g, unknown or other
  misc_feature (387)..(410): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagactttcactctcaccatcagcagcctgcaggctgaaagntgtggcagttttatactgtcagcaatatatagtacnctccgagctcactttcggnggaggaccaaggtggagatcaaaagactgtgctgcaccatctgtctcactcttcccgcatcagatacgtacgtnactgagtcggctgggacaaggcgtanatagnnnnnnnnnnnnnnnnnnnnnnnn

SEQ ID NO: 231335 - DNA, 387 bp, Homo sapiens
  misc_feature: GYAE6OF02IZRXU.13.11.A11.1.454.CMB.1.raw
  modified_base (311)..(311): a, c, t, g, unknown or other
  misc_feature (311)..(311): n is a, c, g, or t
  modified_base (363)..(363): a, c, t, g, unknown or other
  misc_feature (363)..(363): n is a, c, g, or t
  modified_base (379)..(387): a, c, t, g, unknown or other
  misc_feature (379)..(387): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaacctgaagactttgctacttttattctgtcaccagtatggtaggtcacgtactacttttggccaggggaccaagctggagatacaagcgaactgnggctgcacatctgtcttcatctcccgcatctgatagtacgtgactgagcggntggcaaggcgcatagnnnnnnnnn

SEQ ID NO: 231336 - DNA, 595 bp, Homo sapiens
  misc_feature: GYAE6OF02HARRG.13.11.A11.1.454.CMB.1.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggacgtccccagcccgctttctctggactccgaaaggactgatttcccgccaacgcgagggatattactcattctcgtcgggctccagtctgacgatgaggctgacttattacgtgtttgacgtttggcacgaaccaaccgtccgtaggtacttccgttccgggaccgttacggggaaccctacgggttccctaacccggttcgttaacgggtccaccggaccccgaaccgggaccccaacccccgtacttaccgtaccctaccgttcccgtcgttaccccccg

SEQ ID NO: 231337 - DNA, 400 bp, Homo sapiens
  misc_feature: GYAE6OF02HWORH.13.11.A11.1.454.CMB.1.raw
  modified_base (394)..(400): a, c, t, g, unknown or other
  misc_feature (394)..(400): n is a, c, g, or t
tcagtcacgtactacacgaccggtgctcgatttagctacgactgcagggccagtcagattgtcagcagcaactacttagcctggtaccagcagaagcctggccaggcccccaggctcctcatctatggtgcatccaccagggccactggtatcccagaccggttcagtggcagtgggtctgggacagacttcactctcaccatcagcagtctgcagtctgaagtattttgctagtttattactgttcagcagtataataactggcctccgtacatgtacactttttggccaggggacctaaccgtggagatcagacgaactgtggctgcaccatctgtcttcatcttcccgcatctgatagtacgtgactgagcgggctggcaaggcgcatagnnnnnnn

SEQ ID NO: 231338 - DNA, 384 bp, Homo sapiens
  misc_feature: GYAE6OF02HWRV0.13.11.A11.1.454.CMB.1.raw
  modified_base (379)..(384): a, c, t, g, unknown or other
  misc_feature (379)..(384): n is a, c, g, or t
tcagtcacgtactacacgaccggtgctcgatttagctacgactgcagggccagtcagattgtcagaagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttattctgtcaccagtatggtaggtcaccgtacacttttggccaggggaccaagctggagatcaagcgaactgtggctgcaccatctgtcttcatcttccgccatctgatagtacgtgactgagcgggctggcaaggcgcatagnnnnnn

SEQ ID NO: 231339 - DNA, 581 bp, Homo sapiens
  misc_feature: GYAE6OF02JDGQR.13.11.A11.1.454.CMB.1.raw
tcagtcacgtactacacgaccggtgctcgatttagctacgactgcaggggagaagagctgctcagttaggacccagagggaaccatggaaaccccagcgcagcttctcttcctcctgctacttctgggctcccagataccaccggagaaattgtgttgacgcagtctccaggcatcgtgtctttgtctccaggggaaagagccaccctctccgtgcagggccagtcagattgtcagcagcaactacttagcctggtaccagcagaagcctggccaggcccccaggctcctcatctacgatgtattcaggaggaccactcgacactcccagacaggttcagtggcagtggtctgggacagacttcgactctcaccatcagcagactggaacctgaagtactttgacctactttactttcgtgttacacctagttagtaggttacggtctaccggttactacgttttacgggacctacggggtacctaaagtcgtagggagtacgttacgaacggtcgtaacgtggtacggtaccgttaggacccgtaaccgtagttccgttacggttacctttacgtaaccg

SEQ ID NO: 231340 - DNA, 386 bp, Homo sapiens
  misc_feature: GYAE6OF02FV1EF.13.11.A11.1.454.CMB.1.raw
  modified_base (380)..(386): a, c, t, g, unknown or other
  misc_feature (380)..(386): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctacttttattctgtcaccagtatggtaggtcaccgtacacttttggccaggggaccaagctggagatcaagcgaactgtggctgcaccatctgtcttcatcttcccgccatctgatagtacgtgactgagcggctggcaaggcgcatagnnnnnnn

SEQ ID NO: 231341 - DNA, 404 bp, Homo sapiens
  misc_feature: GYAE6OF02GYXWP.13.11.A11.1.454.CMB.1.raw
  modified_base (331)..(331): a, c, t, g, unknown or other
  misc_feature (331)..(331): n is a, c, g, or t
  modified_base (372)..(372): a, c, t, g, unknown or other
  misc_feature (372)..(372): n is a, c, g, or t
  modified_base (390)..(404): a, c, t, g, unknown or other
  misc_feature (390)..(404): n is a, c, g, or t
tcagtcacgtactacacgaccggtgctcgatttagctacgactgcagggccaggtcagattgtcagcagcaactacttagcctggtaccagcagaagcctggccaggccccccaggctcctcatctacgatgtattcaggaggaccactgacatcccagacaggttcagtggcagtgggtctggggacagacttcactctcaccatcagcagactggaacctgaaagactttgctacttttattctgtcaccagtatggtaggtcaccgtacactttggcctatgggaccaagctggagatcaagcgaactgtgctgcaccatctgtcttnactcttcccgctatctgtactagtacgtgactgagtcgggntcggcaaggcgcagtagnnnnnnnnnnnnnnn

SEQ ID NO: 231342 - DNA, 406 bp, Homo sapiens
  misc_feature: GYAE6OF02F1392.13.11.A11.1.454.CMB.1.raw
  modified_base (389)..(406): a, c, t, g, unknown or other
  misc_feature (389)..(406): n is a, c, g, or t
tcagtcacgtactacacgaccggtgctcgatttagctacgactgcagggccagtcagattgtcagctagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaacctgaagacttttgctacttttattctgttcaccagtatggtaggtcaccgtacacttttgccaggggaccaagctggacgatcaagcgaactgtggctgacaccatctgtcttcatccttcccgccatctgactagtacgtgactgagcgggctggacaaggcgcatagnnnnnnnnnnnnnnnnnn

SEQ ID NO: 231343 - DNA, 704 bp, Homo sapiens
  misc_feature: GYAE6OF02GNFXR.13.11.A11.1.454.CMB.1.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttcgtcctatgacatatattggtaccgacagaagccgagggacgtcctacccgtagtttctcctgaggttcaggtacaaactcgaagaactaaacgacgagggtcctcgtacgggacgtaccccgagtcccgtctttcctcgttagggtaactacccggaaaggtactacgtaccgttacccggaccgtaaacggcgtaagggtaacttacgttactactattcgtcggtacgggtaccttaccgaggttcgtacggacgtagtcggtacggcttacgtaactttagtttacgttgtttaacgtacgtttgaaccaaccgaaccgtaaccggtccttagggtacctttccggttaccggaccggtacgggtaacccgtacgggttaccctaaccccggttacggttaacgggacccgaaccggtaaccccgaaccggacccaaacccgtccgttacggtaccctaacccgttccgttccccgttacccccg

SEQ ID NO: 231344 - DNA, 539 bp, Homo sapiens
  misc_feature: GYAE6OF02GMFSS.13.11.A11.1.454.CMB.1.raw
  modified_base (197)..(197): a, c, t, g, unknown or other
  misc_feature (197)..(197): n is a, c, g, or t
tcagtcacgtactacacgaccggtgctcgatttagctacgactgcaggggagaagagctgctcagttaggacccagagggaaccatggaaaccccagcgcagcttctcttcctcctgctactctggctcccagataccaccggagaaattgtgttgacgcagtctccaggcatcgtgtctttgtctccaggggaaangcccaccctctcctgcagggccagtcagattgtcagcagcaactacttagcctggtaccagcagaagcctggccaggcccccaggcttctcatctacgatgtattcaggagaccactgacatccagacaggttcagtggcaggtgggtctgggacagacttcactctcaccatcagcagactacggaactgaagtactttgactactttatttcttcgtcacctagtatggttacggtctaccgtactacttttcggccgtaacgggaccaaggtcgtaggagtagtacgaaggcgtaagttggtaggtacgtacgacaccgtacttcgtcgttacttctac

SEQ ID NO: 231345 - DNA, 397 bp, Homo sapiens
  misc_feature: GYAE6OF02GFHZB.13.11.A11.1.454.CMB.1.raw
  modified_base (368)..(368): a, c, t, g, unknown or other
  misc_feature (368)..(368): n is a, c, g, or t
  modified_base (385)..(397): a, c, t, g, unknown or other
  misc_feature (385)..(397): n is a, c, g, or t
tcagtcacgtactacacgaccggtgctcgatttagctacgactgcagggccgagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcacttttatttctgttcaccagtatggtaggtcaccgtacacttttggccaggggtaccaagctggagatcaagcgaactgtggctgcaccatctgtcttcatcttccgccatctgatagtacgtgacttgagcgggntggcaaggcgcatagcnnnnnnnnnnnnn

SEQ ID NO: 231346 - DNA, 384 bp, Homo sapiens; identical to SEQ ID NO: 230979
  misc_feature: GYAE6OF02FHWM1.13.11.A11.1.454.CMB.1.raw
  modified_base (380)..(384): a, c, t, g, unknown or other
  misc_feature (380)..(384): n is a, c, g, or t

SEQ ID NO: 231347 - DNA, 387 bp, Homo sapiens; identical to SEQ ID NO: 231009
  misc_feature: GYAE6OF02GECL8.13.11.A11.1.454.CMB.1.raw
  modified_base (380)..(387): a, c, t, g, unknown or other
  misc_feature (380)..(387): n is a, c, g, or t

SEQ ID NO: 231348 - DNA, 400 bp, Homo sapiens
  misc_feature: GYAE6OF02H66VS.13.11.A11.1.454.CMB.1.raw
  modified_base (394)..(400): a, c, t, g, unknown or other
  misc_feature (394)..(400): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggtttcagtggcagtgggtctgggacagacttcactctcacatcagcagactggaacctgaagacttttgctacttttatttctgtcacctagtatggtaggtcaccgtactacttttcggcctaggggaaccaagctaggagtatcaagcgaactgtggctgcaccatctgtcttcattccttccgctatctgattgtactgactgaggcggctggacgaacggcgcagtagnnnnnnn

SEQ ID NO: 231349 - DNA, 384 bp, Homo sapiens
  misc_feature: GYAE6OF02IGV5E.13.11.A11.1.454.CMB.1.raw
  modified_base (380)..(384): a, c, t, g, unknown or other
  misc_feature (380)..(384): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaacctgaagactttgctactttatttctgtcaccagtatggtaggtcaccgtacacttttggccaggggaccaagctggagatcaagcgaactgtgctgcaccatctgtcttcatcttccgccatctgatagtacgtgactgagcgggctggcaaggcgcatagnnnnn

SEQ ID NO: 231350 - DNA, 390 bp, Homo sapiens
  misc_feature: GYAE6OF02GXSO6.13.11.A11.1.454.CMB.1.raw
  modified_base (338)..(338): a, c, t, g, unknown or other
  misc_feature (338)..(338): n is a, c, g, or t
  modified_base (383)..(390): a, c, t, g, unknown or other
  misc_feature (383)..(390): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagtactttgctacttttattctgtcaccagtatggtagtcaccgtactacttttggcctagggaccaacctggagatcagacgaactgtggctgcaccatctgtcttcatcttcccnctatctgatagtacgtgactgagcgggctggcaaggcgcagtagnnnnnnnn

SEQ ID NO: 231351 - DNA, 617 bp, Homo sapiens
  misc_feature: GYAE6OF02HMLDW.13.11.A11.1.454.CMB.1.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccacagaagccagggagtcctccccagtttctcctgaggttcaggtcaaactcagataaacgacagggctctggagtccccagccgcttcctcgtggatccgaaggatgattcccgaccaacgcagggatattactcattctctgggctccagtctgacgattggagtctggacttatttaacgtgtttagacgttggcaaccaaacgaaccgtccctagggtactttccgttaccgggaccttacggggtaccctaccgggttccgaaccccggtttcccgttaacgggtccgaacggtccccgtaaaccgggcccccaaacccccgtaccgttaccggtaccctaacccgtttccgttacccggtttacccccccgg

SEQ ID NO: 231352 - DNA, 417 bp, Homo sapiens
  misc_feature: GYAE6OF02GIIGS.13.11.A11.1.454.CMB.1.raw
  modified_base (393)..(393): a, c, t, g, unknown or other
  misc_feature (393)..(393): n is a, c, g, or t
  modified_base (395)..(417): a, c, t, g, unknown or other
  misc_feature (395)..(417): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaacctgaagactttgctacttttattctgtcaccagtatggtagtccaccgtactacttttggccagggaccaagctggagatcaagcgaactgtggctgcaccatctgtcttcatccttcccgctatctgtatacgtacgtgactggacgcgggctggaccgaaggcacgagtacgncnnnnnnnnnnnnnnnnnnnnnnn

SEQ ID NO: 231353 - DNA, 565 bp, Homo sapiens
  misc_feature: GYAE6OF02FQLEF.13.11.A11.1.454.CMB.1.raw
  modified_base (197)..(197): a, c, t, g, unknown or other
  misc_feature (197)..(197): n is a, c, g, or t
  modified_base (206)..(206): a, c, t, g, unknown or other
  misc_feature (206)..(206): n is a, c, g, or t
tcagtcacgtactacacgaccggtgctcgatttagctacgactgcaggggagaagagctgctcagttaggacccagagggaaccatggaaaccccagcgcagcttctcttcctcctgctactctggctcccagataccaccggagaaattgtgttgacgcagtctccaggcatcgtgtctttgtctccaggggaaangccaccctntcctgcagggccagtcagattgtcagcagcaactacttagcctggtaccagcagaagcctggccaggcccccaggctcctcatctacgatgtattcaggagaccactgacatcccagacaggttcagtggcagtgggtctgggacagacttcactctcaccatcagcagactggaacctgaacgacttgctaactttattctgtactaccgtagtacgtggttacggtctaccgttactacgttttggaccgtaacgggggtacccaaaggtccgtagggtacgtactaccgaaagggcgtaaaccgttgggtacgggaccttggaccaaccctaagttcctaggttccttaccgtaac

SEQ ID NO: 231354 - DNA, 387 bp, Homo sapiens
  misc_feature: GYAE6OF02G7D9J.13.11.A11.1.454.CMB.1.raw
  modified_base (381)..(387): a, c, t, g, unknown or other
  misc_feature (381)..(387): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttatttctgtcaccagtatggtaggtcaccgtacacttttggccaggggaccaagctggagatcaagcgaactgtggctgcaccatctgtcttcatcttcccgccatctgatagtacgtgactgagcgggctggcaaggcgcatagnnnnnnn

SEQ ID NO: 231355 - DNA, 391 bp, Homo sapiens
  misc_feature: GYAE6OF02ILIET.13.11.A11.1.454.CMB.1.raw
  modified_base (382)..(391): a, c, t, g, unknown or other
  misc_feature (382)..(391): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaacctgaagactttgctactttatttctgtcaccagtatggtagtcaccgtacacttttggccaggggaccaagctggagatcaagcgaactgtaggctgcaccatctgtcttcatcttcccgccatctgactagtacgtgactgagcggctggcaaggcgcatagnnnnnnnnnn

SEQ ID NO: 231356 - DNA, 403 bp, Homo sapiens
  misc_feature: GYAE6OF02I656C.13.11.A11.1.454.CMB.1.raw
  modified_base (242)..(242): a, c, t, g, unknown or other
  misc_feature (242)..(242): n is a, c, g, or t
  modified_base (294)..(294): a, c, t, g, unknown or other
  misc_feature (294)..(294): n is a, c, g, or t
  modified_base (389)..(403): a, c, t, g, unknown or other
  misc_feature (389)..(403): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctggggacagacttcactctcaccatcagcagactggaacctgaagactttgcacttttattcngtcaccagtatggtagtcaccgtacacttttggccaggggaccaagctgganatcaagcgaactgtggctgcaccatctgtcttcatccttcccgcctatctgtatagtacgtgactgagcgggactggactaaggccgcataggcnnnnnnnnnnnnnnn

SEQ ID NO: 231357 - DNA, 490 bp, Homo sapiens
  misc_feature: GYAE6OF02FZU14.13.11.A11.1.454.CMB.1.raw
  modified_base (286)..(286): a, c, t, g, unknown or other
  misc_feature (286)..(286): n is a, c, g, or t
  modified_base (415)..(415): a, c, t, g, unknown or other
  misc_feature (415)..(415): n is a, c, g, or t
  modified_base (435)..(437): a, c, t, g, unknown or other
  misc_feature (435)..(437): n is a, c, g, or t
  modified_base (439)..(439): a, c, t, g, unknown or other
  misc_feature (439)..(439): n is a, c, g, or t
  modified_base (441)..(442): a, c, t, g, unknown or other
  misc_feature (441)..(442): n is a, c, g, or t
  modified_base (446)..(446): a, c, t, g, unknown or other
  misc_feature (446)..(446): n is a, c, g, or t
  modified_base (448)..(448): a, c, t, g, unknown or other
  misc_feature (448)..(448): n is a, c, g, or t
  modified_base (453)..(455): a, c, t, g, unknown or other
  misc_feature (453)..(455): n is a, c, g, or t
  modified_base (457)..(457): a, c, t, g, unknown or other
  misc_feature (457)..(457): n is a, c, g, or t
  modified_base (460)..(461): a, c, t, g, unknown or other
  misc_feature (460)..(461): n is a, c, g, or t
  modified_base (463)..(468): a, c, t, g, unknown or other
  misc_feature (463)..(468): n is a, c, g, or t
  modified_base (470)..(470): a, c, t, g, unknown or other
  misc_feature (470)..(470): n is a, c, g, or t
  modified_base (472)..(472): a, c, t, g, unknown or other
  misc_feature (472)..(472): n is a, c, g, or t
  modified_base (474)..(475): a, c, t, g, unknown or other
  misc_feature (474)..(475): n is a, c, g, or t
  modified_base (477)..(477): a, c, t, g, unknown or other
  misc_feature (477)..(477): n is a, c, g, or t
  modified_base (479)..(479): a, c, t, g, unknown or other
  misc_feature (479)..(479): n is a, c, g, or t
  modified_base (481)..(489): a, c, t, g, unknown or other
  misc_feature (481)..(489): n is a, c, g, or t
tcagtcacgtactacacgaccggtgctcgattttagctacgactgcagggccagttcgtaggattggtcacgcagcaacgtactttagcctggttacccagcagaagcctggccaggccccaggctcctcatctacgatggtatttcaggaggacctacgttgacatcccagaactaagggtttcagtggcagtggggtctggggtacaggacttcacgtcgtcgaccatccaggccggacgactgggaaccctgaacgactttgctactttatttctgttcaccngtatggtaggtcaccgtacacttttggccgacggggaccaaggcctcgggaggagtcaaggcgaacgtgtggctgcacatctgtcttcatcttcccgcactctcgataggtacgtgacctgagcgggcngggcaaggcgcaagtacggnnnanannagancngacannngnatnntnnnnnngngngnngngngnnnnnnnnnc

SEQ ID NO: 231358 - DNA, 686 bp, Homo sapiens
  misc_feature: GYAE6OF02HSKVL.13.11.A11.1.454.CMB.1.raw
  modified_base (306)..(306): a, c, t, g, unknown or other
  misc_feature (306)..(306): n is a, c, g, or t
  modified_base (622)..(622): a, c, t, g, unknown or other
  misc_feature (622)..(622): n is a, c, g, or t
tcagtcacgtactacacgaccggtgctcgatttagctacgactgcaggggtctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggaggcttggtacaggcctgggcaggtccctgagactctcctgtgcagcctctggatttcattctttgattgattatgccatgcacgtggggtccgnaagctccgaggggaaggcctgggagtgggtctcgagggttattaggttggaattaggtcggtaaactagtagggctaagttcggacggaccttcgtggtacgggaaacggggtcccggtaatttccgaaccctaacgttcccgttacccgaaggtaacggaacccgtaaaaccggcccaaaaacggtaaccccttccccgtttaggtaacttcgttacggaacctaaaaagttacggaaaacctagtttacgtaggaaggtacggactaagggaacggaaccgtacccgggtccttttacggtaattttaacccgngggttaacgaacggtaaaacggttcccttaagttttacgaacgtaggttcgggtacttaccggg

SEQ ID NO: 231359 - DNA, 461 bp, Homo sapiens
  misc_feature: GYAE6OF02JVXZP.13.11.A11.1.454.CMB.1.raw
  modified_base (326)..(326): a, c, t, g, unknown or other
  misc_feature (326)..(326): n is a, c, g, or t
  modified_base (434)..(434): a, c, t, g, unknown or other
  misc_feature (434)..(434): n is a, c, g, or t
  modified_base (439)..(461): a, c, t, g, unknown or other
  misc_feature (439)..(461): n is a, c, g, or t
tcagtcacgtactacacgaccggtgctcgatttagctacgactgcagggccagtcagattgtcagcagcaactacttagcctggtaccagcagaagcctggccaggctcccaggctcctcatctatggtgcatccagcagggccactggcatcccagacaggttcagtggcgaggtgggtcgtgggacagacttcactctcaccatcagcagacgtggagcctagaagtattttgactacttttactttctgtactaccctaaggttacttacgggaacttggtacggtcgttggtaccaaccctagttcctcggtttaccctttntaccttaccgtttcccccggaccctaattccgttaggtaacttacggttacgtacggtacttcggtaaggccggggtatcgggacgtaaacgggccgacgtagtaggntacgnnnnnnnnnnnnnnnnnnnnnnn

SEQ ID NO: 231360 - DNA, 580 bp, Homo sapiens
  misc_feature: GYAE6OF02H3LT9.13.11.A11.1.454.CMB.1.raw
  modified_base (349)..(349): a, c, t, g, unknown or other
  misc_feature (349)..(349): n is a, c, g, or t
  modified_base (380)..(380): a, c, t, g, unknown or other
  misc_feature (380)..(380): n is a, c, g, or t
tcagtcacgtactacacgaccggtgctcgatttagctacgactgcaggggtctgggagaggagccccagccctgagattcccaggtgtttccattcagtgatcagcactgaacacagaggactcaccatggagttgggactgagctggattttcctttggctattttaaaaggtgtccagtgtgagtgcagctggtggagtcgtgggggagcttgggtacagcctggcaggtccctgagactctcctgtgcagcctcgtggacttcattctttgatgtaattatgccatgccacgtcggggtccgcaagcctaccgaggggacggccgtgggaggtggtcctcgaggtnttaggtggaataggtggtaacagtagctagnggcgatcgtaggtgagggcgtatccacatctaccaagacgacaacgaccaacgtaacctcctagtactctacgactaaactgaaactagtactacgagacggacgtaggaacgacgaccggtaccgtttggtaacttaccgtggtaacgtaacgaaacggttccttaagttaccggacgtaacggtcggtacgttcccgg

SEQ ID NO: 231361 - DNA, 392 bp, Homo sapiens
  misc_feature: GYAE6OF02GBDHZ.13.11.A11.1.454.CMB.1.raw
  modified_base (382)..(392): a, c, t, g, unknown or other
  misc_feature (382)..(392): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcacttttattctgtcaccagtatggttaggtcaccgtacacttttggccaggggaccaagctggagatcaagcgaactgtggctgcaccatctggtcttcatcttccgccatctgatagtacgtgactgagcgggctggcaaggcgacatagnnnnnnnnnnn

SEQ ID NO: 231362 - DNA, 665 bp, Homo sapiens
  misc_feature: GYAE6OF02HMFAT.13.11.A11.1.454.CMB.1.raw
  modified_base (159)..(159): a, c, t, g, unknown or other
  misc_feature (159)..(159): n is a, c, g, or t
  modified_base (202)..(202): a, c, t, g, unknown or other
  misc_feature (202)..(202): n is a, c, g, or t
  modified_base (330)..(330): a, c, t, g, unknown or other
  misc_feature (330)..(330): n is a, c, g, or t
  modified_base (360)..(360): a, c, t, g, unknown or other
  misc_feature (360)..(360): n is a, c, g, or t
  modified_base (389)..(389): a, c, t, g, unknown or other
  misc_feature (389)..(389): n is a, c, g, or t
  modified_base (406)..(406): a, c, t, g, unknown or other
  misc_feature (406)..(406): n is a, c, g, or t
tcagtcacgtactacacgaccggtgctcgatttagctacgactgcgggggtaagtagggttgtgtccaaccatggcctggacgtcctctcctcctcctgctcctctctcactgcactagttccctctcgcaggctgtgctgactcaggcctcttccctntctgccttctcctggagcgtcagccagtctcacctgcactgcncagtgcacatgtcgcctatgactattatagttcggtaaccacaagtaacgaccgaagggtacgttccctccccgtagtttcctaccgtaggaacggttcacggtaccaaacgtcaagtactaaaccgnacggtctcgaggactcccgagccgtcttcnctggactcgaagtgtgactcgacgaacgngaacggtatacgttacnctactctacgtcggctctacgtctcgacgtagtcggaagtctgtaacgttacgttacgttgtttagtacgttcggaacaaaccgtaacgtaaccgtccgttaggtaaccgtttccgttacccgggtaacgttaccgggtacccgtaaccgggtacctacccggttaccgtaagggtaccaaccggtaacccgaaaccgggtaacccctaacccggtacgttaccggtaccctaaccgttcccgttacccggttaccccc

SEQ ID NO: 231363 - DNA, 397 bp, Homo sapiens
  misc_feature: GYAE6OF02IETAC.13.11.A11.1.454.CMB.1.raw
  modified_base (181)..(181): a, c, t, g, unknown or other
  misc_feature (181)..(181): n is a, c, g, or t
  modified_base (391)..(397): a, c, t, g, unknown or other
  misc_feature (391)..(397): n is a, c, g, or t
tcagtcacgtactacacgaccggtgctcgatttagctacgactgcagggccagtcagattgtcagcagcaactacttagcctggtaccagcagaagcctggccaggccccacggctcctccatctacgatgtattcaggaggaccactgacatcccagacaggttcagtggcagtgggtcngggttttttacgaggacttcactctcaccatcagcagactggaacctgaagactttgcactttatttctgtcaccagtatggtaggttcaccgtacactttggcctagggaccaagctgagatcaagcgaactgtggctgcaccatctgtcttcatctttccgccactctgtatagtacgtgactgagcgggctggccaaggcgcatagnnnnnnn

SEQ ID NO: 231364 - DNA, 658 bp, Homo sapiens
  misc_feature: GYAE6OF02IWPUM.13.11.A11.1.454.CMB.1.raw
  modified_base (195)..(195): a, c, t, g, unknown or other
  misc_feature (195)..(195): n is a, c, g, or t
tcagtcacgtactacacgaccggtgctcgatttagctacgactgcaggggagaagagctgctcagttaggacccagagggaaccatggaaaccccagcgcagcttctcttcctctgctactctggctcccagataccaccggagaaattgtgttgacgcagtctccaggcatcgtgtcttgtctcgaggggaaangccacctctcctgcaggccagtcagattgtcagcagcaactactagcctaggtaccagcagaacgcctggaccacggccccaggctacctcactctaacgatgtactcgaggacgaccatcgacactcccagactaggtcaggtggacaggtcggtcgtagggacacggtaacttccgaacgttctacaacccgtagtaccgaacgtacgtaacggaaccttacggggaaacccttagggaaacttacgttttacggacctaactttttaggtttaccttacggtacctaaccgtagttaacgttcgggtaacggttaccctaacggttaccttaacggttttcgggaacccgtaaggggtaccctaaggtcttagggaactacgttaccgaaggaaccggtaacgttggtacgggtacctacggtacgtaaccctaggttcccgttagttccgtttagtacc

SEQ ID NO: 231365 - DNA, 621 bp, Homo sapiens
  misc_feature: GYAE6OF02JYW4D.13.11.A11.1.454.CMB.1.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgacggttcaggtacaaactcagataaacgacagggctctggacgtcccagccgcttctctggactccgaaggatcgtacgtttccgtacaacgcgagggtacttaacgttactcacttctacgtcgggtcctaccgagtcgtagaaccgtagtcggaacggtctcggtaactttattaccgttgttacgtaccgtttagggactaaacaacctaacggtccgtagggtacttccgttaccggtaccgtcggggaaccctacggtccaccgtacccgtaggtaccacggtaaccccgaacggaccccaacccgtacgtccggacctacgtcccgttacctaccccccg

SEQ ID NO: 231366 - DNA, 349 bp, Homo sapiens
  misc_feature: GYAE6OF02HPY03.13.11.A11.1.454.CMB.1.raw
  modified_base (340)..(349): a, c, t, g, unknown or other
  misc_feature (340)..(349): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctattttattctgtcacctagtatggaactgtggctgcaccatctcgtcttcattccttcccgctatctgattgtacgtgtactgaggcgggtctggcaaggcgacatagnnnnnnnnnn

SEQ ID NO: 231367 - DNA, 393 bp, Homo sapiens
  misc_feature: GYAE6OF02I0IRK.13.11.A11.1.454.CMB.1.raw
  modified_base (377)..(378): a, c, t, g, unknown or other
  misc_feature (377)..(378): n is a, c, g, or t
  modified_base (380)..(393): a, c, t, g, unknown or other
  misc_feature (380)..(393): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttatttctgtcaccagtatggtaggtcaccgtacacttttggccagggaccaagctggagatcaagcgaactgtggctgcaccatctgtcttcatcttcccgcatctgatagtacgtgactgagcggctggcaaggcgcatagnngnnnnnnnnnnnnnn

SEQ ID NO: 231368 - DNA, 391 bp, Homo sapiens
  misc_feature: GYAE6OF02F6RCB.13.11.A11.1.454.CMB.1.raw
  modified_base (381)..(391): a, c, t, g, unknown or other
  misc_feature (381)..(391): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttatttctgtcaccagtatggtaggtcaccgtacacttttggccaggggaccaagctggagatcaagcgaactgtggctgcaccatctgtcttcatcttcccgccatctgatagtacgtgactgagcgggctggcaaggcgcatagnnnnnnnnnnn

SEQ ID NO: 231369 - DNA, 765 bp, Homo sapiens
  misc_feature: GYAE6OF02IPIIM.13.11.A11.1.454.CMB.1.raw
tcagtcacgtactacacgaccggtgctcgatttagctacgactgcgggggtaagaggttgtgtcaccatggcctggactcctctcctcctcctgctcctctctcactgcacaggttccctctcgcaggctgtgctgactcagccgtcttccctctctgcttctcctggagtcgtcagcccagttcctcaccctgcctaccttggccgcagtggccacctaagttcgtttggtcccctaatggaccattagtattggtacccgaacagaacgccacgggacgtccgttccccgacgtttccgtcctagtgggttccaaggttacctaaactcgaacgaacttaaaccggactacgggtacctccgtcggtaacgttccccccgagtccccggtctttcctaccgttcggtaactcccgtaaaggggacttcggaacttttacccggcccgtaaaccgtccgaaggggttacttaacgttaccgttactagttctcggtcggtacctccgtaacggttctacggaccgtagtcggaacgttacgtacgttaactttgtttaacttggtttacgtaacgttcggtaacaacgtaacccgtaaccaccggttacggtaacgtttccggttacccggttaaacccggccgggttaacccgaacccggttccgtaaccggttcccgtaacggttacccgacggtaaccccgtaacggacccgtaaaccccctcgtccgttaccgtacccgttaccgttcccgttcccccgg

SEQ ID NO: 231370 - DNA, 386 bp, Homo sapiens
  misc_feature: GYAE6OF02FJCM2.13.11.A11.1.454.CMB.1.raw
  modified_base (379)..(386): a, c, t, g, unknown or other
  misc_feature (379)..(386): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttatttctgtcaccagtatggtaggtcaccgtacacttttggccaggggaccaagctggagatcaagcgaactgtggctgcaccatctgtcttcatcttccgcactctgatagtacgtgactgagcgggctggcaggcgcatagnnnnnnnn

SEQ ID NO: 231371 - DNA, 425 bp, Homo sapiens
  misc_feature: GYAE6OF02G7WN0.13.11.A11.1.454.CMB.1.raw
  modified_base (188)..(188): a, c, t, g, unknown or other
  misc_feature (188)..(188): n is a, c, g, or t
  modified_base (243)..(243): a, c, t, g, unknown or other
  misc_feature (243)..(243): n is a, c, g, or t
  modified_base (355)..(355): a, c, t, g, unknown or other
  misc_feature (355)..(355): n is a, c, g, or t
  modified_base (381)..(381): a, c, t, g, unknown or other
  misc_feature (381)..(381): n is a, c, g, or t
  modified_base (383)..(384): a, c, t, g, unknown or other
  misc_feature (383)..(384): n is a, c, g, or t
  modified_base (386)..(388): a, c, t, g, unknown or other
  misc_feature (386)..(388): n is a, c, g, or t
  modified_base (391)..(425): a, c, t, g, unknown or other
  misc_feature (391)..(425): n is a, c, g, or t
tcagtcacgtactacacgaccggtgctcgatttagctacgactgcagggccgaggtcagattgtcagcagcaactacttagcctggtaccagcagaagcctggccaggcccccaggctcctcatctacgatgtattcaggagggccactgacatcccagacaggttcagtggcagtgggtctgggacngacttcactctcaccatcagcagactggaacctgaagctttgctacttttattcngtcaccagtatggtagtcacggtacacttttggccaggggaccaagcgtggagatcgaagcgaactgtggctgcaccatctgtcttcatccttccgccatctgatgtacgtnactgagcggctggcaaggcgcatagntnntnnngcnnnnnnnnnnnnnnnnnnnnnnnnnnnnnnnnnnn

SEQ ID NO: 231372 - DNA, 390 bp, Homo sapiens
  misc_feature: GYAE6OF02HHEW8.13.11.A11.1.454.CMB.1.raw
  modified_base (381)..(390): a, c, t, g, unknown or other
  misc_feature (381)..(390): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagctttgcactttatttctgtcaccagtatggtaggtcaccgtacacttttggccaggggaccaagctggagatcaagcgaactgtggctgcaccatctgtcttcatccttcccgccatctgatagtacgtgactgagcgggctggcaagggcgcatagnnnnnnnnnn

SEQ ID NO: 231373 - DNA, 392 bp, Homo sapiens
  misc_feature: GYAE6OF02HGXV8.13.11.A11.1.454.CMB.1.raw
  modified_base (379)..(379): a, c, t, g, unknown or other
  misc_feature (379)..(379): n is a, c, g, or t
  modified_base (384)..(392): a, c, t, g, unknown or other
  misc_feature (384)..(392): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctacttttatttctgtcaccagtatggtaggtcaccgtacacttttggccaggggaccaagctggagatcaagcgaactgtggctgcaccatctagtcttcatccttcccgccatctgatagtacgtgactgagcgggctggcgaggcgnatagnnnnnnnnn

SEQ ID NO: 231374 - DNA, 400 bp, Homo sapiens
  misc_feature: GYAE6OF02JIBQR.13.11.A11.1.454.CMB.1.raw
  modified_base (242)..(242): a, c, t, g, unknown or other
  misc_feature (242)..(242): n is a, c, g, or t
  modified_base (306)..(306): a, c, t, g, unknown or other
  misc_feature (306)..(306): n is a, c, g, or t
  modified_base (352)..(352): a, c, t, g, unknown or other
  misc_feature (352)..(352): n is a, c, g, or t
  modified_base (383)..(400): a, c, t, g, unknown or other
  misc_feature (383)..(400): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcaggtgggtctgggacagacttcactctcaccatcagcagactggaacctgaaagctttgcacttttattcngtcaccagtatggtaggtcacgtacactttggccaggggccaagctggagatcaagcgaactgnggctgcaccgatctgtctcatccttccgctatctgatacgtacgtnacgtgagcgggctggctaaggcgcgatacgnnnnnnnnnnnnnnnnnn

SEQ ID NO: 231375 - DNA, 393 bp, Homo sapiens
  misc_feature: GYAE6OF02HIRRQ.13.11.A11.1.454.CMB.1.raw
  modified_base (223)..(223): a, c, t, g, unknown or other
  misc_feature (223)..(223): n is a, c, g, or t
  modified_base (241)..(241): a, c, t, g, unknown or other
  misc_feature (241)..(241): n is a, c, g, or t
  modified_base (320)..(320): a, c, t, g, unknown or other
  misc_feature (320)..(320): n is a, c, g, or t
  modified_base (359)..(359): a, c, t, g, unknown or other
  misc_feature (359)..(359): n is a, c, g, or t
  modified_base (378)..(393): a, c, t, g, unknown or other
  misc_feature (378)..(393): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaanactttgctattttattcngtcaccagtatggtagtcaccgtacacttttggccaggggaccaagctggagatcaagcgaactgtggctgcaccatcngttctcatcctccgcatctgatagtactgactgagcggntcggcaaggtcgacatagnnnnnnnnnnnnnnnn

SEQ ID NO: 231376 - DNA, 384 bp, Homo sapiens
  misc_feature: GYAE6OF02I4D1T.13.11.A11.1.454.CMB.1.raw
  modified_base (377)..(384): a, c, t, g, unknown or other
  misc_feature (377)..(384): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttatttctgtcaccagtatggtagtcaccgtacactttggccaggggaccaagctggagatcaagcgaactgtggctgcacatctgtcttcatcttcccgccatctgatagtacgtgactgacgcgggctggcaaggcgcatgnnnnnnnn

SEQ ID NO: 231377 - DNA, 402 bp, Homo sapiens
  misc_feature: GYAE6OF02G81BJ.13.11.A11.1.454.CMB.1.raw
  modified_base (389)..(402): a, c, t, g, unknown or other
  misc_feature (389)..(402): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagtctttgctacttttattctgtcaccagtatggtaggtcaccgtactacttttggccaggggaccaagcgtggagatcaagcgaactgtgctgcacatctgtcttcatctcccgcatctgtatagtacgtgactgacgtcgggctggacgaagggcgacagtacggnnnnnnnnnnnnnn

SEQ ID NO: 231378 - DNA, 400 bp, Homo sapiens
  misc_feature: GYAE6OF02HQCIJ.13.11.A11.1.454.CMB.1.raw
  modified_base (388)..(388): a, c, t, g, unknown or other
  misc_feature (388)..(388): n is a, c, g, or t
  modified_base (393)..(400): a, c, t, g, unknown or other
  misc_feature (393)..(400): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaacctgaagacttttgcctacttttatttctgttcacccagttatggtaggtcaccgttacactttttggccaggggacccaagcttggagatcaagcgaactgtggctgcaccatctgtcttcatctttccgccattctgatagtacgtgactgagcgggctggcaaggcgnatagnnnnnnnn

SEQ ID NO: 231379 - DNA, 402 bp, Homo sapiens
  misc_feature: GYAE6OF02IBKNU.13.11.A11.1.454.CMB.1.raw
  modified_base (389)..(402): a, c, t, g, unknown or other
  misc_feature (389)..(402): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatccccagacaggttcagtggcaggtgggtctgggacagacttcactctcaccatcagcagactggaacctgaagcttttgctacttttattctgtcaccagtatggtaggtcaccgtactacttttggccaggggaccaagctggagatcaagcgaactgtggctgcaccatctgtcttcacttctcccgcatctgatacgtacgtgtactggagcgggctggcaagggcacatagcnnnnnnnnnnnnnn

SEQ ID NO: 231380 - DNA, 464 bp, Homo sapiens
  misc_feature: GYAE6OF02H8A4D.13.11.A11.1.454.CMB.1.raw
  modified_base (237)..(237): a, c, t, g, unknown or other
  misc_feature (237)..(237): n is a, c, g, or t
  modified_base (437)..(464): a, c, t, g, unknown or other
  misc_feature (437)..(464): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagcctttgctactttnttctgtcaccagtatggtagtcaccgttacacttttggcctagggaccaagctggagatcaagcgtaacgtgtcggctagcgacctagtccttcgtcttccattaccctttccccgtcccaacgttcctacgtacttaaggttccgtgtaacctggacggccgggccgttggaccgtaaaggcgtaccgagttcgagcannnnnnnnnnnnnnnnnnnnnnnnnnnn

SEQ ID NO: 231381 - DNA, 426 bp, Homo sapiens
  misc_feature: GYAE6OF02IE3YA.13.11.A11.1.454.CMB.1.raw
  modified_base (412)..(426): a, c, t, g, unknown or other
  misc_feature (412)..(426): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggacccactgacatcccagacaggttcagtggcaggtgggtctgggacagacttcactctcaccatccagcagactggaacctgaagactttgctacttttatttctgtcaccagtatggtaggtcaccgtacacgttttggccaggggaccaagctggagatcaagcgaactgtgctgcaccatctgtcttacacttcttccccgctatcttgaattcgtaacgtgtacgttgacggtccgggcgtacgggcgaacgggcgacgtataggnnnnnnnnnnnnnnn

SEQ ID NO: 231382 - DNA, 720 bp, Homo sapiens
  misc_feature: GYAE6OF02JYQVJ.13.11.A11.1.454.CMB.1.raw
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
tcagtcacgtactacacgaccggtgctcgatttagctacgactgcaggggagaagaggctgctcagttaggacccagagggaaccatggaaaccccagcgcagcttctcttcctcctgctactctggctcccagactaccgaccggagaaattgtgttgacgcagtctccaggcatcgtgtcttgctcgagggaancgccaccgtntcctgcgacgggccaggtccagtattgtcagcagtacctaaactacttagccttaggtaccagactagaacgtccgtaggaccgaccggccccaggtcctccgtaccacttcccgtaacgtacttacgtacttcgaacggtacggaccactacggaactacgtcccagtacgtaggtttacgaggttacggcgtaacgggtccgggtacgttacggggaactacggtaccgttacgaccttccgtacccaaccgtagtaccgacgacgacgtacgtacgaaccgtagtaaacgttcgttagtacttacgtttacgtttactacgttacctaacgttagtacgttacgggttaaccgtacgttaacccgttacgtttacgttaccgggtaacggtaccgggtaaccgtaacggtccggttaaggaacgtcgttaaccgacgggtacgttaaccgtagggttccgtacgttccggtaccaacgttcgttaccggttacgttacccgtacttacccg

SEQ ID NO: 231383 - DNA, 620 bp, Homo sapiens
  misc_feature: GYAE6OF02HIW7Q.13.11.A11.1.454.CMB.1.raw
tcagtcacgtactacacgaccggtgctcgatttagctacgactgcaggggtctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggagcttggtacagcctggcaggtccctgagactctcctgtgcagcctctggattcattctttgatgattatgccatgcacgtcgggtccgcaacgcctaccggaggggaacgggcctagggacggttggggtcctacgtaggttatttagggttaggaaattaggtaggtaaacagttacggtactagtggaccggtactcgttgggtacggaacggggtccgtagtttccgaacctagttccgtaccgaaggaacgaaccaaccgaccaaacgaaccctcccgtagtactctacgaacaaagtacgaactagtactagagtagcgtaggacgacgaccggtcctttagtaacttacgtaggtacgaacgtaaacggttcctaagttacgacgtaggtcggtcgttccgg

SEQ ID NO: 231384 - DNA, 385 bp, Homo sapiens
  misc_feature: GYAE6OF02FOGIN.13.11.A11.1.454.CMB.1.raw
  modified_base (379)..(385): a, c, t, g, unknown or other
  misc_feature (379)..(385): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcacttttattctgtcaccagtatggtaggtcaccgtacacttttggccaggggaccaagctggagatcaagcgaactgtggctgcacatctgtcttcatcttccagccatctgatagtacgtgactgagcgggctggcaaggcgcatagnnnnnnn

SEQ ID NO: 231385 - DNA, 420 bp, Homo sapiens
  misc_feature: GYAE6OF02G8UPP.13.11.A11.1.454.CMB.1.raw
  modified_base (301)..(301): a, c, t, g, unknown or other
  misc_feature (301)..(301): n is a, c, g, or t
  modified_base (360)..(360): a, c, t, g, unknown or other
  misc_feature (360)..(360): n is a, c, g, or t
  modified_base (385)..(385): a, c, t, g, unknown or other
  misc_feature (385)..(385): n is a, c, g, or t
  modified_base (391)..(391): a, c, t, g, unknown or other
  misc_feature (391)..(391): n is a, c, g, or t
  modified_base (397)..(420): a, c, t, g, unknown or other
  misc_feature (397)..(420): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcaggtgggtctgggacagaccttcactctcaccatcagcagactggaacctgaaagtctttgcctacttttattctcgtcacctagtatggtaggtcaccgtacacttttgccgagggaccaagcctgganatcagcgaactgtggctgcacatctgtcttcactcttcccgccatctgactagtacgtnacttgagcgggctggctaacgggcncatagngtcagnnnnnnnnnnnnnnnnnnnnnnnn

SEQ ID NO: 231386 - DNA, 595 bp, Homo sapiens
  misc_feature: GYAE6OF02GWLOC.13.11.A11.1.454.CMB.1.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtccctccccagtttctcctgaggttcaggtcaaactcagataaacgacagggctctggactccccagccgcttctctggactaccgaaggatgacttccgaccaacgcgaagggatattactcatctcgtgggcctccgagtctgacgagtggacggctgacttatttacttgtttgtacgtttcggactaaccgaacgaccgtcgtaggtaacttccgtttaccggaccgttacgggacccgtacgggtccgacccgttaccgtacggtaccgaacggcccgtaaccggaccccaaccccgtacgtccgtacctacccgttccgtaccgttccccccg

SEQ ID NO: 231387 - DNA, 386 bp, Homo sapiens
  misc_feature: GYAE6OF02IVLJ1.13.11.A11.1.454.CMB.1.raw
  modified_base (370)..(370): a, c, t, g, unknown or other
  misc_feature (370)..(370): n is a, c, g, or t
  modified_base (376)..(377): a, c, t, g, unknown or other
  misc_feature (376)..(377): n is a, c, g, or t
  modified_base (379)..(386): a, c, t, g, unknown or other
  misc_feature (379)..(386): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctacttttattctgtcaccagtatggtaggtcacgtacactttggccaggggaccaagctggagatcaagcgaatggtgctgcacatctgtcttcactcttcccgctatctgatagtactgactgagcggctggcaaggcnagtagnngnnnnnnnn

SEQ ID NO: 231388 - DNA, 426 bp, Homo sapiens
  misc_feature: GYAE6OF02FI444.13.11.A11.1.454.CMB.1.raw
  modified_base (242)..(242): a, c, t, g, unknown or other
  misc_feature (242)..(242): n is a, c, g, or t
  modified_base (383)..(383): a, c, t, g, unknown or other
  misc_feature (383)..(383): n is a, c, g, or t
  modified_base (388)..(388): a, c, t, g, unknown or other
  misc_feature (388)..(388): n is a, c, g, or t
  modified_base (390)..(391): a, c, t, g, unknown or other
  misc_feature (390)..(391): n is a, c, g, or t
  modified_base (393)..(394): a, c, t, g, unknown or other
  misc_feature (393)..(394): n is a, c, g, or t
  modified_base (396)..(396): a, c, t, g, unknown or other
  misc_feature (396)..(396): n is a, c, g, or t
  modified_base (399)..(426): a, c, t, g, unknown or other
  misc_feature (399)..(426): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatccaagacaggttcagtggcagtgggtctgggacagacttcactctcaccatcagcagctggaaccctgaagactttgctacttttattcngtcaccagtatggtaggtcaccgtacacttttggccaggggaccaagctggagatcaagcgaactgtggctgcaccgatctgttcttcatcttcccgcctatctgactagtacgtgtactgagcgggtctggcaaggccgnatagntnnanntnacnnnnnnnnnnnnnnnnnnnnnnnnnnnn

SEQ ID NO: 231389 - DNA, 392 bp, Homo sapiens
  misc_feature: GYAE6OF02FXNHI.13.11.A11.1.454.CMB.1.raw
  modified_base (384)..(392): a, c, t, g, unknown or other
  misc_feature (384)..(392): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaatctgaagacttttgctacttttatttctgtcaccagtatggtaggtcaccgtacactttttggccaggggtccaagctggagatcaagcgaactgtggctgcaccatctgtcttcatcttcccgccatctgatagtacgtgactgagcgggctggcaaggcgcatgnnnnnnnnn

SEQ ID NO: 231390 - DNA, 630 bp, Homo sapiens
  misc_feature: GYAE6OF02GGIVU.13.11.A11.1.454.CMB.1.raw
  modified_base (351)..(351): a, c, t, g, unknown or other
  misc_feature (351)..(351): n is a, c, g, or t
  modified_base (363)..(363): a, c, t, g, unknown or other
  misc_feature (363)..(363): n is a, c, g, or t
  modified_base (378)..(378): a, c, t, g, unknown or other
  misc_feature (378)..(378): n is a, c, g, or t
tcagtcacgtactacacgaccggtgctcgatttagctacgactgcgggggtaagaggttgtgtccaccatggcctggactcctctcctccgtcctgctcctcctctcactgcacaggttccctctcgcaggctgtgctgactcagccgtcttccccctctgcttctcctggagcgtcagcccagtctcacctgctaccttgcgcagtggcaccaatgttggtccctatgacatatattcggtaccgacagaagccagggagtccctccccagtttcctcctgacggttacaggtcctaaactcaagaactaaaacgaccgtagggcctcgtggacgtccccagccgcttcnctgactcaggangactccgaccgacgngaggatagtactcatctcgtggcctcagtctagaccgtagtgacgtctacgtaacttactttacgttagtttacggtacttcggacctaaacgaacctaccgtcgtaggtccgttaccggttaccgacccgtacggtacccgaccggttcccgtacccgttaccgtacggtcctaacccggacccgtaaccggacccctaaaccccgacttcccggtacctacccgttccgttacccgttccccctaccccg

SEQ ID NO: 231391 - DNA, 497 bp, Homo sapiens
  misc_feature: GYAE6OF02FFZBQ.13.11.A11.1.454.CMB.1.raw
  modified_base (480)..(480): a, c, t, g, unknown or other
  misc_feature (480)..(480): n is a, c, g, or t
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcacttgcgcagtggcaccaatgttggtccctatgacatatattggtaccgacagaagccagggagtcctccccagtttctcctgaggttcaggtcaaactcagataaacgacagggctctggagtccccagccgcttctctggactccaaggatgacttccgccaacgcagggatacttactcatctctgggctcagtctgacgatgaggctgactattactgttgattggcacaacacgctggatctcgactggaccacggtcaccgctaggtcagcccaagccacccntcgcactctcgtccccg

SEQ ID NO: 231392 - DNA, 785 bp, Homo sapiens
  misc_feature: GYAE6OF02J0MMD.13.11.A11.1.454.CMB.1.raw
tcagtcacgtactacacgaccggtgctcgatttagctacgactgcgggggtaagaggttgtgtccaccatggcctggactcctctcctccgtcctgctcctctctcactgcacaggttccctctcgcaggctgtgctgactcagccgtcttccctctctgcttctcctggagcgtcagcctagtctcacctcgcaccttgcgcagtggcaccatgttggtccctatgacattatagttggtaccgacgagaagccgaaggggacgttccctacccctggtttcctcctaggtacggtttcgaggtaccaaacgtcaaggaataaacgacggtaagggtcttccgtaggaccgttccccgacggccgtaccttcgacggttacgacgtaccgaaggtactcggtaacctttccccggacctaaacggcgtaagggtaacttacgttaacctcaacttccgtacggtccgggaacctttccgtaacgttcggtaacgtaggtaacgttcggaacggtacgtaggttaacctttacggttaacgttacggtttacgttagttaccgggtaaccaaaccggtaaacccgaacggttacccgttagggaaccgttttaccggtaccggttaaacccggttacgggaccgtttaaacccggttccgaacccgggtttaccggtaaccggttaacccggaacggtaccccggttaacccggggacccccctaacccccggttaagtacccggttaacctaacccgggttccgtttaacccccggttccccgg

SEQ ID NO: 231393 - DNA, 551 bp, Homo sapiens
  misc_feature: GYAE6OF02FHCHG.13.11.A11.1.454.CMB.1.raw
  modified_base (429)..(429): a, c, t, g, unknown or other
  misc_feature (429)..(429): n is a, c, g, or t
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtcccctatgacatatattggtacccgacagaagccaggggagttcctccccagtttctcctgaggttcaggtcaaactcagataaacgacagggctctggacgtccccagccgcttctctggactaccaagggactgatttcccgaccaacggcaggggatattactcatctcgtgggctccagtctgacgatgagctgactattactgttnacttggctacaacacgctggacttcgtacggacctgggaccctacggtccaccgtccgtacggtccacggtccccaacggcccaaccccgtactcgtacccaccttccgtcgttaccccccg

SEQ ID NO: 231394 - DNA, 389 bp, Homo sapiens
  misc_feature: GYAE6OF02GB5I0.13.11.A11.1.454.CMB.1.raw
  modified_base (381)..(381): a, c, t, g, unknown or other
  misc_feature (381)..(381): n is a, c, g, or t
  modified_base (385)..(389): a, c, t, g, unknown or other
  misc_feature (385)..(389): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctacttttatttctgtcaccagtatggtaggtcaccgtacacttttggccaggggaccaagctggagatacgaaacgaactgtggctgcaccatctgtcttcatcttcccgcatctgatagtacgtgactgagcgggctggcgaaggcgacntagnnnnn

SEQ ID NO: 231395 - DNA, 628 bp, Homo sapiens
  misc_feature: GYAE6OF02IPNU9.13.11.A11.1.454.CMB.1.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgtgcagtggcaccaatgttggtccctatgacatatattggtaccgacagaagccagggacgtccctccccagtttctcctgaggttcaggtcaaactcagaataaacgacgagggctcgtggacgtccccgagccgtcttcctcgtggactaccaaggatgacgttcccgacctaacgacgaagggataacttacgtcattcctcgtcgggtcctccgagtctaggaccgagtggaacggtcttaggtaacttatttacgttgttttacgactttcgggactaaccgtaaacgaaccgtccgttaggtacttaccgttccggaccgtacgggacccgtaccggtccgacccgtccggttacggtacccacggtcccgaaccggccccaaaccccgtcgtccgtacctaccgttccgttcccgttaccccccg

SEQ ID NO: 231396 - DNA, 405 bp, Homo sapiens
  misc_feature: GYAE6OF02I4RX2.13.11.A11.1.454.CMB.1.raw
  modified_base (392)..(393): a, c, t, g, unknown or other
  misc_feature (392)..(393): n is a, c, g, or t
  modified_base (395)..(405): a, c, t, g, unknown or other
  misc_feature (395)..(405): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaacctgaagtactttgctactttatttctgtcaccagtatggtaggtcaccgtacacgtttggccgagggaccaagctggagatcgaagcgaacgtgtggctcgcaccatctgtcttcactccttcccgcctatctgtatagtacgtgactggagcgggctggacaggcgacatagnngnnnnnnnnnnn

SEQ ID NO: 231397 - DNA, 396 bp, Homo sapiens
  misc_feature: GYAE6OF02GV4LU.13.11.A11.1.454.CMB.1.raw
  modified_base (378)..(378): a, c, t, g, unknown or other
  misc_feature (378)..(378): n is a, c, g, or t
  modified_base (386)..(396): a, c, t, g, unknown or other
  misc_feature (386)..(396): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttatttctgtcaccagtatggtagtcaccgtacacttttgccagggaccaagctggagatcaagcgaactgtaggctgcaccatctgtcttcatcttcccgcatctgatagtacgtcactcgagcgggtctgggcctaagggcncgatagcnnnnnnnnnnn

SEQ ID NO: 231398 - DNA, 446 bp, Homo sapiens
  misc_feature: GYAE6OF02HKYZA.13.11.A11.1.454.CMB.1.raw
  modified_base (424)..(446): a, c, t, g, unknown or other
  misc_feature (424)..(446): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggagaccactgacatcccagacaggttcagtggcagtgggtctgggacagacttcactctcaccatcagcagcctgcaggctagaagagtgtggactagttttattactgtcagcaaattattatagtactcctcgaggctcactttcggcggacggaccaaggtggaacgattcaaaacgaacgtgtggctagacgaacctattctgtcttcaacttccttcccgccactttctgtaattagtacgttagactgaaggcggtcgtcggacaagggccgacagtaagnnnnnnnnnnnnnnnnnnnnnnn

SEQ ID NO: 231399 - DNA, 551 bp, Homo sapiens
  misc_feature: GYAE6OF02H4P2Q.13.11.A11.1.454.CMB.1.raw
  modified_base (222)..(222): a, c, t, g, unknown or other
  misc_feature (222)..(222): n is a, c, g, or t
  modified_base (241)..(241): a, c, t, g, unknown or other
  misc_feature (241)..(241): n is a, c, g, or t
  modified_base (483)..(483): a, c, t, g, unknown or other
  misc_feature (483)..(483): n is a, c, g, or t
  modified_base (485)..(485): a, c, t, g, unknown or other
  misc_feature (485)..(485): n is a, c, g, or t
  modified_base (487)..(511): a, c, t, g, unknown or other
  misc_feature (487)..(511): n is a, c, g, or t
  modified_base (541)..(551): a, c, t, g, unknown or other
  misc_feature (541)..(551): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggacctgaanactttgctattttatttcngttcacctagtatggtagtcaccgtactacttttgccgtaggggaccaaggcttaggacgagtacaagcgaacgtggtggtcgtgactaccattctcggtttcttaccgtactttccgttaccccgacctactttaccgtacgtaaacgtttacggttaacgttacggtaccgttaacggcgggtaccggggtacgtacggggtaccgaaaaccgggccgtaacgtaagttaggacagacgnancnnnnnnnnnnnnnnnnnnnnnnnnngggggggggggggggggggggggggggggnnnnnnnnnnn

SEQ ID NO: 231400 - DNA, 452 bp, Homo sapiens
  misc_feature: GYAE6OF02HZUAD.13.11.A11.1.454.CMB.1.raw
  modified_base (241)..(241): a, c, t, g, unknown or other
  misc_feature (241)..(241): n is a, c, g, or t
  modified_base (248)..(248): a, c, t, g, unknown or other
  misc_feature (248)..(248): n is a, c, g, or t
  modified_base (322)..(322): a, c, t, g, unknown or other
  misc_feature (322)..(322): n is a, c, g, or t
  modified_base (364)..(364): a, c, t, g, unknown or other
  misc_feature (364)..(364): n is a, c, g, or t
  modified_base (400)..(400): a, c, t, g, unknown or other
  misc_feature (400)..(400): n is a, c, g, or t
  modified_base (404)..(404): a, c, t, g, unknown or other
  misc_feature (404)..(404): n is a, c, g, or t
  modified_base (416)..(417): a, c, t, g, unknown or other
  misc_feature (416)..(417): n is a, c, g, or t
  modified_base (421)..(421): a, c, t, g, unknown or other
  misc_feature (421)..(421): n is a, c, g, or t
  modified_base (423)..(430): a, c, t, g, unknown or other
  misc_feature (423)..(430): n is a, c, g, or t
  modified_base (432)..(452): a, c, t, g, unknown or other
  misc_feature (432)..(452): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggagaccactgacatcccagacaggttcagtggcagtgggtctgggacagacttcactctcaccatcagcagactggaacctgaagtactttgcattttattcngtcaccngtatggtaggtcaccgtacacttttgccagggaccaagctggagatcaagcactgtgctgcacatctgtcttcncttcctcccgctactctcgtaatcgttacgtcgtactacggnggccgggtctcgggacgaaggtccgactagtagtcngtcngactgatgacgnngacngnnnnnnnncnnnnnnnnnnnnnnnnnnnnn

SEQ ID NO: 231401 - DNA, 394 bp, Homo sapiens
  misc_feature: GYAE6OF02FOR28.13.11.A11.1.454.CMB.1.raw
  modified_base (386)..(394): a, c, t, g, unknown or other
  misc_feature (386)..(394): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagcctcgagcctgaagtattttgcagcttattactgtcagcagcgtagcaactggcctccggccctttcggcggagggaccaagggtggagatcaaacgactgtggctgcaccatctgtctcatccttccgccatctgatacgtacgtgactgaggcggcgtggacaggcgcagtagnnnnnnnnn

SEQ ID NO: 231402 - DNA, 377 bp, Homo sapiens
  misc_feature: GYAE6OF02GANJV.13.11.A11.1.454.CMB.1.raw
  modified_base (361)..(361): a, c, t, g, unknown or other
  misc_feature (361)..(361): n is a, c, g, or t
  modified_base (369)..(369): a, c, t, g, unknown or other
  misc_feature (369)..(369): n is a, c, g, or t
  modified_base (373)..(377): a, c, t, g, unknown or other
  misc_feature (373)..(377): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctacttttattctgtcaccagtatggtaggtcaccgtacacttttggccagggaccaagctggagatcaagcgaactgtggctgcacatctgtcttcatcttcccgcatctgatagtacgtgactgagcggntggcagcnatgnnnnn

SEQ ID NO: 231403 - DNA, 399 bp, Homo sapiens
  misc_feature: GYAE6OF02IGLSQ.13.11.A11.1.454.CMB.1.raw
  modified_base (383)..(399): a, c, t, g, unknown or other
  misc_feature (383)..(399): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaacctgaatactttgctattttattctgtcaccagtatggtaggtcaccgtactacttttggccaggggaccaagctggagatcgaagcaactggtgctgcacctatctgtcttcactctcccgcatctgactagtactgacgagcgggctaggcgaggcgcatacgnnnnnnnnnnnnnnnnn

SEQ ID NO: 231404 - DNA, 756 bp, Homo sapiens
  misc_feature: GYAE6OF02H9ZO2.13.11.A11.1.454.CMB.1.raw
  modified_base (156)..(156): a, c, t, g, unknown or other
  misc_feature (156)..(156): n is a, c, g, or t
  modified_base (264)..(264): a, c, t, g, unknown or other
  misc_feature (264)..(264): n is a, c, g, or t
  modified_base (665)..(665): a, c, t, g, unknown or other
  misc_feature (665)..(665): n is a, c, g, or t
tcagtcacgtactacacgaccggtgctcgatttagctacgactgcggggtaaggtaggttgtcgtccgaccatggcctggactcctctccgtcctcctgctcctctcgtcacgtcgcacgtacggttcctctcgcacggcttgtcgctagtactcncgtcctccttcctctcctgtcttcttccgaggacgcgtcacgcctatctcgactcgccgaccgttgccggactagtcgaactaccgaagttggttcgaccttagcaanatagtagttcggaccaagagaacgcggaaggtacgtaaccctccgtaacggttctacgtacggtcggttacgacggttacaaacgtctaaacggaacgtaaaacgtacggaacggtcttacgaccgggtacgtacccgaaggtcccgtaccttcgtcgtacggaacctaccgtaaacggacggtagtacccgttaccaacccgtaaaggcccgaaaaggttactaacgtttaccacaaccgtttcgtaacgcggtactaccgatacgtaagtaaccgtatacggcggtacgtacgtaacgttacgttacttacggttactacgtagtacgaaccgtaacgacgtacccgtagacgtttccgtacggacgttaaccggccgtaaccgtacgtaccggtttancccggtaacccggtcttaaaccccggaaaccctacccgtaaaccgttccggttacctaccgttaacccgtttcgaccccgtttaaccccgg

SEQ ID NO: 231405 - DNA, 629 bp, Homo sapiens
  misc_feature: GYAE6OF02GAW1F.13.11.A11.1.454.CMB.1.raw
tcagtcacgtactacacgaccggtgctcgatttagctacgactgcaggggtctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtggggggaggcttggtacagcctggcaggtccctgagactctcctgtgcagcctctggattcatctttgatgattatgccatgcacgtgggtccggcaagcctcgaggggaagggcctggaggtgggtctcgaggttattaggttggaatacggtaggtaaacagtaggcttagtggccggtactcgtggttaggaagggccgtacttcaccgtatcctaccaggtacgaaccaacgaccaaacgtaacctcccgtagtactcgtagactaaagtacgaaccgtacgtctaaggaagtaacggctaggaacgggtaccgtaccgggtccctttaaggttaacgtttaacgttcggttaacggaaccgttaaaaccggttaccgttaatttacgggaccttaagggtccgggtacgttacccggg

SEQ ID NO: 231406 - DNA, 648 bp, Homo sapiens
  misc_feature: GYAE6OF02FIN1D.13.11.A11.1.454.CMB.1.raw
  modified_base (238)..(238): a, c, t, g, unknown or other
  misc_feature (238)..(238): n is a, c, g, or t
  modified_base (279)..(279): a, c, t, g, unknown or other
  misc_feature (279)..(279): n is a, c, g, or t
tcagtcacgtactacacgaccggtgctcgattagctacgactgcaggggtctgggagaggagccccagccctgagattcccaggtgtttccattcagtgatcagcactgaacacagaggactcaccatggagttgggactgagctggatttcctttggctattttaaaaggtgtccagtgtgaagtgcagctggtggagtctgggggagcttgggtacaggcctggcaggtcccctgngactctcctgtgcagcctctggattcatctttgatgattangccatgcactgggtccggcaacgcgtccgagggacggtcctagggacgtgggtctcgaggtatttaggtgggaataggtggtaacagtaggacttaagtcggaccggtacctcgtagtacggaacggggtccgacgttccaacctacgtcctaccaggaacgaccaaccggccctaaaaggaacccttcccgtagtactaccgtacgaactaaatacgtaaactacgtacgttaggaacgacgtacggtcgaacgggtaccgtaccgggtaccttacgggtttaacgtttaccgtggttaaccggtaaccgtaaaaacggttccgttaaaggtttaccgacgtaacgggttacggcccgtttacccggg

SEQ ID NO: 231407 - DNA, 634 bp, Homo sapiens
  misc_feature: GYAE6OF02HDNZS.13.11.A11.1.454.CMB.1.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgtgtccctatgacatatattggtaccacagaagccagggacgtcctccccagtttctcctgaggttcaggtcaaactcagataaacgacgagggctcgtggactccccagccgcttcctctggactccaaggatgatttccgaccaacgcgagggatattactctatctcgtgggtcctcacgtctagacgtatggacgcgtagaacttatttacgttgtttcgtacgttaggcctaaacgaacctacggtcccttaggtaacgttccgtttaccgggacccgttacgggggaaccctaccgggttacccgtaccccggttacccgttaaccgggtccgaaccggtaccccgaaccgggtaacccccaacccccgtaccgttaccgtaccctaaccgttcccgttaccggtttacccccccc

SEQ ID NO: 231408 - DNA, 394 bp, Homo sapiens
  misc_feature: GYAE6OF02FWQ2E.13.11.A11.1.454.CMB.1.raw
  modified_base (382)..(394): a, c, t, g, unknown or other
  misc_feature (382)..(394): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttatttctgtcaccagtatggttaggtcaccgtacacttttggccagggtaccaagctggagatcaagcgaactgtggctgcaccatctgtctcatctccgcatctgatagtacgtgactgagcgggctggcgaaggtcgcgagtagnnnnnnnnnnnnn

SEQ ID NO: 231409 - DNA, 471 bp, Homo sapiens
  misc_feature: GYAE6OF02GT35Z.13.11.A11.1.454.CMB.1.raw
  modified_base (403)..(403): a, c, t, g, unknown or other
  misc_feature (403)..(403): n is a, c, g, or t
  modified_base (434)..(471): a, c, t, g, unknown or other
  misc_feature (434)..(471): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcaggtgggtctgggacagacttcactctcaccatcagcagactggaacctgaagtctttgctacttttatttctgtcaccagtatggtagtcaccgtactacgttttggccaggggtaccaagctggagtatcgaagcgaactggtggctagcgacctatctagtccttcacttccgttcccgcctacttctcgtaataacgtacgtgtaactaggtaccggcggggtacgngggtaccgaacgggccgacgtaagtagcgannnnnnnnnnnnnnnnnnnnnnnnnnnnnnnnnnnnnn

SEQ ID NO: 231410 - DNA, 608 bp, Homo sapiens
  misc_feature: GYAE6OF02GJ9O9.13.11.A11.1.454.CMB.1.raw
  modified_base (199)..(199): a, c, t, g, unknown or other
  misc_feature (199)..(199): n is a, c, g, or t
  modified_base (209)..(209): a, c, t, g, unknown or other
  misc_feature (209)..(209): n is a, c, g, or t
  modified_base (444)..(444): a, c, t, g, unknown or other
  misc_feature (444)..(444): n is a, c, g, or t
  modified_base (567)..(567): a, c, t, g, unknown or other
  misc_feature (567)..(567): n is a, c, g, or t
tcagtcacgtactacacgaccggtgctcgatttagctacgactgcaggggagaagagctgctcagttaggacccagagggaaccatggaaaccccagcgcagcttctcttcctcctgctactctggctcccagataccaccggagaaattgtgttgacgcagtctccaggcatcgtgtctttgtctccgaggggaaagngcccaccctntcctgcagggccagtcagattgcagcagcaactacttagcctggtaccagccagaacgcctggccacggcccccaggcctcctcactacgtacgatgtacttcgaagggacgacctacgtgaccactcccaagacgtaggttcaaggtcggcgaggtcgggtctagggacaggtaccttcacgttcctacacctatccgaggccaaggtactcggaacctaggaacgtacgtttnaccttacttttattcgacgttaccaccgtagttactcgggttaacgtcgtaaccgttacgttacgtttcggaccgtagggtaaccaaggtcgtaggacgtactacgaacggcgtaagttcggngtaccgtcgaccggaactatccggtacttccgttatacccg

SEQ ID NO: 231411 - DNA, 710 bp, Homo sapiens
  misc_feature: GYAE6OF02IV6C6.13.11.A11.1.454.CMB.1.raw
  modified_base (559)..(559): a, c, t, g, unknown or other
  misc_feature (559)..(559): n is a, c, g, or t
tcagtcacgtactacacgaccggtgctcgatttagctacgactgcaggggtctgggagaggagccccagccctgagattcccaggtgtttccattcagtgatcagcactgaacacagaggactcaccatggagttgggactgagctggattttcctttggctattttaaaaggtgtccagtgtgaagtgcagctggtgagtcgtgggggagcttggacagccgtggcaggtccctgagactctcctgtgcacgtcctcgtggacttcattcgtttgatagtattatgacctagtgccgtacgtcggggtacccgagtaacgtccgtaccggaaggggtaacgggtcccgtaggggtacggtggggggtaccggaccccaaaagtaagtaaaacggacgtaaagggttaggaaaacgggtagaaacggtaaaattacgtagtggtaacgggaccttcgtagggtacggaaacgggcccgtaacttccgaaccgtatcccgtaacgagtaacgaacccaacgacgtaaacgtacctacgacttacgtaactacgtaacganaaaacgttcggaaacctcggtacccgtaaggtaacggaccggaaccgagggtaacccctaggggacctttaacggtcttaaacggtttcgtagtaccggtaagtaacgggtaggtaacggggttcggggaacggttaaggttagaaccggg

SEQ ID NO: 231412 - DNA, 437 bp, Homo sapiens
  misc_feature: GYAE6OF02FQ9C3.13.11.A11.1.454.CMB.1.raw
  modified_base (304)..(304): a, c, t, g, unknown or other
  misc_feature (304)..(304): n is a, c, g, or t
  modified_base (398)..(399): a, c, t, g, unknown or other
  misc_feature (398)..(399): n is a, c, g, or t
  modified_base (401)..(405): a, c, t, g, unknown or other
  misc_feature (401)..(405): n is a, c, g, or t
  modified_base (413)..(437): a, c, t, g, unknown or other
  misc_feature (413)..(437): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctggggacagacttcactctcaccatcagcagtctgcagtctgaagattttgcagtttattactgtcagcagtataataactggcctccgtacatgtacacttttggccaggggaccaactggagntcagacgaactgtggctgcacatctgtctcatcttcccgcctatcctgtactagtacggtgactgaagcggggctggcaagggcgccagtacgnnannnnntcagcagnnnnnnnnnnnnnnnnnnnnnnnnn

SEQ ID NO: 231413 - DNA, 741 bp, Homo sapiens
  misc_feature: GYAE6OF02GDGQS.13.11.A11.1.454.CMB.1.raw
tcagtcacgtactacacgaccggtgctcgatttagctacgactgcgggggtaaggaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccatgttcggtccctatgactatatagttcggtaccgacagaagccgagggacgtccctcccctagtttcctccgtggtagttccaggtaccaactcgacgaataaacgacgacgggtctcgtcggactccccgagtccgtcttcctcgtcggacttacccgaaggtatcgtaccgttcccgaccgaacgcggaaggggtacttaacgtttacgtaccctcgtttaccgtccggttccgggaccttaccgtacggttcgtacggaaaccgtagttacggggacggtccgttaacggtaactttaggtttaacccggtttgtttaccggttacgttagggtaccaaccggtaaacgtaacccggtcgttaacggtacttaccggttccgggtaccggtacggacccgtacgggtaccctaccggttaaccggttacggtacccgacccggtaacccggaaaccggttaaccccccgaacccgttaccggttaccgtacccgtaacctttcccggttcccccgtttaaacccccc

SEQ ID NO: 231414 - DNA, 556 bp, Homo sapiens
  misc_feature: GYAE6OF02IYA4I.13.11.A11.1.454.CMB.1.raw
  modified_base (519)..(519): a, c, t, g, unknown or other
  misc_feature (519)..(519): n is a, c, g, or t
  modified_base (526)..(556): a, c, t, g, unknown or other
  misc_feature (526)..(556): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagaccggttcagtggcagtgggatgggacagacttcactctcaccatcagcagtctgcagtctgaagattttgcagtttattactgtcagcagtataataactggtctccgtactatacgtactaactttttcggacctaggggaacccaaccgttgggaacgtacgtacccgtaaggtaaaccgtaaaccgttcggttacgggaccgtttacggaccctaaacccttaacgttcgtacggttcctttaccaacgtttaccctttcccggaccctaattccctaggtaacttacggtaacccgttgaacccgtttggaacgtcgggtaccgtcgggtaactaacgggcgtaccaagtacgctnagtcgannnnnnnnnnnnnnnnnnnnnnnnnnnnnnn

SEQ ID NO: 231415 - DNA, 568 bp, Homo sapiens
  misc_feature: GYAE6OF02F43UE.13.11.A11.1.454.CMB.1.raw
  modified_base (199)..(199): a, c, t, g, unknown or other
  misc_feature (199)..(199): n is a, c, g, or t
  modified_base (369)..(369): a, c, t, g, unknown or other
  misc_feature (369)..(369): n is a, c, g, or t
  modified_base (373)..(373): a, c, t, g, unknown or other
  misc_feature (373)..(373): n is a, c, g, or t
  modified_base (378)..(378): a, c, t, g, unknown or other
  misc_feature (378)..(378): n is a, c, g, or t
tcagtcacgtactacacgaccggtgctcgatttagctacgactgcaggggagaagagctgctcagttaggacccagagggaaccatggaaaccccagcgcagcttctcttcctcctgctactctggctcccagataccaccggagaaatttgtgttgacgcagtctccaggcgtcgtgtctttgtctccgaaggggaangcccaccctctcctgcagggccagtcagattgcagcagcaactacttagcctggtaccagcagagccgtggcccacggcccccaggcctacctcatcacgatagtattcgaggtacgaccactgacactcccgagacgtagtcagtgcaggtggtctgggacagcttacnctcncgacntcagcagctagactagagtcttgacttacttattctcgtactaaccgtagttacgtaggtacgtaccgtaccgttacgttacgttttacgggaccgtacggggtaccaacggtcgtaggaactagttacgaagtacgtacgtgtacgggactcgactaccgtagttccgtcgtacttacgtccttacccg

SEQ ID NO: 231416 - DNA, 571 bp, Homo sapiens
  misc_feature: GYAE6OF02F7AKF.13.11.A11.1.454.CMB.1.raw
  modified_base (211)..(211): a, c, t, g, unknown or other
  misc_feature (211)..(211): n is a, c, g, or t
  modified_base (401)..(401): a, c, t, g, unknown or other
  misc_feature (401)..(401): n is a, c, g, or t
  modified_base (410)..(410): a, c, t, g, unknown or other
  misc_feature (410)..(410): n is a, c, g, or t
  modified_base (444)..(444): a, c, t, g, unknown or other
  misc_feature (444)..(444): n is a, c, g, or t
  modified_base (449)..(450): a, c, t, g, unknown or other
  misc_feature (449)..(450): n is a, c, g, or t
  modified_base (454)..(454): a, c, t, g, unknown or other
  misc_feature (454)..(454): n is a, c, g, or t
  modified_base (459)..(459): a, c, t, g, unknown or other
  misc_feature (459)..(459): n is a, c, g, or t
  modified_base (473)..(473): a, c, t, g, unknown or other
  misc_feature (473)..(473): n is a, c, g, or t
  modified_base (480)..(480): a, c, t, g, unknown or other
  misc_feature (480)..(480): n is a, c, g, or t
  modified_base (487)..(487): a, c, t, g, unknown or other
  misc_feature (487)..(487): n is a, c, g, or t
  modified_base (501)..(501): a, c, t, g, unknown or other
  misc_feature (501)..(501): n is a, c, g, or t
tcagtcacgtactacacgaccggtgctcgattttagctacgactgctagggtccgagtcagattgtcaggcagcaactacttagcctggtaccagcagaagcctggtccaggccccctaggctcctcatctacgagtgtactcaggaggaccgacgtgacgatcccgagtacaggttcagtgacagtgggtctgggacaggacttcactcncaccatcagacagactacgaacctagaagtacttcgactatttattcagtccacagtatggtagtcctaccgtactactttgaccgtagggaccacgtcgaggaacgataccgaagaccgaactggtacggctacgacaccgtaatccgtaggtactttacagttcccttaccggaccttactccagtanacggttcgngtaactggacggcggcgtgggtacgaggccgacngtacnncgtnacggnagtcgcacgctacncgtcccncgacacncgtactagacctcncgtcgtcgcgacgacgcgacgcgacgtcgtcgtactacgtacgtacgtaccgtacgtacgtacgacgtcg

SEQ ID NO: 231417 - DNA, 645 bp, Homo sapiens
  misc_feature: GYAE6OF02GRSML.13.11.A11.1.454.CMB.1.raw
  modified_base (200)..(200): a, c, t, g, unknown or other
  misc_feature (200)..(200): n is a, c, g, or t
  modified_base (301)..(301): a, c, t, g, unknown or other
  misc_feature (301)..(301): n is a, c, g, or t
tcagtcacgtactacacgaccggtgctcgatttagctacgactgcagggggagaagagctgctcagttaggaccccagagggaaccatggaaaccccagcgcagcttctcttcctcctgctactctggctcccagataccaccggagaaattgtgttgacgcagtctccaggcatcgtgtcttgtctccgaggggaaagngccaccctctcctgcagggccagtcaggattgtcagcagcaactacttagcctggtaccagcagaagcctggccacggcccccaggctccctcatctacgntgtagtcaggacgacactgacatcccagacaggtcagtggacagtcgggtcgttggacgagacttcacctcgtacaccgtataccgacgacctagaaccgtacgggtaacctaggtaaacgtacctttgaaccttacgttttaaactttcgttacgtacaacccgttagttagttacgggttacgtcctaacccggttacttaccgttttacggcccgtacgggaaacgtacggtaaccggtcggtaaggaccgtacgtaaacggtaccggttaacgttaccgggtggtaccgttcgaccgtacccgtaaccgttccgtttccggttacctttgttaacccccg

SEQ ID NO: 231418 - DNA, 418 bp, Homo sapiens
  misc_feature: GYAE6OF02HATH4.13.11.A11.1.454.CMB.1.raw
  modified_base (244)..(244): a, c, t, g, unknown or other
  misc_feature (244)..(244): n is a, c, g, or t
  modified_base (305)..(305): a, c, t, g, unknown or other
  misc_feature (305)..(305): n is a, c, g, or t
  modified_base (308)..(308): a, c, t, g, unknown or other
  misc_feature (308)..(308): n is a, c, g, or t
  modified_base (358)..(358): a, c, t, g, unknown or other
  misc_feature (358)..(358): n is a, c, g, or t
  modified_base (397)..(418): a, c, t, g, unknown or other
  misc_feature (397)..(418): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagaccttcactctcaccatcagcagactggaacctgaagtactttgctactttattcngtcaccagtatggtaggtcaccgtacacttttggccagggacagctgagatcagcgaatgngcngcaccatctgtcttcgactccttcccgcctactctgtaagtacgtacgtntaacgtgacggcgggcgtggacgaggtcgactagtagcnnnnnnnnnnnnnnnnnnnnnn

SEQ ID NO: 231419 - DNA, 399 bp, Homo sapiens
  misc_feature: GYAE6OF02GVSWO.13.11.A11.1.454.CMB.1.raw
  modified_base (349)..(349): a, c, t, g, unknown or other
  misc_feature (349)..(349): n is a, c, g, or t
  modified_base (383)..(383): a, c, t, g, unknown or other
  misc_feature (383)..(383): n is a, c, g, or t
  modified_base (389)..(399): a, c, t, g, unknown or other
  misc_feature (389)..(399): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaacctgaagactttgctactttatttctgtcaccagtatggtaggtcaccgtacacttttggccgaggggaccaaggctgggagatcaagcgaactgtggctgcaccatctgtcttcatccttcccgctatctnatagtacgtgactgacgtcgggctggacagggcncatagnnnnnnnnnnn

SEQ ID NO: 231420 - DNA, 402 bp, Homo sapiens
  misc_feature: GYAE6OF02G4LPR.13.11.A11.1.454.CMB.1.raw
  modified_base (313)..(313): a, c, t, g, unknown or other
  misc_feature (313)..(313): n is a, c, g, or t
  modified_base (390)..(402): a, c, t, g, unknown or other
  misc_feature (390)..(402): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaacctgaagactttgctacttttattctgtcaccagtatggtaggtcaccgtacacttttggcctaggggaccaagctggagatcaagcgaactgtgntgcacatctgtcttctatcttcccgccatctgtactagtacgtctactggacgcgggctggctaagggcgcagtagnnnnnnnnnnnnn

SEQ ID NO: 231421 - DNA, 408 bp, Homo sapiens
  misc_feature: GYAE6OF02FQ2VW.13.11.A11.1.454.CMB.1.raw
  modified_base (291)..(291): a, c, t, g, unknown or other
  misc_feature (291)..(291): n is a, c, g, or t
  modified_base (324)..(324): a, c, t, g, unknown or other
  misc_feature (324)..(324): n is a, c, g, or t
  modified_base (374)..(374): a, c, t, g, unknown or other
  misc_feature (374)..(374): n is a, c, g, or t
  modified_base (378)..(378): a, c, t, g, unknown or other
  misc_feature (378)..(378): n is a, c, g, or t
  modified_base (380)..(408): a, c, t, g, unknown or other
  misc_feature (380)..(408): n is a, c, g, or t
tcagtcacgtactacacgaccggtgctcgatttagctacgactgcagggccagtcagattgtcagcagcaactacttagcctggtaccagcagaagcctggccaggcacccaggctcctcatctacgatgtattcaggaggaccactgacatcccagacaggttcagtggcagtgggtctggggacagacttcactctcaccatcagcagactggaacctgaagactttgcacttttattctgtcaccagtatggtagtcaccgtacacttttgccagggaccaagctggngatcaagcgaatgtggctgcaccatctgtcttnatcttcccgcatctgatagtacgtgacttgagcgggctggcaaggcgcanacgnannnnnnnnnnnnnnnnnnnnnnnnnnnnn

SEQ ID NO: 231422 - DNA, 391 bp, Homo sapiens
  misc_feature: GYAE6OF02H7678.13.11.A11.1.454.CMB.1.raw
  modified_base (383)..(391): a, c, t, g, unknown or other
  misc_feature (383)..(391): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaaagactttgcacttttatttctgtcaccagtatggtagtcaccgtacacttttgcccaggggaccaagctggagatcaagcgaactgtggctgcaccatctgtcttcactcttcccgcatctgatagtacgtgactgagcgggctggcgaaggcgcaatagnnnnnnnnn

SEQ ID NO: 231423 - DNA, 763 bp, Homo sapiens
  misc_feature: GYAE6OF02GF4DH.13.11.A11.1.454.CMB.1.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatagttggtaccgacagaagccgagggactccctaccccgtagtttcctcctgtacggttcacggtacaaactcaagaataaacgagaggctcgtggacgtcccgagcccgtcttcctcgtaggactaccgaaagggtatacggtacgttcccgaccgaaaccgtcgaagggtattaacgtttacctactaacttccgtacgttcgggtaccttccgtaacgttcgtacggaacgtagtacgggtcggtacgttaggtaactttaactttaacgttggtttttaccggtaaccggtttggggtaaccctaaccgtaaaacccgtaacccggttacccggttaagggtaacctttccgggtttacccgggtaacggttaccggggtaacccgtaccgggttacccgaacccggtttacccggttaacgggtaacccggtaaccggtaaccccggtaaacccgggacccccttaaaccccccgtacggtttaccggtaaccccttccgtttacccgttaccccgttacccccccgg

SEQ ID NO: 231424 - DNA, 489 bp, Homo sapiens
  misc_feature: GYAE6OF02JE2TE.13.11.A11.1.454.CMB.1.raw
  modified_base (139)..(139): a, c, t, g, unknown or other
  misc_feature (139)..(139): n is a, c, g, or t
  modified_base (188)..(188): a, c, t, g, unknown or other
  misc_feature (188)..(188): n is a, c, g, or t
  modified_base (447)..(450): a, c, t, g, unknown or other
  misc_feature (447)..(450): n is a, c, g, or t
  modified_base (452)..(453): a, c, t, g, unknown or other
  misc_feature (452)..(453): n is a, c, g, or t
  modified_base (455)..(489): a, c, t, g, unknown or other
  misc_feature (455)..(489): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggnggaccactgacatcccagactaggttcagtggcaggtgggtctgggacngtacttcactctcaccatcagctagacctggaaacctggaatactttgacctaacttttatttcctgtactacctagttagtaggtaggtacaccggtactacgttttgacctagggaccaagcgtacggtagatacgaagacgaaacgtgtgactagccaaccgtaatccgtgtacttcgatccttaccgcctacttgactatacgtacgtgtaacgtgtaacggcggtcgtagggacctaagggctacgagttacgnnnntnnannnnnnnnnnnnnnnnnnnnnnnnnnnnnnnnnnn

SEQ ID NO: 231425 - DNA, 395 bp, Homo sapiens
  misc_feature: GYAE6OF02F3STA.13.11.A11.1.454.CMB.1.raw
  modified_base (374)..(374): a, c, t, g, unknown or other
  misc_feature (374)..(374): n is a, c, g, or t
  modified_base (380)..(383): a, c, t, g, unknown or other
  misc_feature (380)..(383): n is a, c, g, or t
  modified_base (385)..(395): a, c, t, g, unknown or other
  misc_feature (385)..(395): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcaggtgggtctgggacagacttcactctcaccatcagcagactggaacctgaagtactttgctacttttattctgtcaccagtactggtaggtcaccgtacactttttggcctaggggaccaagctggagatcaagcgaactgtggctgcaccatctgtcttcatcttcccgccatctgatacggactgagcggctggcaggcncatagnnnngnnnnnnnnnnn

SEQ ID NO: 231426 - DNA, 795 bp, Homo sapiens
  misc_feature: GYAE6OF02JBD4P.13.11.A11.1.454.CMB.1.raw
  modified_base (200)..(200): a, c, t, g, unknown or other
  misc_feature (200)..(200): n is a, c, g, or t
  modified_base (210)..(210): a, c, t, g, unknown or other
  misc_feature (210)..(210): n is a, c, g, or t
  modified_base (303)..(303): a, c, t, g, unknown or other
  misc_feature (303)..(303): n is a, c, g, or t
  modified_base (321)..(321): a, c, t, g, unknown or other
  misc_feature (321)..(321): n is a, c, g, or t
  modified_base (330)..(330): a, c, t, g, unknown or other
  misc_feature (330)..(330): n is a, c, g, or t
tcagtcacgtactacacgaccggtgctcgatttagctacgactgcaggggagaagagctgctcagttaggacccagagggaaccatggaaaccccagcgcagcttctcttcctcctgctactctggctcccagataccaccggagaaattgtgttgacgcagtctccaggcatcgtgtctttgtctccgaaggggaaagngcccaccctntccgtgcagggccagtcagattgtcagcagctaactcttagcctggtaccagcagaagccgtggccacggtccccaggctcctcactctacgntgtactcgaggacgaccncgtacgacncttaccccgaggaacctacgggttaccaggttacggacggtaggttacggggttctacggggacgtacgttaacgttcctaaccggttcccttaacccgaaccgtacttaccggtaacgtacccggtaacggtaacccgttaccgggtaaaccttagggtaaacgtttaccgtttacgggtacccttttaaacgtttttaacgtttaccgttaccggttacccgtaaaccggttacgggttaacgtttacggggttaccgttaacccgttaacccggtttaccgtttaccggtttttaccggggacccgggttaaaccggggtaacccgtaagggttaaccggttagggtaaccggttaccgtaacggtaaccggtaaccggttaacggtacgggtttaccgggaaccgttcgtaaccgttacccggttgtttacccggtacggtttcccggttattacccccgg

SEQ ID NO: 231427 - DNA, 751 bp, Homo sapiens
  misc_feature: GYAE6OF02I3LR3.13.11.A11.1.454.CMB.1.raw
  modified_base (689)..(689): a, c, t, g, unknown or other
  misc_feature (689)..(689): n is a, c, g, or t
tcagtcacgtactacacgaccggtgctcgatttagctacgactgcaggggtcgtgggagaggagccccagccctgagattcccaggtgtttccattcagtgatcagcactgaacacagaggactcaccatggagttgggactggagcgtggtattttcctttggcttagtttaaaaggtgtaccagtgtgaagtgcagcgtggtggagtcgtgggggagcttggacagcctggcaggtcctgagactctcctgtgacagcctcgtggattcattcttgactggtatttagcgtacctatcggaccacggttcgggggtcccgaccaaggtccctaccgggtaagggggaaccggtccggttaggggacggttcgggggtaccttacgggtaagggttaacgtttaggggtagggtaaacttaaggggttacggtaaaacgtgttaaacgggcttaagtcggccgggtaaccttcggtagggtacggacgggtaccgtaagtttcccaaccgttacgttaccgttacccaacgggtaaacggaacccaaaaccggtacccgaaaacggttaccccgttacccgtaggttacttacccgtacggaaacctaaagtacgaacgtacgttaccgaggaacgtacggtctacgggaaccggtacgtacggttcccgttaggtaacgtttacggnggttaacgtaacggtaaaacgttccgttaaagtttcggaccgtaaggtccggtactttccgg

SEQ ID NO: 231428 - DNA, 400 bp, Homo sapiens
  misc_feature: GYAE6OF02FPM86.13.11.A11.1.454.CMB.1.raw
  modified_base (378)..(400): a, c, t, g, unknown or other
  misc_feature (378)..(400): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagctttgctactttatttctgtcaccagtatggtagtcaccgtacacttttggcaggggaccaagctggagatcgaagcgaactgtggctgcacatctgtcttcatcttccgcatctgtatagtacgtgactgacgcggtctggcaaggcgcagtgnnnnnnnnnnnnnnnnnnnnnnn

SEQ ID NO: 231429 - DNA, 655 bp, Homo sapiens
  misc_feature: GYAE6OF02I3A03.13.11.A11.1.454.CMB.1.raw
  modified_base (142)..(142): a, c, t, g, unknown or other
  misc_feature (142)..(142): n is a, c, g, or t
  modified_base (189)..(189): a, c, t, g, unknown or other
  misc_feature (189)..(189): n is a, c, g, or t
  modified_base (191)..(191): a, c, t, g, unknown or other
  misc_feature (191)..(191): n is a, c, g, or t
  modified_base (198)..(198): a, c, t, g, unknown or other
  misc_feature (198)..(198): n is a, c, g, or t
tcagtcacgtactacacgaccggtgctcgatttagctacgactgcaggggagaagagctgctcagttaggacccagagggaaccatggaaacccagcgcagcttctcttcctcctgctactctggctccagataccacgganaattgtgtgacgcagtctccaggcatcgtgtctttagctcagggaancnccacctntcctgcgaggccagtaccagtagtttgacagcgtagactaactacttagccttaggtaaccagaccaagaacgcgtcggaccacggccccaaggccttccgacaactcgacgacgtagttactacgaacgacggacctagtacgaacgactccgagacgtacggttcaggtcggacctagggtgggttacgcggaacgtacgtacgttacccgtataccggttaaccaccgtagttaccgacgtactacggtaaccgtacggttaaccctacggtaacgtaacgtttcgaaccgtttacgtttagtttctacgttacacgttaagtagtcggtaacgtacgttaccgttactacgtttcggaaccgtagggtacgaacgtcgagtactacgtacggtaagtcggtaacgtggaccgtacgtacgtaccgtacgtaagttcgacttccgttactaccg

SEQ ID NO: 231430 - DNA, 426 bp, Homo sapiens
  misc_feature: GYAE6OF02FLRKK.13.11.A11.1.454.CMB.1.raw
  modified_base (394)..(394): a, c, t, g, unknown or other
  misc_feature (394)..(394): n is a, c, g, or t
  modified_base (412)..(426): a, c, t, g, unknown or other
  misc_feature (412)..(426): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagatttcactctcaccatcagcagcctgcaggctgaagatggtggctagttttatactgtcagcaattattatagtactcctccgaggctcacgtttcggcggagggaccaaagggtggagactacgaaaacgaactgtggctgccaccatctgttccttcattcccttcccgcctattcctgtaatacggtacgtgactggagcgggntaggcaaggcacgatagnnnnnnnnnnnnnnn

SEQ ID NO: 231431 - DNA, 392 bp, Homo sapiens
  misc_feature: GYAE6OF02F8TBE.13.11.A11.1.454.CMB.1.raw
  modified_base (383)..(392): a, c, t, g, unknown or other
  misc_feature (383)..(392): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaacctgaagactttgctactttatttctgtcaccagtatggtagtcaccgtacacttttggccaggggaccaagctggagatcaagcgaactgtggctgcaccatctgtcttcatcttccgccatctgatagtacgtgactgacgcgggctggcgaaggcgcagtagnnnnnnnnnn

SEQ ID NO: 231432 - DNA, 800 bp, Homo sapiens
  misc_feature: GYAE6OF02JKJ91.13.11.A11.1.454.CMB.1.raw
  modified_base (184)..(184): a, c, t, g, unknown or other
  misc_feature (184)..(184): n is a, c, g, or t
  modified_base (187)..(187): a, c, t, g, unknown or other
  misc_feature (187)..(187): n is a, c, g, or t
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgctttctcctggagcgtcgacacgtntcncctacgtgaccttacgtgcactggtcgaccaaactgttcggttcccgtacctagcaactattacttggttaccgaaccagaagaccgacggaagggtccttcccctacccgtttagtttcctccgtaggttacgtacgtacgtaaacctaacctacgaacgtaaaacgtaaccgacgggtacggtccttacggtacggtaccccgtacccgacggcccgttcttcctcggtaggtacctaacggaagtcgtagttacccgttcccgaaaccggaccgaacggggtaaggttaactttaaccgtttaccaacgttacttacccgttacgggtccggtacccctaccggttaccgtcgtacggtaaacgtaggtacgggaccggttcgtaaccgttaactttaaccgttttacgttttacggttaccgtttaccgggttcggaaccctaaaacctaaaccgggtaacccgttccggtaggttacctttaccgggtacccggttacgggtacccggtaccgtaccggtacccgttaccgtacgggttacgtaccgacccgtaaccgacccgtaaccccaccgtcgtacgtacctccgttcgttccccgtacccccg

SEQ ID NO: 231433 - DNA, 922 bp, Homo sapiens
  misc_feature: GYAE6OF02GVLG7.13.11.A11.1.454.CMB.1.raw
  modified_base (196)..(196): a, c, t, g, unknown or other
  misc_feature (196)..(196): n is a, c, g, or t
tcagtcacgtactacacgaccggtgctcgatttagctacgactgcaggggagaagagctgctcagttaggacccagagggaaccatggaaaccccagcgcagcttctcttcctcctgctactctggctcccagataccaccggagaaattgtgttgacgcagtctccaggcatcgtgtctttgtctccgagggaangccacctctcctgcagggccagtcagattgcagcagccaacttacttacgccgttggtaacccagaccgaagaacgcccgtacgggaccccaccgggccccccaagggcccttacccctccgaaccttaccttaccggaatttacggtttactttaccgaacgggtacggaccctaaccgttgaaccctaacttaccccgaagtaaccgtagggttttaccaacgggttcggtaccggtaaggggttccggggttacgtttacggggaaaaccgtacgggttaacctttaccggaacccttacccggtttacccaaccgtaaccgttaccggaaccggtaaccgtaaacgggtacccgtttaacggggtaaaaaccccttacgggttaaaaacggtttcccgttttttaaacggaaccccgtttttaaaccgttttttttaacggttttacccgtttaacgggttttaccccctaaaacccgggtttagggtttttaaacggttaccggggtttaaacccgggttaacccgttaacccgggttttacccgtttaacccgggtttttacgggaccccggggttaaaccgggggtaccctaaacggttaccgggtagggaaccgttaccgtacggtaaacgggtaaccgttaacggttaacgggttccgggacttaaccggtaccctacgttaaccgttcggtttccgtttaccgtacgtttaccccg

SEQ ID NO: 231434 - DNA, 853 bp, Homo sapiens
  misc_feature: GYAE6OF02FK5QS.13.11.A11.1.454.CMB.1.raw
tcagtcacgtactacacgaccggtgctcgatttagctacgactgcaggggtctgggagaggagccccagccctgagattcccaggtgtttccattcagtgatcagcactgaacacagaggactcaccatggagttgggactgagctggattttcctttggctattttaaaaggtgtccagtgtgaagtgcagctggtggagtcgtgggggaggcttggtacagcctggcaggtccctgagacctctcctgtgcagcctctggattcattcttttgatgtattatcgacctagtgctacggtcggggtcccgacaacggcctaccggagggggaacgggtcctaggggacggttcggggtacctacggtaggttaagtttacggtagggtaatacggttaagggtaactaaggttaggaccttagtacgggccggtaccttcgtaggtagggaacgggtacccgtatttaccgaaccgtagttacccgttaccgaaacgggtaaccggaaacccgtaacccggtaaccgaaaaccgggttaacccctttacccccggttaaggttaaccgttaccttaacgggtaaacccgtaaaactttaaccgggaaaacccgttacgggtttaaccgttaacgggaacgggttaaccgggtaaccggttaacgggggaaacccgggttaacccgggttaaccccggggtttcccggttttacgggttttaaacccggtttaaccgggtttacgggttaaccccgggaaaccgttttaaaacccgggggtaccccttttaagggttttaaacccgggaccggtttaaccggggtttcccgggttacggttttacccccgggg

SEQ ID NO: 231435 - DNA, 692 bp, Homo sapiens
  misc_feature: GYAE6OF02ITJIT.13.11.A11.1.454.CMB.1.raw
  modified_base (201)..(201): a, c, t, g, unknown or other
  misc_feature (201)..(201): n is a, c, g, or t
  modified_base (211)..(211): a, c, t, g, unknown or other
  misc_feature (211)..(211): n is a, c, g, or t
  modified_base (235)..(235): a, c, t, g, unknown or other
  misc_feature (235)..(235): n is a, c, g, or t
tcagtcacgtactacacgaccggtgctcgatttagctacgactgcagggggagaagagctgctcagttaggacccagagggaaccatggaaaccccagcgcagcttctcttcctcctgctactctggctcccagataccaccggagaaattgtgttgacgcagtcctccgaggcatcgtgtctttgtctcgaaggggaaancgccaccctntcctggccagggcctagtccagtnttgtcagcagcctaactacttgcctggtaccagcagacgcctcggccacgccccagcctcctcatctacgatgtatcgaaggacgtacccagtcgaactacgtacccgaagtaccgtaggttacaggttcggacgtagggttgggtaccgtgggtaaccgtacgtactttaccgaccttccgtaccaacctaagtcgacgacgtaacgtacgtacgtaacccgttaacgtaaccgttacgtttacgtaacccttaactttttaacgtttcgttaccgttacctaacccgtaagttacgttacgggtaacgttacccgtaaccgttaacgtttaacgttttccgggaaccggtaacggggtaacccgtaaggtacggtacggtaagacgttacgaacgtcgtaaacggtcggtacgtcgtacgaccgttaccgtgtaccgttcgttaccttcctaccg

SEQ ID NO: 231436 - DNA, 716 bp, Homo sapiens
  misc_feature: GYAE6OF02HPPCT.13.11.A11.1.454.CMB.1.raw
  modified_base (174)..(174): a, c, t, g, unknown or other
  misc_feature (174)..(174): n is a, c, g, or t
tcagtcacgtactacacgaccggtgctcgatttagctacgactgcaggggtctgggagaggagccccagccctgagattcccaggtgtttccattcagtgatcagcactgaacacagaggactcaccatggagttgggactgagctggattttcctttggctattttaaaggtntccagtgtgaagtgcagctggtggagtcgtggggggaggcttggtacagccgtggcaggtccctagagactctcctgtacgcagtccctagtggattcattcgtttgagttgaatttagtcggcctaagtcgacctacgttcggggtaccgacaaggcctacggaagggggacggacgtgggtacggttgggggaccttacggtaagggttactttaggggtaggtaaattacgggtgggttaaaccaggttacggtcgttaagtcgggtaaccgggactttacgttgggtaacgggaacggggtaccgttaacgttaccgtaaccgacttcgttaaccgacggtaaacgaaccgaacgacccgaaacgtaaccgtcccgttacgtaactccgtacgtaacaaagtaccgaaacgtcgaccgtagaacgtacgcgtaaggacggaccgtacggttcttacggtagtttaacgtggtaacgaaccgtaaaacgaccttacccgtaaccccgtttaacggtttacggttttagtacggttacgg

SEQ ID NO: 231437 - DNA, 437 bp, Homo sapiens
  misc_feature: GYAE6OF02HMW5T.13.11.A11.1.454.CMB.1.raw
  modified_base (199)..(199): a, c, t, g, unknown or other
  misc_feature (199)..(199): n is a, c, g, or t
  modified_base (244)..(244): a, c, t, g, unknown or other
  misc_feature (244)..(244): n is a, c, g, or t
  modified_base (343)..(343): a, c, t, g, unknown or other
  misc_feature (343)..(343): n is a, c, g, or t
  modified_base (376)..(376): a, c, t, g, unknown or other
  misc_feature (376)..(376): n is a, c, g, or t
  modified_base (398)..(398): a, c, t, g, unknown or other
  misc_feature (398)..(398): n is a, c, g, or t
  modified_base (403)..(437): a, c, t, g, unknown or other
  misc_feature (403)..(437): n is a, c, g, or t
tcagtcacgtactacacgaccggtgctcgattttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactcncaccatcagcagactggaacctgaagtctttgctactttatttcngtcaccagtatggtaggtcaccgtactacttttggccgaggggaccaaggctggagatcaagcaactgtggctgcaccatctgtcttcacttcctcccncactctgacttagtcgtgacgtgaggccggtcnggacgaacggcgacgtaagtgngtacnnnnnnnnnnnnnnnnnnnnnnnnnnnnnnnnnnn

SEQ ID NO: 231438 - DNA, 716 bp, Homo sapiens
  misc_feature: GYAE6OF02IYJTR.13.11.A11.1.454.CMB.1.raw
  modified_base (415)..(415): a, c, t, g, unknown or other
  misc_feature (415)..(415): n is a, c, g, or t
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttcctcctggagtcgtcagccagtctcacctgcaccttgcgcagtgcacctatgttcggtccctagtcgacctatatagttggtacccgacaggtaagcccgtaaggggacttccctccccgtagtttcctccccgtggtaccggtttcacgggtacctaaaacgtcgaagtaacgtaaaccgacgtacgggtccttacggacgggtaccttacccccgaagtcccgtcctttcgccgtgaacgtccgtaaaggnttcggtacttccccggacctaacggcgtagggtacttaataccgtccacgttcctcgtacgggtcctacgtcgttcgagtcgtagttcggacggtcttacgtacgttatttacggttgtttaacgccgtttaggaccctaacgtaccgtaaccggtcgttacggtacttaccgttacggtacccgtaaccggggtacctaccggttaccgtacccggttacccgaggttacccaccggtacccgtaaccgcccctaacccgtcgtaccgtccacgtttaccccggtaccgttacccccggg

SEQ ID NO: 231439 - DNA, 810 bp, Homo sapiens
  misc_feature: GYAE6OF02HBVHL.13.11.A11.1.454.CMB.1.raw
tcagtcacgtactacacgaccggtgctcgatttagctacgactgcaggggtctgggagaggagccccagccctgagattcccaggtgtttccattcagtgatcagcactgaacacagaggactcaccatggagttgggactgagctggattttccttttggctattttaaaaggtgcccagtgtgaggtgcagctgggtggagtcgtgggaggaggcttggatccagccgtgggggtccctgacgactctcctgtgcagcctcgtggttcaccgtcagtcacacctacatgagtctcgggtcccgaccgacgggtcctacccggaagggggtaacgggggcgtaggggtacggttcggtccgtttccgtttacgttttttaagtttttaagttaggttaacggtttgggttaacggttaaactacgtttaacccgtcccggtacgaacgtaaccggttcccggtacggggtaacgggggcccgttacgtttacccacccggtaatttcccgtaccgaaaggtaaccgtaaacctaaacgtttacccaaaacgggtaaaccctaccggtttacgttttaaccggtttttacctaaacgttaaaacggttacgaaaccgttaccggtacccgttagggaaacccggtggacccgtaagtaccggaacccggttaccgggttaccgttagtttaaccgttcgtacgttacgggaccgtagggaaggtcccgggtaacggggtacccgttaaaccggtaacgtttaaccgtacggtacgttagggtacggggttaccgttccgggaaccggggg

SEQ ID NO: 231440 - DNA, 419 bp, Homo sapiens
  misc_feature: GYAE6OF02GHM1N.13.11.A11.1.454.CMB.1.raw
  modified_base (389)..(419): a, c, t, g, unknown or other
  misc_feature (389)..(419): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagtaatttgactacttttatttctgtcaccagtatggtagtcaccgtacacttttggccaggggaccaagctggagactcaagcgaactgtggctgcacatctgtctcatcttcccgctatctacgatagtacgtgactggacgcgggctggacaggcgctagtacgnnnnnnnnnnnnnnnnnnnnnnnnnnnnnnn

SEQ ID NO: 231441 - DNA, 218 bp, Homo sapiens
  misc_feature: GYAE6OF02HMUOK.13.11.A11.1.454.CMB.1.raw
  modified_base (212)..(218): a, c, t, g, unknown or other
  misc_feature (212)..(218): n is a, c, g, or t
tcagtcacgtactacacgaccggtgctcgatttagctacgactgcaggggccagggagccctggtcaccgtctcctcagcctccaccaagggcccatcggtcttcccctggcgccctgctccaggagcacctccgagagcacagcggccctgggctgcctggtcaaggactacttcctagtacgtgactgagcgggctggcaggcgcatagnnnnnnn

SEQ ID NO: 231442 - DNA, 424 bp, Homo sapiens
  misc_feature: GYAE6OF02F8PZ3.13.11.A11.1.454.CMB.1.raw
  modified_base (405)..(405): a, c, t, g, unknown or other
  misc_feature (405)..(405): n is a, c, g, or t
  modified_base (407)..(424): a, c, t, g, unknown or other
  misc_feature (407)..(424): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatccccagacaggttcagtggcagtggggtctggggacagacttcactctcaccatcagcagactaggaacctgaagtacttttgccttacttttatttctgtccaccagtatggtaggtcaccgtactacttttggccaggggaccaagctagggagatcaagcgaactgtggctgcaccatctgtcttcactccttcccgctactctgatagtacgtgtactggacggcggcgtggccgaaggcgcagtagnannnnnnnnnnnnnnnnnn

SEQ ID NO: 231443 - DNA, 546 bp, Homo sapiens
  misc_feature: GYAE6OF02J1FN8.13.11.A11.1.454.CMB.1.raw
  modified_base (515)..(546): a, c, t, g, unknown or other
  misc_feature (515)..(546): n is a, c, g, or t
tcagtcacgtactacacgaccggtgctcgatttagctacgactgcagggccagtcagattgtcagcagcaactacttagcctggtaccagcagaagcctggccaggcccccaggcctcctcatctacgatgtattcaggaggacccatgacatcccagacaggttcagtggcagtgggtctgggacaggacttcactctcaccatcagcagacttggaaacctgaagactttgactacttttatttcctagtcctaccagttattgggtagttccgaccgttactacgtttttcggccgacgggggtaccctaaggtcccgtagggtacgtaacgttaccgaaaggtaccggtaaaccgttgggtcggtcctggtaccaccgtaattcctggttccttacgtaccttcccttccccgactacgtcgttataacgtaccgttaagtcgtaccgttaggaacgggttcggggcccgttagggaaccgtaacgggcgttaaccgagttaagcgctgcnnnnnnnnnnnnnnnnnnnnnnnnnnnnnnnn

SEQ ID NO: 231444 - DNA, 455 bp, Homo sapiens
  misc_feature: GYAE6OF02GGRLE.13.11.A11.1.454.CMB.1.raw
  modified_base (419)..(419): a, c, t, g, unknown or other
  misc_feature (419)..(419): n is a, c, g, or t
  modified_base (423)..(424): a, c, t, g, unknown or other
  misc_feature (423)..(424): n is a, c, g, or t
  modified_base (426)..(428): a, c, t, g, unknown or other
  misc_feature (426)..(428): n is a, c, g, or t
  modified_base (430)..(455): a, c, t, g, unknown or other
  misc_feature (430)..(455): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaacctgaagtactttgctacttttattctgtcacctagtagtggtaggtctaccgtactacgttttggccgacgggaccaagctggagactacaagacgaatgtggctgccactatctgtcttacacttccttcccgacctattcctagtattacgtacgtggactggacggtcgggctcgggacgtaaggccgacgtagtagnagtnngnnntnnnnnnnnnnnnnnnnnnnnnnnnnn

SEQ ID NO: 231445 - DNA, 684 bp, Homo sapiens
  misc_feature: GYAE6OF02JPFS7.13.11.A11.1.454.CMB.1.raw
  modified_base (161)..(161): a, c, t, g, unknown or other
  misc_feature (161)..(161): n is a, c, g, or t
  modified_base (191)..(191): a, c, t, g, unknown or other
  misc_feature (191)..(191): n is a, c, g, or t
  modified_base (196)..(196): a, c, t, g, unknown or other
  misc_feature (196)..(196): n is a, c, g, or t
  modified_base (245)..(245): a, c, t, g, unknown or other
  misc_feature (245)..(245): n is a, c, g, or t
  modified_base (359)..(359): a, c, t, g, unknown or other
  misc_feature (359)..(359): n is a, c, g, or t
  modified_base (432)..(432): a, c, t, g, unknown or other
  misc_feature (432)..(432): n is a, c, g, or t
  modified_base (506)..(506): a, c, t, g, unknown or other
  misc_feature (506)..(506): n is a, c, g, or t
  modified_base (635)..(635): a, c, t, g, unknown or other
  misc_feature (635)..(635): n is a, c, g, or t
tcagtcacgtactacacgaccggtgctcgatttagctacgactgcggggggtaagaggttgtgtccaccatggcctggactcctctcctcctcctgctcctctctcactgcacgtacgttccctctcgcgaggctgtgctgactcacgtccgtcttccctntctgtccttcctcgaggcgtcgtcagcctnttccncctacctgcctcctggccgctaggtcgaccaacgtgtttcgggtttccncctatacggacctaatttacttaggttacggacccgaagaacggacggcccggaagggtcctaccccgttcccttcgtttccgacgttacggtagttaacgcgtactaaacgtnacgtaacgacggagacggtcgtagtacccggactaccccgcgtccgtacttcgttagcgtaccacgtaacgtncgttaccgacccgacacggacggttacggtatttacaccttgtacgtttcgcggtaccggattcgtaaccggtnacggtagacgttggacgtcgtaacgttctttagtaacgttttgttaccgttaaccggttcgaccttaaccgaccgtaccgtgttacgtcgttccgcggtacgtaccggctacgggtactcgtaccggtntaccgccgtaaccgccgaccaccgtctcgaccgtcctccgtacctcccg

SEQ ID NO: 231446 - DNA, 796 bp, Homo sapiens
  misc_feature: GYAE6OF02JR5EW.13.11.A11.1.454.CMB.1.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgtcttctctggagcgtcagccagtctcactgctaccgtgcgcgagtcgacaccgattcgttcgtacctatacgactaattattagttacggtaaccgacgagaacgccgagggtacgtccccgtaccccgtagtttccgtaccgttaggtacggttaccgtaacggtacctaaaccgtcgaaggtaaacgtaaaaccgacggaacgggtccttacggtacgggacccgtccccgacgtcccgtcctttacgtcgtcggtaacctacgtaaggtacgtacgtacgttacccgaaccgtaacggcgtaacggtactttacgttacgtaccgtacttccgttacggtacggtacccgtaccgtacggttacgtacggtaacgtaggtacgggtaacggtaccgtacgttaaccgtttaactttacgtttacggttttacggtaaccggtttacgaaccgtaaccgaaaccgtacccggtacgtaacggttaccgttaccgtaaccgggtaccggtaaccgggtacccgtaccggtaccgtacccggtaccggtaacgggtacccaccggtaaccggaaccccgtacccgtaacccgttacgttaccggacctttaccccgttccgttacccggttaccccc

SEQ ID NO: 231447 - DNA, 458 bp, Homo sapiens
  misc_feature: GYAE6OF02HX0L0.13.11.A11.1.454.CMB.1.raw
  modified_base (302)..(302): a, c, t, g, unknown or other
  misc_feature (302)..(302): n is a, c, g, or t
  modified_base (423)..(423): a, c, t, g, unknown or other
  misc_feature (423)..(423): n is a, c, g, or t
  modified_base (427)..(458): a, c, t, g, unknown or other
  misc_feature (427)..(458): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatccccagacaggttcagtggcagtgggtctgggacagacttcactctccaccatcagcagacctggaacctgaagtactttgctattttactttctgtcaccagtatggtaggtcaccgtactactttggccgagggaccaagctagganatacaagcgaactggtcggctgcaccatctcgttcttctacttccttccccgcactctgtaagtacgtacgtgacgtggacgccgggtctacgggacgaagggccgacgtagtagcgatgncgannnnnnnnnnnnnnnnnnnnnnnnnnnnnnnn

SEQ ID NO: 231448 - DNA, 701 bp, Homo sapiens
  misc_feature: GYAE6OF02IKQBT.13.11.A11.1.454.CMB.1.raw
  modified_base (496)..(496): a, c, t, g, unknown or other
  misc_feature (496)..(496): n is a, c, g, or t
tcagtcacgtactacacgaccggtgctcgatttagctacgactgcggggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcctaccttgcgcgaggtcggcaacctaagttggttcggtccctagtcgaactataattagttacggtaaccgaacaagaacggccgtaaggggaccgttcccctaccccgtagtttcctccgttggtacggttacgacggtaaccaaactcgaagtaaactaaacggacgtacgggacctacgtacgggtaccgtcccccgaagcccgtccttcgtcgtaggacctacgaagtacgtacgtacgttaccgaccgtaacgacgtaaggtaacttacttacctactactcgtcgtggacccttacgngtctaggacgtagtacggtggtacttagtacctttatttacgtttggtttacgtagttacggactaaccgtaacgtaccgtcgtagttaccgtccgtttacgggaccgttacccgggacgttaccggacctacccggttcgtaagacccgacgacccggaaccgtaccccgaacctcgttacgaccctacctccgtcccgtcccc

SEQ ID NO: 231449 - DNA, 555 bp, Homo sapiens
  misc_feature: GYAE6OF02G2GU9.13.11.A11.1.454.CMB.1.raw
  modified_base (358)..(358): a, c, t, g, unknown or other
  misc_feature (358)..(358): n is a, c, g, or t
  modified_base (458)..(458): a, c, t, g, unknown or other
  misc_feature (458)..(458): n is a, c, g, or t
  modified_base (460)..(460): a, c, t, g, unknown or other
  misc_feature (460)..(460): n is a, c, g, or t
  modified_base (463)..(463): a, c, t, g, unknown or other
  misc_feature (463)..(463): n is a, c, g, or t
  modified_base (466)..(466): a, c, t, g, unknown or other
  misc_feature (466)..(466): n is a, c, g, or t
  modified_base (472)..(472): a, c, t, g, unknown or other
  misc_feature (472)..(472): n is a, c, g, or t
  modified_base (483)..(483): a, c, t, g, unknown or other
  misc_feature (483)..(483): n is a, c, g, or t
  modified_base (485)..(485): a, c, t, g, unknown or other
  misc_feature (485)..(485): n is a, c, g, or t
  modified_base (487)..(487): a, c, t, g, unknown or other
  misc_feature (487)..(487): n is a, c, g, or t
  modified_base (491)..(491): a, c, t, g, unknown or other
  misc_feature (491)..(491): n is a, c, g, or t
  modified_base (495)..(495): a, c, t, g, unknown or other
  misc_feature (495)..(495): n is a, c, g, or t
  modified_base (497)..(497): a, c, t, g, unknown or other
  misc_feature (497)..(497): n is a, c, g, or t
tcagtcacgtactacacgaccggtgctcgattttagctacgactgcagggtccgagtcagattgtcaggcagcaactacttagcctggtaccagcagaagcctggtcaggccccaggctcctcatctacgatcgtattcgaggaggaccgacgtgacatcccgagtacaggttcagtgctagtggtctgggacaggacttcactctcaccatcagacagactcgaacctgaacgtctttagactactttattctagtcaccagtagtggtagttctaccgtactacgtttcggccgaacggggacctaagcgtaggtaacgacgtacgaacgcgaacgtagtcgctgccacgtattcncgtcttactacttccttcccgcctacgttctacgtactacggtacgttcggtaactggacggccggtacgtggacggaacggtcgtacgtagttagctancnacnacngtacgnctctcgcgtcncncnctcncacncncgcgacgcgcgcgcgcgcgcgtcgtacgcgtacgtacgtactacgtacgtcgtatacg

SEQ ID NO: 231450 - DNA, 618 bp, Homo sapiens
  misc_feature: GYAE6OF02J3FJL.13.11.A11.1.454.CMB.1.raw
  modified_base (434)..(434): a, c, t, g, unknown or other
  misc_feature (434)..(434): n is a, c, g, or t
  modified_base (510)..(510): a, c, t, g, unknown or other
  misc_feature (510)..(510): n is a, c, g, or t
  modified_base (580)..(580): a, c, t, g, unknown or other
  misc_feature (580)..(580): n is a, c, g, or t
  modified_base (584)..(584): a, c, t, g, unknown or other
  misc_feature (584)..(584): n is a, c, g, or t
  modified_base (591)..(591): a, c, t, g, unknown or other
  misc_feature (591)..(591): n is a, c, g, or t
  modified_base (593)..(593): a, c, t, g, unknown or other
  misc_feature (593)..(593): n is a, c, g, or t
  modified_base (595)..(618): a, c, t, g, unknown or other
  misc_feature (595)..(618): n is a, c, g, or t
tcagtcacgtactacacgaccggtgctcgatttagctacgactgcagggccagtcagattgtcagcagcaactacttagcctggtaccagcagaagcctggccacggcccccaggcctcctcatctacgattggtatcgaggagacctactgacctactacccgagtacgacgggtttcaggttcggacgtagggttcgggtactagggactacgtacctttccaccttctaccaacccagtcgaccgacgtaacggtaccgtaacggtaccctaggtaacttacgtttcgacctttacgttttatcctagaccctaacgtagttacgttacgggtacctaccgtacccggtttacgttaccggtttacgggacccggaacggggtaacctacggtaccgtagggtacctacaaccggttacggacgttaccgngggttaccgtaccgtaccgacccttaacgtcttccgttaacgtttcccgacccttccgttaccctccggaactttntacggttaacgtaccggtacgttacgtacgtacggcggggtacgtccggtagacgggtacacgggctacngtgncggatgnancnnnnnnnnnnnnnnnnnnnnnnnn

SEQ ID NO: 231451 - DNA, 595 bp, Homo sapiens
  misc_feature: GYAE6OF02IP0V2.13.11.A11.1.454.CMB.1.raw
  modified_base (196)..(196): a, c, t, g, unknown or other
  misc_feature (196)..(196): n is a, c, g, or t
tcagtcacgtactacacgaccggtgctcgatttagctacgactgcaggggagaagagctgctcagttaggacccagagggaaccatggaaaccccagcgcagcttctcttcctcctgctactctggctcccagataccaccggagaaattgtgttgacgcagtctccaggcatcgtgtctttgtctccaggggaanagccacctctcctgcagggccagtcagattgtcagcagcaactacttagcctggtaccagcagaagcctggccaggcccccaggctcctcactctacgatgtattcgaggaggaccatgacactcccagacctaggttcaggtcggacgaggttcgggtctgggacacggactttcgacttcgtacaacccattccagctagaccgtaggaacctagaacgtacttagaccttacgttttattctgttcacctagtatggtagtcctaccgtactacgttttacggccgtacggggtacctaaggtccgtacggtaacgtagtacgtaacggtaccggtaacgttcgggtcggacgttcggtacctaccgacgtttccgttacgttcctacgttacccg

SEQ ID NO: 231452 - DNA, 558 bp, Homo sapiens
  misc_feature: GYAE6OF02JOUZQ.13.11.A11.1.454.CMB.1.raw
  modified_base (248)..(248): a, c, t, g, unknown or other
  misc_feature (248)..(248): n is a, c, g, or t
  modified_base (477)..(477): a, c, t, g, unknown or other
  misc_feature (477)..(477): n is a, c, g, or t
  modified_base (487)..(487): a, c, t, g, unknown or other
  misc_feature (487)..(487): n is a, c, g, or t
  modified_base (489)..(489): a, c, t, g, unknown or other
  misc_feature (489)..(489): n is a, c, g, or t
  modified_base (499)..(499): a, c, t, g, unknown or other
  misc_feature (499)..(499): n is a, c, g, or t
  modified_base (506)..(506): a, c, t, g, unknown or other
  misc_feature (506)..(506): n is a, c, g, or t
  modified_base (509)..(509): a, c, t, g, unknown or other
  misc_feature (509)..(509): n is a, c, g, or t
  modified_base (513)..(513): a, c, t, g, unknown or other
  misc_feature (513)..(513): n is a, c, g, or t
  modified_base (517)..(518): a, c, t, g, unknown or other
  misc_feature (517)..(518): n is a, c, g, or t
  modified_base (520)..(520): a, c, t, g, unknown or other
  misc_feature (520)..(520): n is a, c, g, or t
  modified_base (522)..(522): a, c, t, g, unknown or other
  misc_feature (522)..(522): n is a, c, g, or t
  modified_base (524)..(524): a, c, t, g, unknown or other
  misc_feature (524)..(524): n is a, c, g, or t
  modified_base (526)..(526): a, c, t, g, unknown or other
  misc_feature (526)..(526): n is a, c, g, or t
  modified_base (528)..(531): a, c, t, g, unknown or other
  misc_feature (528)..(531): n is a, c, g, or t
  modified_base (533)..(533): a, c, t, g, unknown or other
  misc_feature (533)..(533): n is a, c, g, or t
  modified_base (535)..(536): a, c, t, g, unknown or other
  misc_feature (535)..(536): n is a, c, g, or t
  modified_base (538)..(540): a, c, t, g, unknown or other
  misc_feature (538)..(540): n is a, c, g, or t
  modified_base (542)..(543): a, c, t, g, unknown or other
  misc_feature (542)..(543): n is a, c, g, or t
  modified_base (545)..(545): a, c, t, g, unknown or other
  misc_feature (545)..(545): n is a, c, g, or t
  modified_base (549)..(549): a, c, t, g, unknown or other
  misc_feature (549)..(549): n is a, c, g, or t
  modified_base (551)..(551): a, c, t, g, unknown or other
  misc_feature (551)..(551): n is a, c, g, or t
  modified_base (553)..(553): a, c, t, g, unknown or other
  misc_feature (553)..(553): n is a, c, g, or t
  modified_base (555)..(555): a, c, t, g, unknown or other
  misc_feature (555)..(555): n is a, c, g, or t
  modified_base (557)..(558): a, c, t, g, unknown or other
  misc_feature (557)..(558): n is a, c, g, or t
tcagtcacgtactacacgaccggtgctcgatttagctacgactgcaggccagtcagattgtcagcagcaactacttagcctggtaccagcagaagcctggccaggccccaggctcctcactctacgactgtattcaggtacgaccactgacactcccagcagttcagtggcaggtgggtctgggactacgaccttcgactcctacaccatccaagctagactggaacctgaagtcttgctattattcngttcacgcgtatcgtacggttcaccgtactacttttggcctaggggtacctaaacgtcgttagggaacgtacttacgaacggtaccggtaaaccttgggtacggtaccttggaacctaccccggtaattccgtcgttaaccgttctaccgttccgttttcccggacctaacgtcctagtacttacgacgttgacgtacgtacggcgtacgtggactaggtaccgctaanaggtcagtcncncggatccgancttccgnacngttngtanngngncncncnnnncncnncnnncnncnctcncncncncnn

SEQ ID NO: 231453 - DNA, 439 bp, Homo sapiens
  misc_feature: GYAE6OF02HHYX4.13.11.A11.1.454.CMB.1.raw
  modified_base (335)..(335): a, c, t, g, unknown or other
  misc_feature (335)..(335): n is a, c, g, or t
  modified_base (396)..(396): a, c, t, g, unknown or other
  misc_feature (396)..(396): n is a, c, g, or t
  modified_base (398)..(398): a, c, t, g, unknown or other
  misc_feature (398)..(398): n is a, c, g, or t
  modified_base (402)..(403): a, c, t, g, unknown or other
  misc_feature (402)..(403): n is a, c, g, or t
  modified_base (406)..(439): a, c, t, g, unknown or other
  misc_feature (406)..(439): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatccccagaccaggttcagtggcagtgggtctggggacagacttcactctcacccatcagcagactggaaccctgaagacttttgctacttttatttctgtcaccagtatggtaggtcaccgtacacttttggccaggggaccaagctggagatcaagcgaactgtggctgcaccatctgtcttnatccttcccgcctatctgatagtacgtgactgagcgggctggacgaagggtcgacagtagncnagcnngtnnnnnnnnnnnnnnnnnnnnnnnnnnnnnnnnnn

SEQ ID NO: 231454 - DNA, 718 bp, Homo sapiens
  misc_feature: GYAE6OF02HV88O.13.11.A11.1.454.CMB.1.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtgcacaatgtgtcctatcgacatatattcggtaccgacagaacgccgaagggacgtccctacccctagtttcctccgtggtacggttcgacggtacctaaaaccttcgaagaacttaaaaccggacgaggggtcctccgtaggtaccgtacccccgagcccgtcctttaccgtcgtaggaactacccgaaaggtactgacttacccgacaacggcgaacggtattacgttaactacgtactcgtacgtgggtacccttccgtaagtccgtaggtaacgtactgggtaacggtacttacggtaaacctttagtttaaccgtttcggtttacggtaccgtttcgggacctaaaccgtaaacgaaccggtcccgttaggtaaccttccggtttaccgggaaccggttcgggacccgtaacggtcctaccggttaccggacggtaccaaccggaaccccgtaacggaacccctaacccgtacgttaccgtaccctaccgtttcccgtccgttaccccccg

SEQ ID NO: 231455 - DNA, 585 bp, Homo sapiens
  misc_feature: GYAE6OF02GDUW1.13.11.A11.1.454.CMB.1.raw
  modified_base (454)..(454): a, c, t, g, unknown or other
  misc_feature (454)..(454): n is a, c, g, or t
  modified_base (543)..(543): a, c, t, g, unknown or other
  misc_feature (543)..(543): n is a, c, g, or t
  modified_base (547)..(549): a, c, t, g, unknown or other
  misc_feature (547)..(549): n is a, c, g, or t
  modified_base (552)..(557): a, c, t, g, unknown or other
  misc_feature (552)..(557): n is a, c, g, or t
  modified_base (559)..(568): a, c, t, g, unknown or other
  misc_feature (559)..(568): n is a, c, g, or t
  modified_base (570)..(585): a, c, t, g, unknown or other
  misc_feature (570)..(585): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccatgacatcccagacaggttcagtgcagtggtctgggacagcttcactctcaccatccagcagactaggaaactgaagtacttttgaccttaactttttattcgtacgtaccaacctacgtaagtcgggttaacggttaccaaccccgttaacgttaccgtttttcggggacccgtaaacggggggtaacctaaaggtcccgtaacgggtaacgtaacttacggaaaacggtaccggtaacggttcggtaccgggtacgttcgacccgtaactacttaccgtcgttacgttcttaacgtccgtttccccnctacgttctagtacgttaacgtcggtacgtactcggacgtaccggtcgtacggaaccggaacgggtccaacgattcgacttagcgtcgnctannnacnnnnnnannnnnnnnnngnnnnnnnnnnnnnnnn

SEQ ID NO: 231456 - DNA, 414 bp, Homo sapiens
  misc_feature: GYAE6OF02JFVQD.13.11.A11.1.454.CMB.1.raw
  modified_base (244)..(244): a, c, t, g, unknown or other
  misc_feature (244)..(244): n is a, c, g, or t
  modified_base (322)..(322): a, c, t, g, unknown or other
  misc_feature (322)..(322): n is a, c, g, or t
  modified_base (343)..(343): a, c, t, g, unknown or other
  misc_feature (343)..(343): n is a, c, g, or t
  modified_base (392)..(414): a, c, t, g, unknown or other
  misc_feature (392)..(414): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaacctgaagactttgctactttatttccngtcaccagtatggtagtcaccgtactactttggccagggaccaagctaggagatcagcgaatgtggctgcaccatctntcttcatcctcccgctatctnatacgtacgtgactgacgcgggtcgtcggacgaacggtcgacgagtagnnnnnnnnnnnnnnnnnnnnnnn

SEQ ID NO: 231457 - DNA, 477 bp, Homo sapiens
  misc_feature: GYAE6OF02JEUCT.13.11.A11.1.454.CMB.1.raw
  modified_base (429)..(429): a, c, t, g, unknown or other
  misc_feature (429)..(429): n is a, c, g, or t
  modified_base (432)..(432): a, c, t, g, unknown or other
  misc_feature (432)..(432): n is a, c, g, or t
  modified_base (435)..(435): a, c, t, g, unknown or other
  misc_feature (435)..(435): n is a, c, g, or t
  modified_base (438)..(438): a, c, t, g, unknown or other
  misc_feature (438)..(438): n is a, c, g, or t
  modified_base (440)..(440): a, c, t, g, unknown or other
  misc_feature (440)..(440): n is a, c, g, or t
  modified_base (442)..(442): a, c, t, g, unknown or other
  misc_feature (442)..(442): n is a, c, g, or t
  modified_base (444)..(462): a, c, t, g, unknown or other
  misc_feature (444)..(462): n is a, c, g, or t
  modified_base (464)..(477): a, c, t, g, unknown or other
  misc_feature (464)..(477): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaaccctgaaacgtcttttagcctacttttatttcgtgtcacctagtatggtagtcaccgttacacttttggccaggggaccaagcgtaggagatcaagcgaactgtgctgcaccatctgtcttcactcctcccgcatctgattacgtacgtacgtactaggacggtccgggacgttcgggaccgtaaacggccggtacgtaaacggttcggatncgngcngcngngngnnnnnnnnnnnnnnnnnnngnnnnnnnnnnnnnn

SEQ ID NO: 231458 - DNA, 703 bp, Homo sapiens
  misc_feature: GYAE6OF02HIQHQ.13.11.A11.1.454.CMB.1.raw
tcagtcacgtactacacgaccggtgctcgatttagctacgactgcgggggttaagagggttgtgtccaccatggcctggactcctctcctcctcctgctcctctctcactgcacacggttccctctcgcaggctgtgctgactcagccgtcttccctctctgcttctcctggagcgtcagccagtctcactgccaccttgcgcagtcggacaccaatgttcgtcctatgacatatattggtaccaacaagacgaccgagggacgtccctcccctagtttcctccgtaggtacggttcgaggtactaaacgtcaagtaactaaaacgacgacgggtctcgtacggaccgtcccgagccgtcttcgtcgtggactaccgaaggactagtacctttacccgaccgaacgcgaaggtacttacttacgtactacgtccgtagtcgggcttaccgaagttctaggaacgtagtgggacgtctacggtaatttacgtttacgtttggtttactggtttaccggaactaaccgtaaaccgtacggtaccgttaaggtaccgtttaccggttaacccggtaccggtaccgggtaaccccgtacgggtacccgtaacccgtttaccggttaacggacccgttaaccggaaccccgaaccgaacccccttaaccgcgttaaccgtcctaaccgtttcctacccgttacccccc

SEQ ID NO: 231459 - DNA, 553 bp, Homo sapiens
  misc_feature: GYAE6OF02JX21R.13.11.A11.1.454.CMB.1.raw
  modified_base (96)..(96): a, c, t, g, unknown or other
  misc_feature (96)..(96): n is a, c, g, or t
  modified_base (203)..(203): a, c, t, g, unknown or other
  misc_feature (203)..(203): n is a, c, g, or t
  modified_base (214)..(214): a, c, t, g, unknown or other
  misc_feature (214)..(214): n is a, c, g, or t
  modified_base (238)..(238): a, c, t, g, unknown or other
  misc_feature (238)..(238): n is a, c, g, or t
  modified_base (332)..(332): a, c, t, g, unknown or other
  misc_feature (332)..(332): n is a, c, g, or t
  modified_base (373)..(373): a, c, t, g, unknown or other
  misc_feature (373)..(373): n is a, c, g, or t
  modified_base (384)..(384): a, c, t, g, unknown or other
  misc_feature (384)..(384): n is a, c, g, or t
  modified_base (471)..(471): a, c, t, g, unknown or other
  misc_feature (471)..(471): n is a, c, g, or t
  modified_base (523)..(553): a, c, t, g, unknown or other
  misc_feature (523)..(553): n is a, c, g, or t
tcagtcacgtactacacgaccggtgctcgatttagctacgactgcagggccagtcagattgtcagcagcaactacttagcctggtaccagcagaancctggccaggccccaggctcctcatctacgatgtattccaggaggacccatgacatcccgaagactaggttcaggtgcaggtcggtacgtgggacagtatttcactntcaccatcacnctacgcctggcaggtctaggaatntggtcggacttaagtttattaccctaggtctaaggtattaataagtttacgaacgtacttccgtaccgggaatcctaacttccggttaccgggngggtaaccggacgaaggttcggacttaagaccaaaacgggnttgggaccggntacgtaccacgtactggtacttcgtactactttcccgaccgtactcgtttagttccgagttaacgtaggtcgtaaccgggttacggngggttacccgggacgtagggaccctaaggggtccaattacgggactcgatgnnnnnnnnnnnnnnnnnnnnnnnnnnnnnnn

SEQ ID NO: 231460 - DNA, 404 bp, Homo sapiens
  misc_feature: GYAE6OF02FMUL1.13.11.A11.1.454.CMB.1.raw
  modified_base (244)..(244): a, c, t, g, unknown or other
  misc_feature (244)..(244): n is a, c, g, or t
  modified_base (298)..(298): a, c, t, g, unknown or other
  misc_feature (298)..(298): n is a, c, g, or t
  modified_base (315)..(315): a, c, t, g, unknown or other
  misc_feature (315)..(315): n is a, c, g, or t
  modified_base (320)..(320): a, c, t, g, unknown or other
  misc_feature (320)..(320): n is a, c, g, or t
  modified_base (354)..(354): a, c, t, g, unknown or other
  misc_feature (354)..(354): n is a, c, g, or t
  modified_base (381)..(381): a, c, t, g, unknown or other
  misc_feature (381)..(381): n is a, c, g, or t
  modified_base (386)..(404): a, c, t, g, unknown or other
  misc_feature (386)..(404): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagctggaacctgaagtactttgctacttttattccngtcacagtatggtagtcaccgtactacttttcggcctaggggaccaagctgganattcaagcgaatgtgcngcacntctgtctcatcctccgccatctgactagtacgtntacgtgacgcggcgtggcaaggcgtanatagnnnnnnnnnnnnnnnnnnn

SEQ ID NO: 231461 - DNA, 394 bp, Homo sapiens
  misc_feature: GYAE6OF02H4XM0.13.11.A11.1.454.CMB.1.raw
  modified_base (243)..(243): a, c, t, g, unknown or other
  misc_feature (243)..(243): n is a, c, g, or t
  modified_base (325)..(325): a, c, t, g, unknown or other
  misc_feature (325)..(325): n is a, c, g, or t
  modified_base (346)..(346): a, c, t, g, unknown or other
  misc_feature (346)..(346): n is a, c, g, or t
  modified_base (386)..(394): a, c, t, g, unknown or other
  misc_feature (386)..(394): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagtctttgcctattttatttcngtctaccagtactggtaggtcaccgttacactttttggccaggggtaccaagctggagatcaagcgaatgtgctgcacatcngtcttcatcttcccgccactntgatagtacgtgactgagcggctggcaaggcgacagtagnnnnnnnnn

SEQ ID NO: 231462 - DNA, 697 bp, Homo sapiens
  misc_feature: GYAE6OF02GOIOP.13.11.A11.1.454.CMB.1.raw
  modified_base (198)..(198): a, c, t, g, unknown or other
  misc_feature (198)..(198): n is a, c, g, or t
tcagtcacgtactacacgaccggtgctcgatttagctacgactgcggggtaagaggttgtgtccaccatggcctggactcctctcctcctcctgctcctctctcactgcacaggttccctctcgcaggctgtgctgactcagccgtcttccctctctgtcttctcctggagcgtcagccagtctcacctgcacttgcncagtgcaacctatgttcggtacctatgacatatatcggtaccacaggaacgaccgaggacgttccctccccgtagtttcctcctggtacggttccaaggtacctaaactacgaacgtaacgtaaaacgacggacgggtcctcgtacgggaccgtaccccacggtcccgtactttccgtacgtcggtactaccgaaaggtactacggtacttccccggacgtaaccggaacgtaacgggtaattaacgtttactacctacgttccgtacggtccggtacctcccgtacgttaccgtagacgtacgtaggtacggtctacgttacttaacgttacttgttagtacgtacgtacctaactaacgtacgtaccgtacggtacttccgtaccgggtaccggaccggtacgtaccggtacctcccggttacgtacggtacctaccggacccgtaaccgaccccgaaccctcgtaccgtaccgtacccttccgtacccgttacccc

SEQ ID NO: 231463 - DNA, 773 bp, Homo sapiens
  misc_feature: GYAE6OF02JUML9.13.11.A11.1.454.CMB.1.raw
  modified_base (207)..(207): a, c, t, g, unknown or other
  misc_feature (207)..(207): n is a, c, g, or t
tcagtcacgtactacacgaccggtgctcgatttagctacgactgcagggtctgggagaggagccccagccctgagattcccaggtgtttccattcagtgatcagcactgaacacagaggactcaccatggagttggactgagctggtattttcctttggctattttaaaaggtgtaccagttgtgaagtgtcagctggtgagtcggnggggagtcgttaggacacgccgtggtcgtacggtcctagacgtaccttctcgttcgcgtcgacgtccgtcgtggtacttcgtatttcgtttagagttagttaattgtccgtaccgtattcgtaaccggtcggttcgggaaccgtcgtacgtaccgtcggtaacgggtacggtcgtacgggttggtcggggtacctggttaagtacgttaggtaaggtgtaacgtagtacgtaggtagtcgtagtcggaccgtagtacgttagggtacggaaccgggttttttacgaccgtaccgtaacgtcgttacgtaacgtacggtaacgaacccgtaaccgtaaccgtaaccgtaccgttaccgttacgtaaccgttacgtaaccgtaaagtaaaccgttaccgaacgtacggtaccttacggtaacgtaccgtacggtaacggttaaccgaaccggttaccgttaaccgtttaaccggttcgttaacggttaccggttaacggtaaaccgttaccggttaacgttacgttaccggtaaccgttaccggtacggttacccggtttaaccccgg

SEQ ID NO: 231464 - DNA, 549 bp, Homo sapiens
  misc_feature: GYAE6OF02FG9FB.13.11.A11.1.454.CMB.1.raw
  modified_base (246)..(246): a, c, t, g, unknown or other
  misc_feature (246)..(246): n is a, c, g, or t
  modified_base (389)..(389): a, c, t, g, unknown or other
  misc_feature (389)..(389): n is a, c, g, or t
  modified_base (392)..(393): a, c, t, g, unknown or other
  misc_feature (392)..(393): n is a, c, g, or t
  modified_base (397)..(397): a, c, t, g, unknown or other
  misc_feature (397)..(397): n is a, c, g, or t
  modified_base (403)..(403): a, c, t, g, unknown or other
  misc_feature (403)..(403): n is a, c, g, or t
  modified_base (408)..(408): a, c, t, g, unknown or other
  misc_feature (408)..(408): n is a, c, g, or t
  modified_base (413)..(413): a, c, t, g, unknown or other
  misc_feature (413)..(413): n is a, c, g, or t
  modified_base (424)..(424): a, c, t, g, unknown or other
  misc_feature (424)..(424): n is a, c, g, or t
  modified_base (428)..(428): a, c, t, g, unknown or other
  misc_feature (428)..(428): n is a, c, g, or t
  modified_base (432)..(432): a, c, t, g, unknown or other
  misc_feature (432)..(432): n is a, c, g, or t
  modified_base (434)..(434): a, c, t, g, unknown or other
  misc_feature (434)..(434): n is a, c, g, or t
  modified_base (436)..(436): a, c, t, g, unknown or other
  misc_feature (436)..(436): n is a, c, g, or t
  modified_base (440)..(440): a, c, t, g, unknown or other
  misc_feature (440)..(440): n is a, c, g, or t
tcagtcacgtactacacgaccggtgctcgatttagctacgactgcagggccgagtcagattgtcagcagcaactacttagcctggtaccagcagaagcctggccagcccccaggctcctcatctacgatgtattcaggagaccactgacatcccagaccaggttcagtggcagtggtctgggacagtacttcactctcaccatcagcagacgtcggaacctgaacgtactttgctacttttattcngtaccaccgagtacgtggtaactgtacggctgaccacctagttcctagttcttacgacttccttcccgacgtatcgtacgacgttagtacgtagacctggacggtcgggactcggacgaacgggtcgacgtaagtagcagtcnacnncgancgttcncgagngttcngtcactcgacncgancgcncncncgcnctacacacgtactactactactacacgtacgactacgtagtacgtacgtacgacgtacgtacgacgtacgtacgtacgtacgaccgacgtaccgtacgcgacgtcgacg

SEQ ID NO: 231465 - DNA, 785 bp, Homo sapiens
  misc_feature: GYAE6OF02IDW8A.13.11.A11.1.454.CMB.1.raw
  modified_base (616)..(616): a, c, t, g, unknown or other
  misc_feature (616)..(616): n is a, c, g, or t
tcagtcacgtactacacgaccggtgctcgatttagctacgactgcgggggtaagaggttgtgtccaccatggcctgggactcctctcctcctcctgcctcctctctcactgcacaggttccctctcgcaggctgtgctgactcacgccgttccttccctctctcgtcttcctcctggcgcgtcacgacctagttcctcaccgtcgtacctaccctttgccgcgacggttcggaccctaaacctaagttcggtttcggtaccccttaacgtagacctaattaagttacgtttacgggtaacccggaaccgaacggtaacggaccgtaacggggtaccgttacccccttacccccgtaacgtttttccccttacccgtcggttaacgtttacggaccggtttaaacctaaaccgtacgtaacggtaaacgttaaaccggaacggtaacggggtcctaccggttacggaccgttacccccgaacggtcccgttactttccgttccgtaacggtactaaccgaacggttaactacggtaccttcccggaacccggtacggaacgtaacgggtaacttaacgtactcgtactcgtcgtcgggtcctacgactcgtacggtntagtaggacgtacgtacgttactagttacgttagttctcttcgaacaccgaacaccgtcgtcgtacttccggttaccggcgtacggaccgtaccgcgtacggtaccgtggtaccgaccgtacccgaccgtacccaccgtactaccgtacctacttcccgtacgtacccc

SEQ ID NO: 231466 - DNA, 677 bp, Homo sapiens
  misc_feature: GYAE6OF02HQXMO.13.11.A11.1.454.CMB.1.raw
  modified_base (191)..(191): a, c, t, g, unknown or other
  misc_feature (191)..(191): n is a, c, g, or t
  modified_base (608)..(608): a, c, t, g, unknown or other
  misc_feature (608)..(608): n is a, c, g, or t
  modified_base (620)..(620): a, c, t, g, unknown or other
  misc_feature (620)..(620): n is a, c, g, or t
  modified_base (628)..(628): a, c, t, g, unknown or other
  misc_feature (628)..(628): n is a, c, g, or t
  modified_base (639)..(639): a, c, t, g, unknown or other
  misc_feature (639)..(639): n is a, c, g, or t
  modified_base (642)..(642): a, c, t, g, unknown or other
  misc_feature (642)..(642): n is a, c, g, or t
  modified_base (644)..(644): a, c, t, g, unknown or other
  misc_feature (644)..(644): n is a, c, g, or t
  modified_base (646)..(646): a, c, t, g, unknown or other
  misc_feature (646)..(646): n is a, c, g, or t
  modified_base (648)..(648): a, c, t, g, unknown or other
  misc_feature (648)..(648): n is a, c, g, or t
  modified_base (651)..(652): a, c, t, g, unknown or other
  misc_feature (651)..(652): n is a, c, g, or t
  modified_base (656)..(656): a, c, t, g, unknown or other
  misc_feature (656)..(656): n is a, c, g, or t
  modified_base (659)..(660): a, c, t, g, unknown or other
  misc_feature (659)..(660): n is a, c, g, or t
  modified_base (663)..(664): a, c, t, g, unknown or other
  misc_feature (663)..(664): n is a, c, g, or t
  modified_base (666)..(667): a, c, t, g, unknown or other
  misc_feature (666)..(667): n is a, c, g, or t
  modified_base (670)..(671): a, c, t, g, unknown or other
  misc_feature (670)..(671): n is a, c, g, or t
  modified_base (673)..(675): a, c, t, g, unknown or other
  misc_feature (673)..(675): n is a, c, g, or t
tcagtcacgtactacacgaccggtgctcgatttagctacgactgcagggccagtcagattgtcagcagcaactacttagcctggtaccagcagagcctggccaggccccaggctcctcatctacgatgtattcaggaggaccactgacactcccagaccaggttcaggtcggcaggtgggtcctgggaacngtacttcactctcaccatcaagcaagtactggaacctggaaacgtcttttgacttaatttttcttacgttgtacaccgtagttaactgggtaaggttaccacccgttaacgttacgtttttacccggacggaaccgggggtaaccccgaaaaggttcccgtaaggggtaaaccgtaaggtttaaccgaacgggaaccgaaactttcgggttacgggtaactccggggtaaccttaacccggacgttaacgtccgttttcggttaccttaaccgtttccctttaccccccggtctttaacgttcccgtttagaacgttaacgtttacgttaacgtacctacggggtaacggcggggtttaccctagggaacccggtacggggtacccttaaggaccgtttaaggcgatccggatacgnttccggatcgtntacgtganagcgtagtacncgntntnantgnnaganctnngtnnanncgnngnnngc

SEQ ID NO: 231467 - DNA, 740 bp, Homo sapiens
  misc_feature: GYAE6OF02I52SP.13.11.A11.1.454.CMB.1.raw
tcagtcacgtactacacgaccggtgctcgatttagctacgactgcaggggtctgggagaggagccccagccctgagattcccaggtgtttccattcagtgatcagcactgaacacagaggactcaccatggagttgggactgagctggattttccttttggtctaagttttaaaaggtgtccagtgtgaagtgcagctggtggagtcgtgggggaggcgttggtacaggccgtggccgtacggtcccctggacgacctccttccgtggtcgcacgcctcgtggattcctagttctttagtagttcgtattatcggtacctattcggcctacggtcggggtacccggacgaacggtcctaccgggaaggggaacgggtcccggtggggacggttcgggggtacctacggtaagggtttgtttaagggttagggtaaagttaacgggttacggtaaacgtaagttagggacctagtacgggacggtacgttcgtagggttacgggaacgggtccggtaattcccgaactactcctaacgagtaaccgaacgtaacccgacgtaaacgtaaccgttcccgttagtacttaccagaaccgtaaagacgaaacgtaacgtagtaggaacgtaaggtcgtaaggaccgggtaacctacggttaccgtttacgtaatttacggtacgttcgtaaacgtaaaccggttacttaacggttacggaccgttaggtcggtaccgttcccgg

SEQ ID NO: 231468 - DNA, 680 bp, Homo sapiens
  misc_feature: GYAE6OF02IPHG3.13.11.A11.1.454.CMB.1.raw
tcagtcacgtactacacgaccggtgctcgatttagctacgactgcaggggtctgggagaggagccccagccctgagattcccaggtgtttccattcagtgatcagcactgaacacagaggactcaccatggagttgggactgagctgggttttccttgttgcttattttaaaaggtgcccagtgtgaggtgcagctggtggagtcgtggaggaggcttgatccagccgtgggggtccctgagactctcctgtgcagcctcgtggttccaccgtcagtcacacctacatgagtccgtggggtcccgccgaggcctccggaaggggaacggggcgtgggagtcgtcgttcttctttttaattacgagttagttaggtatacatacctccgacaacgtacgtccggtacggacggggtccacgtttaccacctattcccaaccgaaggacgtaaactaacttacccgaaagtaacccacggttcctttacgttttccttaaacaaagttaccggaaactacggtcccttagggaacgtacgaccccgaagttacggaacccgtaccggttaccgtagtttaacctacgttggtaccgagtacggaaggtcggaccgggtacccctaacggttaaccgttaaccgtcggtaccttaggtacgggtcccggttaggtaccggggg

SEQ ID NO: 231469 - DNA, 817 bp, Homo sapiens
  misc_feature: GYAE6OF02GXZVU.13.11.A11.1.454.CMB.1.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgtcttctccgtggagcgtcagccagtctcacctgccaccttgcgcaggtcggcaacctaattggttcggtaccctagtagacattattagttcggtaaccgacaagacgccgagggactcccttcccgtagtttcctactaggtacgttacgaggtacaaactcgaagtaaactaaaaccggcgaacgggtctacggtacggaccgtaccccacggtcccgtcgttccgtcgtacggaactaccgaaagggtactacggtactttacccggaaccgaaacggcgtaaacggggttaacttaacttaaccgtctaacgttccgtaccggtcggggtaccctaccgtacggttaccgtacggacgtaacggtggaacggtcttaagtaacgtttattttaccggttgtttaacgtacggtttacgaccttaaaccgaaacgttaccgtaccgttacgggtaaccttaccggtttaccgggaacccttacgggggtaaccctaccggggttaccccgtaaccgggtttcccggtaaccgggttaaccccgtacccggtaacccccggtaaaacccggaccccccgttaaaaccccccggttaccggttaccgtttaaccccccgtaccggtttacccgttaaccccccggtttacccccccg

SEQ ID NO: 231470 - DNA, 747 bp, Homo sapiens
  misc_feature: GYAE6OF02I6Z3F.13.11.A11.1.454.CMB.1.raw
tcagtcacgtactacacgaccggtgctcgatttagctacgactgcagggccagtcagattgtcagcagcaactacttagcctggtaccagcagaagcctaggccaggccccaggctcctcatctacgatgtattcaggagtaccactgacatcccagacaggttcagtggcaggtgggtctgggacagacttcgactcgtcaccatcagcagactggaacctgaagtactttgctactttacttctcgtacaccgtagttaacgtggtaacggttcaacccggttactaacttttttcggggccctaagggggtaacccaaacggtacccgtagggtaacgtaacgttaccgaaacggtaccgtaaaccgttacggttcggggtccttaggtaccgaaccgtaattccgttggttacccttacgttaaccttcccggttttaccccgacccttaacgttaccgtacggttacttaacgggtacgttccgtaaagtcggtaacgggtccgggtccgttacggaccgtaaacggggtccgtaccggtaaagtaccggtgttacggtccacgttcgggaactttcccgggaaagtacggtaacgtacgtacgtacggtacgtacgtacgtacgtacgtcgtacggtacgtaccgtacgtaccgtacgtacggttacgtacgtaccgtacgtaccgtaccgtacccgtaccgtacgtacgtcgttccgtaccgtaccgttacgtacgtacg

SEQ ID NO: 231471 - DNA, 416 bp, Homo sapiens
  misc_feature: GYAE6OF02IHERK.13.11.A11.1.454.CMB.1.raw
  modified_base (304)..(304): a, c, t, g, unknown or other
  misc_feature (304)..(304): n is a, c, g, or t
  modified_base (383)..(383): a, c, t, g, unknown or other
  misc_feature (383)..(383): n is a, c, g, or t
  modified_base (393)..(416): a, c, t, g, unknown or other
  misc_feature (393)..(416): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcagtggcagtgggtctgggacagacttcactctcaccatcagcagactggaaacctgaagtctttgactacttttattcctgtcaccagtatggtaggtcaccgtactacttttggccagggaccaagctggagactanaagcgaatgtggctgcaccatctgtcttcactcttcccgcctactgatagtactgacgtgagcggcgtggacaagggcncgtagtacgnnnnnnnnnnnnnnnnnnnnnnnn

SEQ ID NO: 231472 - DNA, 750 bp, Homo sapiens
  misc_feature: GYAE6OF02GF9AW.13.11.A11.1.454.CMB.1.raw
  modified_base (196)..(196): a, c, t, g, unknown or other
  misc_feature (196)..(196): n is a, c, g, or t
  modified_base (227)..(227): a, c, t, g, unknown or other
  misc_feature (227)..(227): n is a, c, g, or t
  modified_base (264)..(264): a, c, t, g, unknown or other
  misc_feature (264)..(264): n is a, c, g, or t
  modified_base (730)..(730): a, c, t, g, unknown or other
  misc_feature (730)..(730): n is a, c, g, or t
tcagtcacgtactacacgaccggtgctcgatttagctacgactgcagggggaggaagagctgctcagttaggacccagagggaaccatcggaaaccccagcgcagcttctcttcctcctgctactctggctccagactaccaccggagaaattggtgttgacgcagtctcaggcatcgtgtcttgctcgagggaancgccacctctcctgacgacggccagtcagtnttagtcagcagactaactacgtacgtcctaggtaccncgacgaagaacgcctacggccgtaaccggacccccgaggtccctacctaccacttacctaacgattacgttacttcggaacggtaaccggaccaacgtacggaactactaaccccgagaaccgttacggttacgtaaggtcgggaccgttagggttcgggtaccggtacgggtaactaacggttaaccgttactacgttaccacgtaacccgtataccgaacgtaccgaacggtaaccgtacggtaaccttagggaaaccgtttacgtttacggtaaccctttaactttttacgttaccgttacgttaaaccgttaccgttagttacgtttacgggtaaccggttacttaacccgttacgtttacggtttcgggaacgttaacgggtaacccgtagttcggtaaggaagttaacgaccgtaacggtaacgtaacgttggacgttacgcgtaaccacgtaaccgttntccgttactacccgttaccg

SEQ ID NO: 231473 - DNA, 662 bp, Homo sapiens
  misc_feature: GYAE6OF02HBBXG.13.11.A11.1.454.CMB.1.raw
  modified_base (246)..(246): a, c, t, g, unknown or other
  misc_feature (246)..(246): n is a, c, g, or t
  modified_base (316)..(316): a, c, t, g, unknown or other
  misc_feature (316)..(316): n is a, c, g, or t
  modified_base (364)..(364): a, c, t, g, unknown or other
  misc_feature (364)..(364): n is a, c, g, or t
  modified_base (633)..(633): a, c, t, g, unknown or other
  misc_feature (633)..(633): n is a, c, g, or t
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagcccagtctcacctgcctaccttgcgcagtgcaccatgttcggtcctagtgactatagtatggtaccganagaacgccgagggacttccctaccctagtttctccgtgtagtcgaggtacaaactcagtaactaacgacncgggctcgtaggacgtcccgagccgtcttcgtcgtgactacgaaggtntcgtactccgacacgagacgggtaactagttacctctacttcgtacgtggtacctaccgtagtctacggaacgtagttacggacgttccgtaagtactttagtttaccgtggttttacgtacgtttacggacctaacgtaacccgtaacggttcctaggttaaccttcgttacccgggtaccgtaccgggtaacccgtaccggttacgtacccgttacgtacggacccgtaaccggtacccgaacccgcccgtaaacccctcggtaccncctaccgttcccgtacccgtttacccccg

SEQ ID NO: 231474 - DNA, 578 bp, Homo sapiens
  misc_feature: GYAE6OF02GD8BB.13.11.A11.1.454.CMB.1.raw
  modified_base (194)..(194): a, c, t, g, unknown or other
  misc_feature (194)..(194): n is a, c, g, or t
  modified_base (202)..(202): a, c, t, g, unknown or other
  misc_feature (202)..(202): n is a, c, g, or t
  modified_base (222)..(222): a, c, t, g, unknown or other
  misc_feature (222)..(222): n is a, c, g, or t
  modified_base (254)..(254): a, c, t, g, unknown or other
  misc_feature (254)..(254): n is a, c, g, or t
  modified_base (365)..(365): a, c, t, g, unknown or other
  misc_feature (365)..(365): n is a, c, g, or t
tcagtcacgtactacacgaccggtgctcgatttagctacgactgcaggggagaagagctgctcagttaggacccagagggaaccatggaaaccccagcgcagcttctcttcctcctgctactctggctcccagataccaccggagaaattgtgttgacgcagtctccaggcatcgtgtctttgctcaggggaangccacctntcctgcagggccagtcagtnttgtacagcagcaactacttagcctggtaccngcagaacgcctggaccacggcccccaggcctcctcgactctacggactgtacttcaaggacggaccacgtcgacactcccgagtactacggttcaggtggctaggtcggtntagggtacagacttcactcacacagtcagacagacgtcgaacctgaatctttagactacttttattctacgtctactagtacttcgggtacgttactaccgttacttcgtttcggaccgtacgggtaacctacggtcgttacggagtactacgaacggtacgtaacgttacggtcgattacggctaccgtattacggttctacttccgtaccg

SEQ ID NO: 231475 - DNA, 484 bp, Homo sapiens
  misc_feature: GYAE6OF02H9K2U.13.11.A11.1.454.CMB.1.raw
  modified_base (205)..(205): a, c, t, g, unknown or other
  misc_feature (205)..(205): n is a, c, g, or t
  modified_base (461)..(461): a, c, t, g, unknown or other
  misc_feature (461)..(461): n is a, c, g, or t
  modified_base (464)..(464): a, c, t, g, unknown or other
  misc_feature (464)..(464): n is a, c, g, or t
  modified_base (466)..(466): a, c, t, g, unknown or other
  misc_feature (466)..(466): n is a, c, g, or t
  modified_base (468)..(484): a, c, t, g, unknown or other
  misc_feature (468)..(484): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggaggaccactgacatcccagacaggttcaggtgcaggtgggtctggggacagacttcactctcaccntcagcagactggaacctagaagtactttgctagtgttattactgtcaggctagtagtggtagcctccaccgtccggacgtttccggacgaacgggaaccgtaagggtagggaaactaccgaaaacggtaacttgggtacggaccttggaccacctatcgtagttccttacacttccttacccgcctacttccgtagaacttcggtaagtcgacgttggacggtcggggtctcggggacgtaacggcgacgttaagngtnancnnnnnnnnnnnnnnnnn

SEQ ID NO: 231476 - DNA, 416 bp, Homo sapiens
  misc_feature: GYAE6OF02FZ38V.13.11.A11.1.454.CMB.1.raw
  modified_base (309)..(309): a, c, t, g, unknown or other
  misc_feature (309)..(309): n is a, c, g, or t
  modified_base (323)..(324): a, c, t, g, unknown or other
  misc_feature (323)..(324): n is a, c, g, or t
  modified_base (359)..(359): a, c, t, g, unknown or other
  misc_feature (359)..(359): n is a, c, g, or t
  modified_base (373)..(373): a, c, t, g, unknown or other
  misc_feature (373)..(373): n is a, c, g, or t
  modified_base (378)..(379): a, c, t, g, unknown or other
  misc_feature (378)..(379): n is a, c, g, or t
  modified_base (386)..(416): a, c, t, g, unknown or other
  misc_feature (386)..(416): n is a, c, g, or t
tcagtcacgtactacacgaccggtgctcgatttagctacgactgcagggccagtcagagtgttcccaacaactacttagcctggtaccagcaaaggcctggccaggctcccaggcgcctcatctatgctgcttccagtagggccactggcgtcccagacaggttcagtggcagtgggtctgggacagacttcaccctcaccatcagcagctggagcctagaagtattttgctagtctattactgtcagcagtatggtagccgaaagacgtttcgccaagggaccaaggtgaaatcaaacgactgtggcnggcacatctgtctnntctcccgcatctgattagtacgtgactggagcggngtggcgaaggcganatgannagtgtannnnnnnnnnnnnnnnnnnnnnnnnnnnnnn

SEQ ID NO: 231477 - DNA, 495 bp, Homo sapiens
  misc_feature: GYAE6OF02FM4D6.13.11.A11.1.454.CMB.1.raw
  modified_base (476)..(476): a, c, t, g, unknown or other
  misc_feature (476)..(476): n is a, c, g, or t
  modified_base (478)..(479): a, c, t, g, unknown or other
  misc_feature (478)..(479): n is a, c, g, or t
  modified_base (481)..(495): a, c, t, g, unknown or other
  misc_feature (481)..(495): n is a, c, g, or t
tcagtcacgtactacacgaccggtgctcgatttagctacgactgcagggccagtcagagtgttagcagcagcttagcctggtaccagcagaagcctggccaggctcccaggcctcctcatttatggtgcatccactagggccactggtgtcccagtcaggttcagcggcaggtgggtctgggacaggtacttccactctccaccactcagcagtcctgcctagtctagaagtacttttgacgtacgttctattactgtacagctaagttattacgttacgtaggtaacgtaccggttccggaccgaacgggtaccacggtacgtgggaacgaaggttaaacggaacgttagggtcggtactcgacctacctacgttcctggttaccttaccgtcctttcccgttaccccgtcacttcgtagtagttacggtacgttacgtacgtggacggccggtggtccgaggaacgtcgatagngnntnnnnnnnnnnnnnnn

SEQ ID NO: 231478 - DNA, 512 bp, Homo sapiens
  misc_feature: GYAE6OF02JKDPK.13.11.A11.1.454.CMB.1.raw
  modified_base (471)..(471): a, c, t, g, unknown or other
  misc_feature (471)..(471): n is a, c, g, or t
  modified_base (476)..(512): a, c, t, g, unknown or other
  misc_feature (476)..(512): n is a, c, g, or t
tcagtcacgtactacacgaccggtgctcgatttagctacgactgcagggccagtcagattgtcagcagcaactactcagcctggtaccagcagaagcctggccaggcccccaggcctcctcatctacgatgtattcaggaggaccactgacatcccagacaggttcaggtggcaggtgggtctgggacagacttcactctcaccatcagcacgactcggaaacctgaacgtacgtttgaccttattttacttctgtccacctaagtagtggtaggtccaccggttactacgttttcgggccgaggggaacctaagcgtggtaagactcggaagtacgaacgtggtacggtcgtagccaaccgtagtcgttacgtctttacgaccgtttccttcccgtacctattcgtacgtagtacgtacggtgtaccgttgacggcgggtcgacggcgtaacggtcgacgtataggcagntgatnnnnnnnnnnnnnnnnnnnnnnnnnnnnnnnnnnnnn

SEQ ID NO: 231479 - DNA, 958 bp, Homo sapiens
  misc_feature: GYAE6OF02IG5BN.13.11.A11.1.454.CMB.1.raw
tcagtcacgtactacacgaccggtgctcgatttagctacgactgcggggggtaagaggttgtgtccaccatggcctggactcctctcctcctcctgctcctctctcactgcacgaggttccctctcgcaggctgtgctgactcagccgtcttccctctctgtccttctcctggagcgtcacgcctagtctcacctgcctaccttgcgcgtaggtcggacacctaagttcggttcgtaccctatacgaactagttattagttcggtaaccgataggaacgtccggagggtaccttcccctaccctagtttccgtcctaggtacggttactacggtaacaaccgtctaaggtaaacgtaaccggacgtacgggtctcgtcgggaccctcccgacgtcccgtatttccgtcgcggtactaccgaagtgtacgtactcccggactaacggacggtaggtaacttacgttaccgacgtacttcgtaccgggttcggtaccctcgtacgttacgtacggtaaacgtcgtacgggacgttacggttaaccgttaaccgttttaacggttttaccgggtttacgggttttaaccgtaccgggtttaaccggttaacccgaaacccgttaaaccgggtaccccgttaaacccggggtttggtttaaacccccgtttaccccgggttttaccccgggggtaaaaccccgggtttccgggggttaaaaacccccccgtaccgggggttttaacccccccttaaccccccggggggttttaaccgtaacccggggggtttacccccccaaaaacccgggggttaaccccccccccgtttaaaaccgggggtacccccccccctttaaaacccccggggttacggtttaaacccccccggtttacccggtttaaaacccccggttttccccccccgggttttaaaccccccgggtttaacccccccccccc

SEQ ID NO: 231480 - DNA, 725 bp, Homo sapiens
  misc_feature: GYAE6OF02FSOJG.13.11.A11.1.454.CMB.1.raw
  modified_base (230)..(230): a, c, t, g, unknown or other
  misc_feature (230)..(230): n is a, c, g, or t
tcagtcacgtactacacgaccggtgctcgatttagctacgactgcaggggagaagagctgctcagttaggacccagagggaaccatggaaaccccagcgcagcttctcttcctcctgctactctggctcccagataccaccggagaaattgtgttgacgcagtctccaggcatcgtgtctttgtctccgaggggaaagcgcccacccttctcctagcagggccagtcagnttgtcagcagccaacgtacttacgccgtaggtacccagaccgaggaacgccttcggcccgaacgggccccccaagggtcctccgtctactccgtaacgattcgtacttcgaacggaacggtaccacgtgaacctagtccccgaaggtaccaggggttttaccaaggttcgggacgtagggttcggggttacctaggggaaccacggtaaccgtttacaccgttacctccgtaacccgaattacggacgacacggtaaccgtacgggtaaaccctaggtaaaaccgttacgtttagacccgttactttttaacgtttcctacgttactaacccgtagttacgttacgggttagttaccgaaccgttacgtacgttttacgggaccgtaacggggtaactagtcgtacgggtacgtacgtacgtaacggtcggtaaaccggttcggtaggtaccgtacggtaccgtaacctcgttaccgtctttcctacgttaaccg

SEQ ID NO: 231481 - DNA, 839 bp, Homo sapiens
  misc_feature: GYAE6OF02H72RL.13.11.A11.1.454.CMB.1.raw
  modified_base (304)..(304): a, c, t, g, unknown or other
  misc_feature (304)..(304): n is a, c, g, or t
tcagtcacgtactacacgaccggtgctcgatttagctacgactgcaggggtctgggagaggagccccagccctgagattcccaggtgtttccattcagtgatcagcactgaacacagaggactcaccatggagttgggactgagctggattttcctgctgcttaattttaaaaggtgtccagttgtgaggtgacaaggtggtaggaggtcggtggggggggctttagggttaacgccgggtggggggtccccttcgacgtaccttctccgtgttcgacctaaccgtcgtggtattctattttcnctggacgtccttggtgacggtcgtcgggtccgaccgacggtcccggtaccggggagggtcgtagggtaggtttcgggtcggaccgttaaggttaaagggtacggaagtactaggttacgggaccggaacaaacgtacggtaacttacgaggttaccggttacccggtaaggaaaacggtccgtaagtaacctttccgtaaacgttaacttaccgtaaaccgtaaaggtacggtaacgttaaccgtaaacgttaaaaccggaaaaagtaaagttaacgttaaacgtaatttaactaccgtaacggtaactaaagttaaccgaaaacgtaaaccgtaaaagggaaacggtaaccggaaacgggtaccaaacggttacggggtaaccgtttaaggttaaccgtttaacgtacggttaaacccaaggtaacggttacggtaaccgggcgtaacggtaacgtaccgtaacgtaaaggtccgggtaacccgggacccggttaacggtaccggtttaacccgggaccgttaaccccgggggg

SEQ ID NO: 231482 - DNA, 883 bp, Homo sapiens
  misc_feature: GYAE6OF02H987K.13.11.A11.1.454.CMB.1.raw
  modified_base (142)..(142): a, c, t, g, unknown or other
  misc_feature (142)..(142): n is a, c, g, or t
tcagtcacgtactacacgaccggtgctcgatttagctacgactgcagggggggacacagcctactctgaggcatcccttccagaagtcactatacagtaggagacatgcaaatggggtcctccctctgccgatagaaaaccngcccagccctgaccctgcagctcgtgggagaggacgcccccagtccctggagacttcccgagttgttcgcctagttccggtgattcagcgctagaacacgagaggacctcgccagttgggtagttgggctggtagtcgtttgggttttccttggttcgtacgtttaagttttaaaggtcgttacgtaggttggtcggtaggtcgacgtaggcgttggtaggtaggtcgggtgggggtaggtggttacgggtaccggggtcgggttaccggggggtccctacggacgttaccgtccgtacggttcgtacggtacccgtaaccgttcgggttacggtacctttcggtaacggttacgttttagggtaacgttagggttagttaacgttacgggacctttaaacgtaccgttaccgggttcccggggttaccccgtaacccgttaaacccgggtaccgggtaaacgggggtaacggggttctaccgggttacggttacggggtacggtttaccgttacgggtttaacgggttaaacgtttaaaccgggtaggtaaaccggggtttcggttccggggaaaccaacggttacccgtaaaccggtttaaccgtttacggtaccggaaccggtttaaccggttaccggttacggtttaaccggggtaacccgggttaacggggtaccccggttttaaacccggtttaaacggccccggttttaacccgttacccggtaaaacccgggg

SEQ ID NO: 231483 - DNA, 933 bp, Homo sapiens
  misc_feature: GYAE6OF02GBU4L.13.11.A11.1.454.CMB.1.raw
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttcctctctcgcttctccgtggagtcgtcagccagtcctcacctcgctaccgttcgcgctaggtcggccaaccgtaagttggtttaccggtcccctaagtcgaactacgttttaattacgttacggtaacccgaacgtaaggtaacggcccggaaggggtaccgtccccttccccgttaaggtttccctccggttaggtacggttttcgaacgggttaaccaaaacgttccgaaggtaaaacttaaaaccgggacgtacggggtaccctttacggtacggggtaaccgtaccccccgtacgggttccccggttccttttcccgtacgggtttaccggtaaaccgttacccgggtaaaaacggggttacgttaacggtttaaccctttacccccgggaacccggttaaaaccggtcgggtttaaacgggggtaacttttaacctttccgtaacttaccgttccggttaccgtcggggtaccctacccgggtaagttcccgtaagggtaaccgttagtacgggtacggttacctaggttaacctttaacggttttcgttgtttacgactttaccgggaccaacgtaacccgttacggtccgttaaggtccgttacggttaccgggaacccggttaccgggtaaccgttacccgggtacctacccggggttaaccggtcgggtaacctaaccccggggaaccccggttaacccggaaccccccgttaccgtacccgtttaaccggggttcccttaacccgttcccgggttaaccctttacccccccgg

SEQ ID NO: 231484 - DNA, 516 bp, Homo sapiens
  misc_feature: GYAE6OF02I9T2A.13.11.A11.1.454.CMB.1.raw
  modified_base (144)..(144): a, c, t, g, unknown or other
  misc_feature (144)..(144): n is a, c, g, or t
  modified_base (383)..(383): a, c, t, g, unknown or other
  misc_feature (383)..(383): n is a, c, g, or t
  modified_base (466)..(466): a, c, t, g, unknown or other
  misc_feature (466)..(466): n is a, c, g, or t
  modified_base (473)..(473): a, c, t, g, unknown or other
  misc_feature (473)..(473): n is a, c, g, or t
  modified_base (475)..(475): a, c, t, g, unknown or other
  misc_feature (475)..(475): n is a, c, g, or t
  modified_base (478)..(479): a, c, t, g, unknown or other
  misc_feature (478)..(479): n is a, c, g, or t
  modified_base (481)..(484): a, c, t, g, unknown or other
  misc_feature (481)..(484): n is a, c, g, or t
  modified_base (486)..(493): a, c, t, g, unknown or other
  misc_feature (486)..(493): n is a, c, g, or t
  modified_base (495)..(500): a, c, t, g, unknown or other
  misc_feature (495)..(500): n is a, c, g, or t
  modified_base (502)..(508): a, c, t, g, unknown or other
  misc_feature (502)..(508): n is a, c, g, or t
  modified_base (510)..(513): a, c, t, g, unknown or other
  misc_feature (510)..(513): n is a, c, g, or t
  modified_base (515)..(516): a, c, t, g, unknown or other
  misc_feature (515)..(516): n is a, c, g, or t
tcagtcacgtactacacgaccggtgctcgattttagctacgactgcagggccagtcagattgtcagcagcaactacttagcctggtaccagcagaagcctggcccaggcccccccaggcctcctcatctacgatgtattcaggngaccactgacatcccagacaggttcagtggcagtgggtctgggacagacttcactctcaccagtccagcagacctggaacctgaacgtactttgcttaacttttatttctcgtccacctagttatggtaggtcctaccgtactacgttttcggccgaacgggaccaacgtacgtaggagtactcgaagacgaacgtggtggtcgtcgccacattctgttccttacgtacttccgtcccncctactcgtacgtacgttagtaccgtacggacggtacggtacgggcggtcgggcggaaccggccgacgaacgttacggactgntcagtcngngcnngnnnnannnnnnnncnnnnnngnnnnnnnannnnann

SEQ ID NO: 231485 - DNA, 536 bp, Homo sapiens
  misc_feature: GYAE6OF02GFNJ8.13.11.A11.1.454.CMB.1.raw
  modified_base (182)..(182): a, c, t, g, unknown or other
  misc_feature (182)..(182): n is a, c, g, or t
  modified_base (434)..(434): a, c, t, g, unknown or other
  misc_feature (434)..(434): n is a, c, g, or t
  modified_base (446)..(446): a, c, t, g, unknown or other
  misc_feature (446)..(446): n is a, c, g, or t
  modified_base (453)..(453): a, c, t, g, unknown or other
  misc_feature (453)..(453): n is a, c, g, or t
  modified_base (455)..(455): a, c, t, g, unknown or other
  misc_feature (455)..(455): n is a, c, g, or t
  modified_base (458)..(458): a, c, t, g, unknown or other
  misc_feature (458)..(458): n is a, c, g, or t
  modified_base (461)..(461): a, c, t, g, unknown or other
  misc_feature (461)..(461): n is a, c, g, or t
  modified_base (465)..(465): a, c, t, g, unknown or other
  misc_feature (465)..(465): n is a, c, g, or t
  modified_base (469)..(469): a, c, t, g, unknown or other
  misc_feature (469)..(469): n is a, c, g, or t
  modified_base (471)..(471): a, c, t, g, unknown or other
  misc_feature (471)..(471): n is a, c, g, or t
  modified_base (473)..(473): a, c, t, g, unknown or other
  misc_feature (473)..(473): n is a, c, g, or t
  modified_base (477)..(477): a, c, t, g, unknown or other
  misc_feature (477)..(477): n is a, c, g, or t
  modified_base (481)..(481): a, c, t, g, unknown or other
  misc_feature (481)..(481): n is a, c, g, or t
  modified_base (483)..(484): a, c, t, g, unknown or other
  misc_feature (483)..(484): n is a, c, g, or t
  modified_base (486)..(486): a, c, t, g, unknown or other
  misc_feature (486)..(486): n is a, c, g, or t
  modified_base (492)..(492): a, c, t, g, unknown or other
  misc_feature (492)..(492): n is a, c, g, or t
  modified_base (497)..(497): a, c, t, g, unknown or other
  misc_feature (497)..(497): n is a, c, g, or t
  modified_base (499)..(499): a, c, t, g, unknown or other
  misc_feature (499)..(499): n is a, c, g, or t
  modified_base (506)..(506): a, c, t, g, unknown or other
  misc_feature (506)..(506): n is a, c, g, or t
  modified_base (508)..(508): a, c, t, g, unknown or other
  misc_feature (508)..(508): n is a, c, g, or t
  modified_base (510)..(510): a, c, t, g, unknown or other
  misc_feature (510)..(510): n is a, c, g, or t
  modified_base (512)..(512): a, c, t, g, unknown or other
  misc_feature (512)..(512): n is a, c, g, or t
  modified_base (520)..(520): a, c, t, g, unknown or other
  misc_feature (520)..(520): n is a, c, g, or t
  modified_base (533)..(533): a, c, t, g, unknown or other
  misc_feature (533)..(533): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggacactgacatcccagacaggttcagtgcagtgggctggganagacttcactctcaccatcagcagactggaacctgaacgacttttgactaaccttttatttccaggttaccaccaggtattacggtaggtcctaacgtacgactttttggaccgacggggtacccaaggtccgtagggaacgacgtacaaaggacgaactggtggctacgacacctatctgtactctatcctacccgctatctaacttagtacgttagactgaacggtccgggactcgggacaaacgggccncgtaagtacgancgtagcngnacntanagancganananaganacgnannanagacanacacnanagactananananagacgtanacgtactcgacgnacg

SEQ ID NO: 231486 - DNA, 652 bp, Homo sapiens
  misc_feature: GYAE6OF02HRK4F.13.11.A11.1.454.CMB.1.raw
  modified_base (551)..(551): a, c, t, g, unknown or other
  misc_feature (551)..(551): n is a, c, g, or t
  modified_base (564)..(564): a, c, t, g, unknown or other
  misc_feature (564)..(564): n is a, c, g, or t
  modified_base (574)..(574): a, c, t, g, unknown or other
  misc_feature (574)..(574): n is a, c, g, or t
  modified_base (581)..(581): a, c, t, g, unknown or other
  misc_feature (581)..(581): n is a, c, g, or t
  modified_base (583)..(583): a, c, t, g, unknown or other
  misc_feature (583)..(583): n is a, c, g, or t
  modified_base (590)..(590): a, c, t, g, unknown or other
  misc_feature (590)..(590): n is a, c, g, or t
  modified_base (642)..(642): a, c, t, g, unknown or other
  misc_feature (642)..(642): n is a, c, g, or t
  modified_base (652)..(652): a, c, t, g, unknown or other
  misc_feature (652)..(652): n is a, c, g, or t
tcagtcacgtactacacgaccggtgctcgatttagctacgactgcagggccagtcagattgtcagcagcaactacttagcctggtaccagcagagcctgccaggccccagctctcatctacgatgtattcgaggacggaccactgacactcccagactaggttcaggtgcaggttggtctgggacagtactttcactctaccacctatcgtacgcaagtacgtacggaacctaggtaacgttactttggaccttactttttacttcctggtaccaacctaggttagtacgggtacggttcctaaccgttactcggttttcggaccggaacgggtacctaggtacgtagggataacgtacgaacggtacgtaacggtcggtacggtcctacggctaccgtacgtttcgtacgttcctaacttccgtaccccgttccgtacctacggtttacttggaaacgggtttacaacccgggtttggtaacctcggggtaacccggggcccggttagtaccggacggaaaccgggtccgtaaccggtataccgggtaancgtacgacgtcgncgtcgtctcngtcgtcncncgtagtntcgtgtcagtcgtcgcgtctacgtctacgtgtcgtgcgagcgtgtcgacgcntcgcgtcgtn

SEQ ID NO: 231487 - DNA, 875 bp, Homo sapiens
  misc_feature: GYAE6OF02I55QI.13.11.A11.1.454.CMB.1.raw
  modified_base (237)..(237): a, c, t, g, unknown or other
  misc_feature (237)..(237): n is a, c, g, or t
  modified_base (764)..(764): a, c, t, g, unknown or other
  misc_feature (764)..(764): n is a, c, g, or t
tcagtcacgtactacacgaccggtgctcgatttagctacgactgcagggggggacacagcctactctgaggcatcccttccagaagtcactatacagtaggagacatgcaaatggggtcctccctctgccgatgaaaaccagccctagccctggaccctgccagctcgtagggagaggacgcccccagcccctgaacgtacttccccgacggttgtttcgacccgtagttttccggngtaacttccaggtccggtccttacggaaaaccaacgaagggaccggaaccgttccgacccgtagttaggggtacgttttcggggccgtaggtacggtccgtttcggggtttttcctttaggtttgtaccgttttaaagtttttaaaaggggttcttacccggtaaggttggttacgggtagggttcggtcgtaaggtcggttaggggtaaggtcggttggggtggggggttaacggttgggttcggggtaccggggtccgggttccggggggtacccttacggaccggttaccgttctccggttcgtacgtacccgtaaccgttcggtaggttaccttacgtaacggttgttttagacgttgttaagggtactacgggtacctagttacccgtaggttacccgggtaccctaccccggtaaccgttaaccggtacggggacgggtccgtaacggccgtagggttccggttcgtttacgtacggttaacgtaacggttacggtaacggttggaacctacccgggtaanacccgttaacgtaacgtttgtaaccgtcggaaccttaggttccggtaacgggtaacggttaaaccgggccggtttacttaccccgaaacggtttcccaccgttaaccccgg

SEQ ID NO: 231488 - DNA, 452 bp, Homo sapiens
  misc_feature: GYAE6OF02IFOP5.13.11.A11.1.454.CMB.1.raw
  modified_base (242)..(242): a, c, t, g, unknown or other
  misc_feature (242)..(242): n is a, c, g, or t
  modified_base (305)..(305): a, c, t, g, unknown or other
  misc_feature (305)..(305): n is a, c, g, or t
  modified_base (408)..(408): a, c, t, g, unknown or other
  misc_feature (408)..(408): n is a, c, g, or t
  modified_base (425)..(452): a, c, t, g, unknown or other
  misc_feature (425)..(452): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtgcaggtggtctgggacagacttcactctcaccatcagcagactggaacctgaagtactttgcctattttattcngtcaaccagtatggtaacggtctaaccgtactacgtttggccgaaggggtaccaagctagganatgaagcgaactggtgtctagccacgtactcgtacttcttctacttcctacccgtcaacttactattaacgtaccgttgtactagaggtcgggactacggganaagggccaggaataggnnnnnnnnnnnnnnnnnnnnnnnnnnnn

SEQ ID NO: 231489 - DNA, 466 bp, Homo sapiens
  misc_feature: GYAE6OF02GZDHL.13.11.A11.1.454.CMB.1.raw
  modified_base (141)..(141): a, c, t, g, unknown or other
  misc_feature (141)..(141): n is a, c, g, or t
  modified_base (298)..(298): a, c, t, g, unknown or other
  misc_feature (298)..(298): n is a, c, g, or t
  modified_base (303)..(303): a, c, t, g, unknown or other
  misc_feature (303)..(303): n is a, c, g, or t
  modified_base (327)..(327): a, c, t, g, unknown or other
  misc_feature (327)..(327): n is a, c, g, or t
  modified_base (332)..(332): a, c, t, g, unknown or other
  misc_feature (332)..(332): n is a, c, g, or t
  modified_base (338)..(338): a, c, t, g, unknown or other
  misc_feature (338)..(338): n is a, c, g, or t
  modified_base (423)..(423): a, c, t, g, unknown or other
  misc_feature (423)..(423): n is a, c, g, or t
  modified_base (426)..(426): a, c, t, g, unknown or other
  misc_feature (426)..(426): n is a, c, g, or t
  modified_base (428)..(428): a, c, t, g, unknown or other
  misc_feature (428)..(428): n is a, c, g, or t
  modified_base (430)..(433): a, c, t, g, unknown or other
  misc_feature (430)..(433): n is a, c, g, or t
  modified_base (435)..(466): a, c, t, g, unknown or other
  misc_feature (435)..(466): n is a, c, g, or t
tcagtcacgtactacacgaccggtgctcgatttagctacgactgcagggccagtcagattgtcagcagcaactacttagcctggtaccagcagaagcctggccaggccccccaggcctcctcatctacgatgtattcaggnggaccactgacatcccagacaggttcagtggcaggtgggtctgggacagtaccttcactcctacacctatcagcagactaggaacctgaagtctttgcttacttttattctgtctacctagtatggtagtcaccgtatcgtttgccgagggaccagntgganatacagcaactggtgctcgcactntcgtntcttcncttccttccccgctactcgtgtattacgtacgtcgacgttggccgggtcgggcttacgggacgtaacgggtcgacgtaagtacgngangntnnnntnnnnnnnnnnnnnnnnnnnnnnnnnnnnnnnn

SEQ ID NO: 231490 - DNA, 593 bp, Homo sapiens
  misc_feature: GYAE6OF02G50FU.13.11.A11.1.454.CMB.1.raw
  modified_base (381)..(381): a, c, t, g, unknown or other
  misc_feature (381)..(381): n is a, c, g, or t
  modified_base (386)..(386): a, c, t, g, unknown or other
  misc_feature (386)..(386): n is a, c, g, or t
tcagtcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgccaccttgcgcagtggcaccaatgttggtccctatgacatatattggtaccgacagaagccagggactccctccccagttctcctgaggttcaggtcaactcagataacgacgaggctcgtggacgtccccgagcccgtcgttctcgtggactccgaaggactgacttccgccaacggcgaggtatatacncatcncgtcggctaccagtctgacgatggacgcttagacttatttacctggtttacgacgttcggactaacgaacgacgtccgtaggacttccgtaccggaccttacgggacccgtacggtcccgtaccggttaccgtacggtaccgaccgtacccgaaccggaccccaaccccgtgttaccgtacctacccgttctacccggttccccccg

SEQ ID NO: 231491 - DNA, 490 bp, Homo sapiens
  misc_feature: GYAE6OF02I4WGY.13.11.A11.1.454.CMB.1.raw
  modified_base (185)..(185): a, c, t, g, unknown or other
  misc_feature (185)..(185): n is a, c, g, or t
  modified_base (347)..(347): a, c, t, g, unknown or other
  misc_feature (347)..(347): n is a, c, g, or t
  modified_base (368)..(368): a, c, t, g, unknown or other
  misc_feature (368)..(368): n is a, c, g, or t
  modified_base (382)..(382): a, c, t, g, unknown or other
  misc_feature (382)..(382): n is a, c, g, or t
  modified_base (446)..(446): a, c, t, g, unknown or other
  misc_feature (446)..(446): n is a, c, g, or t
  modified_base (450)..(450): a, c, t, g, unknown or other
  misc_feature (450)..(450): n is a, c, g, or t
  modified_base (452)..(452): a, c, t, g, unknown or other
  misc_feature (452)..(452): n is a, c, g, or t
  modified_base (457)..(457): a, c, t, g, unknown or other
  misc_feature (457)..(457): n is a, c, g, or t
  modified_base (459)..(460): a, c, t, g, unknown or other
  misc_feature (459)..(460): n is a, c, g, or t
  modified_base (463)..(490): a, c, t, g, unknown or other
  misc_feature (463)..(490): n is a, c, g, or t
tcagtcacgtactacacgaccggtgctcgatttagctacgactgcagggccagtcagattgtcagcagcaactacttagcctggtaccagcagaagcctggccaggccccccaggctcctcatctacgatgtattcaggagaccactgacatcccagacaggttcagtgcaggtggtctgggacngacttcactctcaccatccagcagacctcggaaccttggaagtactttcgacttaactttttatttcgtacttaccgacctagtagttcggtagtccacgttactacgttttcggaccgaggaccagcgtaggagtctagacgcgtaacgtgtcggtacgtnaccactacgtcttcgttcctntaccttccgtcccnctactctaggtatactaggtaccagttcggaggtcgcgtagcgaacgccgagtacgtagctagnacgncntgctnanncgnnnnnnnnnnnnnnnnnnnnnnnnnnnn

SEQ ID NO: 231492 - DNA, 499 bp, Homo sapiens
  misc_feature: GYAE6OF02GGLZT.13.11.A11.1.454.CMB.1.raw
  modified_base (384)..(384): a, c, t, g, unknown or other
  misc_feature (384)..(384): n is a, c, g, or t
  modified_base (469)..(469): a, c, t, g, unknown or other
  misc_feature (469)..(469): n is a, c, g, or t
  modified_base (473)..(474): a, c, t, g, unknown or other
  misc_feature (473)..(474): n is a, c, g, or t
  modified_base (476)..(499): a, c, t, g, unknown or other
  misc_feature (476)..(499): n is a, c, g, or t
tcagtcacgtactacacgaccggtgctcgatttagctacgactgcagggccagtcagattgtcagcagcaactacttagcctggtaccagcagaagcctggtcacggcccccaggctcctcatctacgatgtattcaggagaccactgacatcccagacaggttcagtggcaggtgggtctgggacagtacttcactctcaccatcagcagactggaacctgaacgtactttgacttacttttattctagtcaccgagttagtgggtacggtcctaccgtacttaccttttgggaccgacggggaacccaagccgtggagatacgaagcgaacgtggtagctcgctaccattccgttgttcccttcgtacttcccgtttccccnccgtacttcgtagtacttacggttaccgtcgtacgtagggacggtccggggtactcgggtaacgaacgggtccgataacgtagtncganngnnnnnnnnnnnnnnnnnnnnnnnn

SEQ ID NO: 231493 - DNA, 584 bp, Homo sapiens
  misc_feature: GYAE6OF02FUSJA.13.11.A11.1.454.CMB.1.raw
  modified_base (194)..(194): a, c, t, g, unknown or other
  misc_feature (194)..(194): n is a, c, g, or t
  modified_base (239)..(239): a, c, t, g, unknown or other
  misc_feature (239)..(239): n is a, c, g, or t
  modified_base (296)..(296): a, c, t, g, unknown or other
  misc_feature (296)..(296): n is a, c, g, or t
  modified_base (464)..(464): a, c, t, g, unknown or other
  misc_feature (464)..(464): n is a, c, g, or t
  modified_base (471)..(471): a, c, t, g, unknown or other
  misc_feature (471)..(471): n is a, c, g, or t
  modified_base (476)..(476): a, c, t, g, unknown or other
  misc_feature (476)..(476): n is a, c, g, or t
  modified_base (483)..(483): a, c, t, g, unknown or other
  misc_feature (483)..(483): n is a, c, g, or t
  modified_base (485)..(485): a, c, t, g, unknown or other
  misc_feature (485)..(485): n is a, c, g, or t
  modified_base (494)..(494): a, c, t, g, unknown or other
  misc_feature (494)..(494): n is a, c, g, or t
  modified_base (497)..(497): a, c, t, g, unknown or other
  misc_feature (497)..(497): n is a, c, g, or t
  modified_base (515)..(515): a, c, t, g, unknown or other
  misc_feature (515)..(515): n is a, c, g, or t
  modified_base (543)..(543): a, c, t, g, unknown or other
  misc_feature (543)..(543): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtggtctgggacagactttacnctcaccatcagcagactggaacctgaagctttgctattttattcngtcacagtatggtaggtcacgtacacttttggacctaggggaccaagcgttaggganaactcgaaagtcgaaacgtggtacggtctagccacctaagttcctacgttcttacacgttccttacccggcctaacttcgttagaacgtttaacggtaacggttccgaacgtttaggaagggtcccgggtaccttacggggaccaaagggtccgaacgttaataacgngtaacgngtagngacgacngntacgtagtntangtgtagagactcgtcgtntacgagacgtacgtactacgtatatagngtacacgtacgtagtacgtacacgtactagtagtactagac

SEQ ID NO: 231494 - DNA, 512 bp, Homo sapiens
  misc_feature: GYAE6OF02IPV36.13.11.A11.1.454.CMB.1.raw
  modified_base (460)..(460): a, c, t, g, unknown or other
  misc_feature (460)..(460): n is a, c, g, or t
  modified_base (469)..(469): a, c, t, g, unknown or other
  misc_feature (469)..(469): n is a, c, g, or t
  modified_base (475)..(476): a, c, t, g, unknown or other
  misc_feature (475)..(476): n is a, c, g, or t
  modified_base (480)..(483): a, c, t, g, unknown or other
  misc_feature (480)..(483): n is a, c, g, or t
  modified_base (485)..(487): a, c, t, g, unknown or other
  misc_feature (485)..(487): n is a, c, g, or t
  modified_base (489)..(512): a, c, t, g, unknown or other
  misc_feature (489)..(512): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctaggacagacttcactctcaccatcagcagactggactgaactctttgctacttttattctgtcacctagtatggtacgtcacgtactcgtttcggccgagggacctaagcgtggagtacgtacaacgacgaacgtggtcgctgacacctatcttacgtcttaccacttcccgttaccccgactctttaccgtaggtaaccgtttacggttaccgttggtaccgttgggaccgggtccggggtctacgggaccggaaacgggtcgtaacccgaagttcggngtcagtcancagtgnngtcnnnngnnncnnnnnnnnnnnnnnnnnnnnnnnn

SEQ ID NO: 231495 - DNA, 539 bp, Homo sapiens
  misc_feature: GYAE6OF02JCUCV.13.11.A11.1.454.CMB.1.raw
  modified_base (221)..(221): a, c, t, g, unknown or other
  misc_feature (221)..(221): n is a, c, g, or t
  modified_base (497)..(497): a, c, t, g, unknown or other
  misc_feature (497)..(497): n is a, c, g, or t
  modified_base (499)..(499): a, c, t, g, unknown or other
  misc_feature (499)..(499): n is a, c, g, or t
  modified_base (502)..(502): a, c, t, g, unknown or other
  misc_feature (502)..(502): n is a, c, g, or t
  modified_base (505)..(539): a, c, t, g, unknown or other
  misc_feature (505)..(539): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccaagacaggttcagtggcagtgggtctgggacagacttcactctcaccatcagcagactaggaaccngaagtcttttgctacttttattctgtccaccagttagtacggtagtccaccgtactacgtttcgggaccaggggaacccaaggtctagggatacgtacaaacggtccggtaaaccgttgggtcggtaccttaggaccctacgtaacctttcggttacgttccctttacgtaaccgttcccgtttaccccgaccctatttccgtagtaaacgttacgttacgtacggtactaggcgggtcgggtacgtggaccgaacgggccactaggtcggagtanancgntannnnnnnnnnnnnnnnnnnnnnnnnnnnnnnnnnn

SEQ ID NO: 231496 - DNA, 455 bp, Homo sapiens
  misc_feature: GYAE6OF02GPKAN.13.11.A11.1.454.CMB.1.raw
  modified_base (238)..(238): a, c, t, g, unknown or other
  misc_feature (238)..(238): n is a, c, g, or t
  modified_base (264)..(264): a, c, t, g, unknown or other
  misc_feature (264)..(264): n is a, c, g, or t
  modified_base (326)..(326): a, c, t, g, unknown or other
  misc_feature (326)..(326): n is a, c, g, or t
  modified_base (364)..(364): a, c, t, g, unknown or other
  misc_feature (364)..(364): n is a, c, g, or t
  modified_base (401)..(401): a, c, t, g, unknown or other
  misc_feature (401)..(401): n is a, c, g, or t
  modified_base (403)..(403): a, c, t, g, unknown or other
  misc_feature (403)..(403): n is a, c, g, or t
  modified_base (408)..(409): a, c, t, g, unknown or other
  misc_feature (408)..(409): n is a, c, g, or t
  modified_base (411)..(411): a, c, t, g, unknown or other
  misc_feature (411)..(411): n is a, c, g, or t
  modified_base (415)..(415): a, c, t, g, unknown or other
  misc_feature (415)..(415): n is a, c, g, or t
  modified_base (417)..(417): a, c, t, g, unknown or other
  misc_feature (417)..(417): n is a, c, g, or t
  modified_base (421)..(421): a, c, t, g, unknown or other
  misc_feature (421)..(421): n is a, c, g, or t
  modified_base (423)..(427): a, c, t, g, unknown or other
  misc_feature (423)..(427): n is a, c, g, or t
  modified_base (429)..(430): a, c, t, g, unknown or other
  misc_feature (429)..(430): n is a, c, g, or t
  modified_base (433)..(435): a, c, t, g, unknown or other
  misc_feature (433)..(435): n is a, c, g, or t
  modified_base (437)..(443): a, c, t, g, unknown or other
  misc_feature (437)..(443): n is a, c, g, or t
  modified_base (445)..(452): a, c, t, g, unknown or other
  misc_feature (445)..(452): n is a, c, g, or t
  modified_base (454)..(455): a, c, t, g, unknown or other
  misc_feature (454)..(455): n is a, c, g, or t
tcagtcacgtactacacgaccggtgctcgatttagctacgactgcagggccagtcagattgtcagcagcaactacttagcctggtaccagcagaagcctggccaggcccccaggctcctcatctacgatgtattcaggagaccactgacatcccagacaggttcagtgcagtggtctgggacagacttcactctcaccatcagcagactgaacctgaagactttgctactttatttcngtcaccagtatggtagtcaccgtacnctttttggccaaggggtaccaaagtctaggagatcaagcgaacctggtgatcgcaccatctntcttcacttcttcccgcgtatctgtactaagtacgttnactagagcgggtctaggctaacggcgtcgagttacgngntcganncngtcngnactnannnnncnntcnnnannnnnnncnnnnnnnnann

SEQ ID NO: 231497 - DNA, 487 bp, Homo sapiens
  misc_feature: GYAE6OF02IGMC8.13.11.A11.1.454.CMB.1.raw
  modified_base (296)..(296): a, c, t, g, unknown or other
  misc_feature (296)..(296): n is a, c, g, or t
  modified_base (428)..(428): a, c, t, g, unknown or other
  misc_feature (428)..(428): n is a, c, g, or t
  modified_base (435)..(435): a, c, t, g, unknown or other
  misc_feature (435)..(435): n is a, c, g, or t
  modified_base (437)..(437): a, c, t, g, unknown or other
  misc_feature (437)..(437): n is a, c, g, or t
  modified_base (440)..(440): a, c, t, g, unknown or other
  misc_feature (440)..(440): n is a, c, g, or t
  modified_base (444)..(445): a, c, t, g, unknown or other
  misc_feature (444)..(445): n is a, c, g, or t
  modified_base (448)..(448): a, c, t, g, unknown or other
  misc_feature (448)..(448): n is a, c, g, or t
  modified_base (450)..(452): a, c, t, g, unknown or other
  misc_feature (450)..(452): n is a, c, g, or t
  modified_base (455)..(457): a, c, t, g, unknown or other
  misc_feature (455)..(457): n is a, c, g, or t
  modified_base (459)..(459): a, c, t, g, unknown or other
  misc_feature (459)..(459): n is a, c, g, or t
  modified_base (461)..(461): a, c, t, g, unknown or other
  misc_feature (461)..(461): n is a, c, g, or t
  modified_base (463)..(473): a, c, t, g, unknown or other
  misc_feature (463)..(473): n is a, c, g, or t
  modified_base (476)..(481): a, c, t, g, unknown or other
  misc_feature (476)..(481): n is a, c, g, or t
  modified_base (483)..(486): a, c, t, g, unknown or other
  misc_feature (483)..(486): n is a, c, g, or t
tcagtcacgtactacacgaccggtgctcgatttagctacgactgcagggccagtcagattgtcagcagcaactacttagcctggtaccagcagaaagcctggccaggccccccaggctcctcatctacgatgtattcaggaggaccactgacatcccagaaaggttcagtggcagtcgggtctgggacagacttcactctcaccatcagctagactggaacctgagactttgctactttatttctgtcacagtatggtagtcaccgtatacttttggccaggggaccaagctgganatacaagcgtaactgtggatgcaccatctcgtcttacgatccctttaccggcctattcgtacagttaaagtaccgtagtacgtacgaacgggccgggtcaggggaccaaagggtcccggcctaaagttacgngttaagncngantcgnnctnannnacnnncnancnnnnnnnnnnncgnnnnnntnnnna

SEQ ID NO: 231498 - DNA, 782 bp, Homo sapiens
  misc_feature: GYAE6OF02GNV9D.13.11.A11.1.454.CMB.1.raw
tcagtcacgtactacacgaccggtgctcgatttagctacgactgcagggggggacacagcctactctgaggcatcccttccagaagtcactatacagtaggagacatgcaaatgggtcctccctctgccgatgaaaaccagcccagccctgaccctgcagctcgtgggagacggacgccccagccctgagtacttcccgacgttgttcgcctagttcggtgactcgagcgactagaacacgaggacggactccgaccgagttggtaggttggccgtaggacgttcggtttcgggtttttcccttggtttacgtacgttttaaagttttaaaacgggtcgttaccgtaggttcggtggtaaggtcgacgtaggtcggttaggtaggtacggtcgggtagggggtaggttcggtcggggtaccggggtccgggttccggggggtccctaggtacgtccgtttccgtccgtggtacctaccgtaccgtcgtaggttacttcggtagttacggtttagtagtagtaagttggtaacgtctaaacgtacggtccggttacccgggtacccgtacccgtaaacccggtccgggaaacggggtaccgggtacgtcggcggtacgggttcggttcttacggtaacgttaagttaaccggtagggttaacggttcgggaccgttaacgacgtaaccgtaactttacggtagtccgaacggttaccgtacgttcgggttacggaccgggttaccgtccttaaccgttacccgacttaccgtccgtaacccgg

SEQ ID NO: 231499 - DNA, 630 bp, Homo sapiens
  misc_feature: GYAE6OF02F0XBZ.13.11.A11.1.454.CMB.1.raw
  modified_base (279)..(279): a, c, t, g, unknown or other
  misc_feature (279)..(279): n is a, c, g, or t
  modified_base (308)..(308): a, c, t, g, unknown or other
  misc_feature (308)..(308): n is a, c, g, or t
  modified_base (416)..(416): a, c, t, g, unknown or other
  misc_feature (416)..(416): n is a, c, g, or t
  modified_base (523)..(523): a, c, t, g, unknown or other
  misc_feature (523)..(523): n is a, c, g, or t
  modified_base (543)..(543): a, c, t, g, unknown or other
  misc_feature (543)..(543): n is a, c, g, or t
  modified_base (552)..(552): a, c, t, g, unknown or other
  misc_feature (552)..(552): n is a, c, g, or t
  modified_base (589)..(589): a, c, t, g, unknown or other
  misc_feature (589)..(589): n is a, c, g, or t
tcagtcacgtactacacgaccggtgctcgatttagctacgactgcagggccagtcagattgtcagcagcaactacttagcctggtaccagcagaagcctggccaggcccccaggtctcctcatctacgatgtattcaaggaggaccactgacactcccaagacaggtttcagtggacagtgggtctagggacagaaccttcaacttcgtaccaacctattcaacgccgtaagcgtacggtaacctagaacgttacttttggacttacgttttatttcgntacctacgtatagtgtaagtcaaccgttntactttgaccgagggaccaaggtcgtaggacgtacgtaacgaacgtacggtaatcggtaggtcctacgaactacctagtcttacgttcctcgtaaccttccgtacccnctaacgttcgtaacggttagtaacgtacgtacgtaccgtaggaccggtacgggcgtacgggtacgaacggggcctacgtaagtacgatcgctagactgacatcgtanagtagtcgagtaccgagacncgtaccagntacgtacagtacctgacgacctagtagccgtttaaanaccgtaacgtgacgtagtaacgtacgtacgtcgacgtaacg

SEQ ID NO: 231500 - DNA, 835 bp, Homo sapiens
  misc_feature: GYAE6OF02FTCCC.13.11.A11.1.454.CMB.1.raw
  modified_base (179)..(179): a, c, t, g, unknown or other
  misc_feature (179)..(179): n is a, c, g, or t
  modified_base (193)..(193): a, c, t, g, unknown or other
  misc_feature (193)..(193): n is a, c, g, or t
  modified_base (394)..(394): a, c, t, g, unknown or other
  misc_feature (394)..(394): n is a, c, g, or t
tcagtcacgtactacacgaccggtgctcgatttagctacgactgcaggggtctgggagaggagccccagccctgagattcccaggtgtttccattcagtgatcagcactgaacacagaggactcaccatggagttgggactgagctggtattttccgttttggtcttattttaaaggtntccagtgtgaagtncagctggtggagtcgtgggggagtcttcggtacagccgtggcgtacggtcccctaggacgtactcctccgtggtgaccaggccccttagtgggatttcagttccgttttgattcgtatttagtcgaccagttacggccgttacggttcgggtacccggacaaccggtccgtaccgggaaggggtacgggtcgttacggggngggttacggggttcctacggttaagggttacgttttaaggttacggggtaaacgttagggttaggttaaaacgtacggttaaacgggtacttaggtaccggtagggtaccttcggttaggtacggggtaacggtccgtaacgttccgaaccgtctccgtaccgacgtacgaacccgaaaccggaaccgtacgtaaacccgttccgttaacgtaaccgttactacgggtaactaacggtaacgtaacggttaaccgttacgtagggaaaccgttcggtaacggtacgggtaacgtaccccgggttagggttaacccgtttacgtttaaacggtttaccgggttaacggtaacccgtttaaaaccggggaaaccgttttcccggttaaaggttttacccgggtaacggtttaccgggtaccggttcccggttttaaccccggg

SEQ ID NO: 231501 - DNA, 270 bp, Homo sapiens
  misc_feature: GYAE6OF02GCVNZ.13.11.A11.1.454.CMB.1.raw
  modified_base (183)..(183): a, c, t, g, unknown or other
  misc_feature (183)..(183): n is a, c, g, or t
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (220)..(270): a, c, t, g, unknown or other
  misc_feature (220)..(270): n is a, c, g, or t
tcagtcacgtactacacgaccggtgctcgatttagctacgactgcagggtggaggctgaggatgttattgggctctattattgcatgcaagcaacacactggccgtacacttttggccaggggaccaagctggagatcaatcgaactgtggctgcaccatctgtcttcatcttcccgccatcngatagacgtgactgagcgggntggcaaggcncatagnnnnnnnnnnnnnnnnnnnnnnnnnnnnnnnnnnnnnnnnnnnnnnnnnnn

SEQ ID NO: 231502 - DNA, 123 bp, Homo sapiens
  misc_feature: GYAE6OF01CDWGV.51.70.G04.1.454.CMB.1.raw
  modified_base (117)..(123): a, c, t, g, unknown or other
  misc_feature (117)..(123): n is a, c, g, or t
tcagcgatcgtatacacgaccggtgctcgatttagtgtagtgtgaagggaaagggcagcgtcactctgttcccgccctcctctcgtagcactctgagcggctggcaaggcgcatagnnnnnnn

SEQ ID NO: 231503 - DNA, 118 bp, Homo sapiens
  misc_feature: GYAE6OF01EOJL7.51.70.G04.1.454.CMB.1.raw
  modified_base (118)..(118): a, c, t, g, unknown or other
  misc_feature (118)..(118): n is a, c, g, or t
tcagcgatcgtatacacgaccggtgctcgatttagtgtagtgtgaagggaaagggcagcgtcactctgttcccaccctcctctcgtagcactctgagcgggctggcaaggcgcatagn

SEQ ID NO: 231504 - DNA, 126 bp, Homo sapiens
  misc_feature: GYAE6OF01B6436.51.70.G04.1.454.CMB.1.raw
  modified_base (111)..(111): a, c, t, g, unknown or other
  misc_feature (111)..(111): n is a, c, g, or t
  modified_base (117)..(126): a, c, t, g, unknown or other
  misc_feature (117)..(126): n is a, c, g, or t
tcagcgatcgtatacacgaccggtgctcgatttagtgtagtgtgaagggaaagggcagcgtcactctgttcccaccctcctctcgtagcactctgagcggctggcaaggcncatagnnnnnnnnnn

SEQ ID NO: 231505 - DNA, 134 bp, Homo sapiens
  misc_feature: GYAE6OF01B1S5Q.51.70.G04.1.454.CMB.1.raw
  modified_base (119)..(134): a, c, t, g, unknown or other
  misc_feature (119)..(134): n is a, c, g, or t
tcagcgatcgtatacacgaccggtgctcgatttagtgtagtgtgaagggaaagggcagcgtcactctgttcccgccctcctctacgtagccacctgagcgggctggcaaggcgcatagnnnnnnnnnnnnnnnn

SEQ ID NO: 231506 - DNA, 118 bp, Homo sapiens
  misc_feature: GYAE6OF01C06MQ.51.70.G04.1.454.CMB.1.raw
  modified_base (118)..(118): a, c, t, g, unknown or other
  misc_feature (118)..(118): n is a, c, g, or t
tcagcgatcgtatacacgaccggtgctcgatttagtgtagtgtgaagggaaagggcagcgtcactctgttcccgccctcctctcgtagcactctgagcgggctggcaaggcgcatagn

SEQ ID NO: 231507 - DNA, 117 bp, Homo sapiens
  misc_feature: GYAE6OF01BGE49.51.70.G04.1.454.CMB.1.raw
tcagcgatcgtatacacgaccggtgctcgatttagtgtagtgtgaagggaaagggcagcgtcactctgttcccgccctcctctcgtagcactctgagcgggctggcaaggcgcatag

SEQ ID NO: 231508 - DNA, 118 bp, Homo sapiens; identical to SEQ ID NO: 231503
  misc_feature: GYAE6OF01BSU6B.51.70.G04.1.454.CMB.1.raw
  modified_base (118)..(118): a, c, t, g, unknown or other
  misc_feature (118)..(118): n is a, c, g, or t

SEQ ID NO: 231509 - DNA, 128 bp, Homo sapiens
  misc_feature: GYAE6OF01BZEP5.51.70.G04.1.454.CMB.1.raw
  modified_base (118)..(128): a, c, t, g, unknown or other
  misc_feature (118)..(128): n is a, c, g, or t
tcagcgatcgtatacacgaccggtgctcgatttagtgtagtgtgaagggaaagggcagcgtcactctgttcccgccctcctctcgtagcactctgagcgggctggcaaggcgcatagnnnnnnnnnnn

SEQ ID NO: 231510 - DNA, 121 bp, Homo sapiens
  misc_feature: GYAE6OF01D1YXR.51.70.G04.1.454.CMB.1.raw
  modified_base (117)..(121): a, c, t, g, unknown or other
  misc_feature (117)..(121): n is a, c, g, or t
tcagcgatcgtatacacgaccggtgctcgatttagtgtagtgtgaagggaaagggcagcgtcactctgttcccaccctcctctcgtagcactctgagcggctggcaaggcgcatagnnnnn

SEQ ID NO: 231511 - DNA, 399 bp, Homo sapiens
  misc_feature: GYAE6OF01B4M6Q.51.70.G04.1.454.CMB.1.raw
  modified_base (391)..(399): a, c, t, g, unknown or other
  misc_feature (391)..(399): n is a, c, g, or t
tcagcgatcgtatacacgaccggtgctcgatttagtgtagtgtgaagggaaagggtatgatgtacactggtaccagcagcttccaggaacagcccccaaactcctcatttattctaacacccatcggccctcaggggtccctgatcgattctctggctccaagtctggcacctcagcctccctggccatcactggactccaggctgaggatgaggctgattattactgccagtcctatgacatcagcctgagtcgttcgtggtattcgggcggaggaccagactgaccgtctaagtcacgcccaaggcctcgcccccgtcggtcactctcgttccccaccctcctctccgtagccacctctggagtcgggctcggacgacgggcgcatagnnnnnnnnn

SEQ ID NO: 231512 - DNA, 117 bp, Homo sapiens
  misc_feature: GYAE6OF02GE9LP.51.70.G04.1.454.CMB.1.raw
  modified_base (117)..(117): a, c, t, g, unknown or other
  misc_feature (117)..(117): n is a, c, g, or t
tcagcgatcgtatacacgaccggtgctcgatttagtgtagtgtgaagggaagggcagcgtcactctgttcccaccctcctctcgtagcactctgagcgggctggcaaggcgcatagn

SEQ ID NO: 231513 - DNA, 119 bp, Homo sapiens
  misc_feature: GYAE6OF02IRRHS.51.70.G04.1.454.CMB.1.raw
  modified_base (118)..(119): a, c, t, g, unknown or other
  misc_feature (118)..(119): n is a, c, g, or t
tcagcgatcgtatacacgaccggtgctcgatttagtgtagtgtgaagggaaagggcagcgtcactctgttcccgccctcctctcgtagcactctgagcgggctggcaaggcgcatagnn

SEQ ID NO: 231514 - DNA, 118 bp, Homo sapiens; identical to SEQ ID NO: 231503
  misc_feature: GYAE6OF02HP8TI.51.70.G04.1.454.CMB.1.raw
  modified_base (118)..(118): a, c, t, g, unknown or other
  misc_feature (118)..(118): n is a, c, g, or t

SEQ ID NO: 231515 - DNA, 118 bp, Homo sapiens; identical to SEQ ID NO: 231503
  misc_feature: GYAE6OF02HTUFH.51.70.G04.1.454.CMB.1.raw
  modified_base (118)..(118): a, c, t, g, unknown or other
  misc_feature (118)..(118): n is a, c, g, or t

SEQ ID NO: 231516 - DNA, 118 bp, Homo sapiens; identical to SEQ ID NO: 231503
  misc_feature: GYAE6OF02IGPAQ.51.70.G04.1.454.CMB.1.raw
  modified_base (118)..(118): a, c, t, g, unknown or other
  misc_feature (118)..(118): n is a, c, g, or t

SEQ ID NO: 231517 - DNA, 117 bp, Homo sapiens; identical to SEQ ID NO: 231507
  misc_feature: GYAE6OF02IIWB7.51.70.G04.1.454.CMB.1.raw

SEQ ID NO: 231518 - DNA, 117 bp, Homo sapiens
  misc_feature: GYAE6OF02G5IPB.51.70.G04.1.454.CMB.1.raw
tcagcgatcgtatacacgaccggtgctcgatttagtgtagtgtgaagggaaagggcagcgtcactctgttcccaccctcctctcgtagcactctgagcgggctggcaaggcgcatag

SEQ ID NO: 231519 - DNA, 118 bp, Homo sapiens; identical to SEQ ID NO: 231506
  misc_feature: GYAE6OF02H15HU.51.70.G04.1.454.CMB.1.raw
  modified_base (118)..(118): a, c, t, g, unknown or other
  misc_feature (118)..(118): n is a, c, g, or t

SEQ ID NO: 231520 - DNA, 118 bp, Homo sapiens; identical to SEQ ID NO: 231506
  misc_feature: GYAE6OF02F4T4Z.51.70.G04.1.454.CMB.1.raw
  modified_base (118)..(118): a, c, t, g, unknown or other
  misc_feature (118)..(118): n is a, c, g, or t

SEQ ID NO: 231521 - DNA, 118 bp, Homo sapiens; identical to SEQ ID NO: 231503
  misc_feature: GYAE6OF02H2UZH.51.70.G04.1.454.CMB.1.raw
  modified_base (118)..(118): a, c, t, g, unknown or other
  misc_feature (118)..(118): n is a, c, g, or t

SEQ ID NO: 231522 - DNA, 117 bp, Homo sapiens
  misc_feature: GYAE6OF02F6XYT.51.70.G04.1.454.CMB.1.raw
  modified_base (117)..(117): a, c, t, g, unknown or other
  misc_feature (117)..(117): n is a, c, g, or t
tcagcgatcgtatacacgaccggtgctcgatttagtgtagtgtgaagggaagggcagcgtcactctgttcccgccctcctctcgtagcactctgagcgggctggcaaggcgcatagn

SEQ ID NO: 231523 - DNA, 118 bp, Homo sapiens; identical to SEQ ID NO: 231503
  misc_feature: GYAE6OF02H664S.51.70.G04.1.454.CMB.1.raw
  modified_base (118)..(118): a, c, t, g, unknown or other
  misc_feature (118)..(118): n is a, c, g, or t

SEQ ID NO: 231524 - DNA, 119 bp, Homo sapiens
  misc_feature: GYAE6OF02G8HNE.51.70.G04.1.454.CMB.1.raw
  modified_base (118)..(119): a, c, t, g, unknown or other
  misc_feature (118)..(119): n is a, c, g, or t
tcagcgatcgtatacacgaccggtgctcgatttagtgtagtgtgaagggaaagggcagcgtcactctgttcccaccctcctctcgtagcactctgagcgggctggcaaggcgcatagnn

SEQ ID NO: 231525 - DNA, 117 bp, Homo sapiens; identical to SEQ ID NO: 231518
  misc_feature: GYAE6OF02FJ5AK.51.70.G04.1.454.CMB.1.raw

SEQ ID NO: 231526 - DNA, 117 bp, Homo sapiens; identical to SEQ ID NO: 231518
  misc_feature: GYAE6OF02GLIDF.51.70.G04.1.454.CMB.1.raw

SEQ ID NO: 231527 - DNA, 118 bp, Homo sapiens; identical to SEQ ID NO: 231503
  misc_feature: GYAE6OF02G7S31.51.70.G04.1.454.CMB.1.raw
  modified_base (118)..(118): a, c, t, g, unknown or other
  misc_feature (118)..(118): n is a, c, g, or t

SEQ ID NO: 231528 - DNA, 124 bp, Homo sapiens
  misc_feature: GYAE6OF02F2ZK5.51.70.G04.1.454.CMB.1.raw
  modified_base (117)..(124): a, c, t, g, unknown or other
  misc_feature (117)..(124): n is a, c, g, or t
tcagcgatcgtatacacgaccggtgctcgatttagtgtagtgtgaagggaaagggcagcgtcactctgttcccgccctctctcgtagcactctgagcgggctggcaaggcgcatagnnnnnnnn

SEQ ID NO: 231529 - DNA, 421 bp, Homo sapiens
  misc_feature: GYAE6OF02FKUNU.51.70.G04.1.454.CMB.1.raw
  modified_base (341)..(341): a, c, t, g, unknown or other
  misc_feature (341)..(341): n is a, c, g, or t
  modified_base (383)..(383): a, c, t, g, unknown or other
  misc_feature (383)..(383): n is a, c, g, or t
  modified_base (385)..(421): a, c, t, g, unknown or other
  misc_feature (385)..(421): n is a, c, g, or t
tcagcgatcgtatacacgaccggtgctcgatttagtgtagtgtgaagggaaagggtatgatgtacactggtaccagcagcttccaggaacagcccccaaactcctcatttattctaacacccatcggccctcaggggtccctgatcgattctctggctccaagtctggcacctcacgcctccctggccatcactggactccaggctgagatgaggctgattattactgccagtcctatgacatcagctgagtggttcgtggttattcggcggagggaccagactcgaccgtcctaagtcagcccgaagctcgccccctggcactctcttccccaccttccnctcgtacgcactcgtgacgcgggctggcgaaggcgacatagngnnnnnnnnnnnnnnnnnnnnnnnnnnnnnnnnnnnnn

SEQ ID NO: 231530 - DNA, 184 bp, Homo sapiens
  misc_feature: GYAE6OF02G25XY.51.70.G04.1.454.CMB.1.raw
  modified_base (122)..(184): a, c, t, g, unknown or other
  misc_feature (122)..(184): n is a, c, g, or t
tcagcgatcgtatacacgaccggtgctcgatttagtgtagtgtgaagggaaaggcagcgtcactctgttcccgcccgtcctcgtcgtagcactctggagcgggctggcaaaggcgctatagnnnnnnnnnnnnnnnnnnnnnnnnnnnnnnnnnnnnnnnnnnnnnnnnnnnnnnnnnnnnnnn

SEQ ID NO: 231531 - DNA, 541 bp, Homo sapiens
  misc_feature: GYAE6OF01AHTTS.43.44.D11.1.454.CMB.1.raw
tcagtgtgagtagtcacgaccggtgctcgatttagcgcagtacgaagggggccctgggagcacagctcagcaccatggactggacctggaggttcctctttgtggtggcaacagctacaggtgtccaatcccaggtgcaactgctgtagtctgggactgaggtgaaaaagcctgggtcctcagtgacggtgtcctgcaagtctaccggaggcatcttcagcagccaaactataagttgggtgcgacaggcccctggagaaggacttgaatggatggggggatcatcccgaggcttggaacaacaaactacgcacagaagtttcagggcagaatttcgattactgcggacgactccacgaccacggcctatttggaggtgagaggcctaacatctgacgacacggccgtctattactgtgcgagagaggcggtggactctgcttttgggagtttatggcgctgattattggggccaggggaacccagggtcacccggtctcttcagcctccaccaaagggcccatcggtcttcccccgtcgg

SEQ ID NO: 231532 - DNA, 662 bp, Homo sapiens
  misc_feature: GYAE6OF01DBQ4T.43.44.D11.1.454.CMB.1.raw
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgctgcagtctgggactgaggtgaaaaagcctgggtcctcagtgacggtgtcctgcaagtctaccggaggcatcttcagcagccaaactataagttgggtgcgacaggcccctggagaaggacttgaagtggagtgggggggatcgagtccccgaggtcttagggaacaacaaaactacgacacagtaagtttcagggcagaatttcgattactgcgacgactccacgaccacggcctattggaggtgagaggcctaacatcgtagacgacaccggcgttctattactgtcgcgagaggaggcggtaggactcgttggtcgtttggggtagttttagcgggtcggtccgttaggtagttttacggttcggggggacccgtaacgggggtaaaccccgtaggggttaccccgtaacccgggttcctttacccgtttccgaacccgttccccgtaccccgtaaaccccggaaacgggggtccccctaaacggttccccgggttccccgtttccccccccggg

SEQ ID NO: 231533 - DNA, 574 bp, Homo sapiens
  misc_feature: GYAE6OF01C1Q9X.43.44.D11.1.454.CMB.1.raw
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgctgcagtctgggactgaggtgaaaaagcctgggtcctcagtgacggtgtcctgcaagtctaccggaggcatcttcagcagccaaactataagttgggtgcgacaggcccctggagaaggacttgaatggagtggggggatcgagtcccgaggcttaggaacaacaaactacgacacagaagttcagggcagaattcgattactgcgacgactcacgacacgcctattggagtgagaggctaacatctagacgacacggccgtactattactgtgcgagagaggcggtggactctgtcgtttggggagtttagtgggtcgtcgtgtagttagttcgggggccacggggaacccgaggtaccgtaccggttcttccttcgacgtccctacccgaacccgaagggccccacgttccggtcccgtttcccccgg

SEQ ID NO: 231534 - DNA, 633 bp, Homo sapiens
  misc_feature: GYAE6OF01DTTPD.43.44.D11.1.454.CMB.1.raw
  modified_base (243)..(243): a, c, t, g, unknown or other
  misc_feature (243)..(243): n is a, c, g, or t
  modified_base (248)..(248): a, c, t, g, unknown or other
  misc_feature (248)..(248): n is a, c, g, or t
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgctgcagtctgggactgaggtgaaaaagcctgggtcctcagtgacggtgtcctgcaagtctaccggaggcatcttcagcagccaaactataagttgggtncgacnggcccctggagaaggacttagaatggagtgggggggatcgatcccgaggcttaggaacaaacgaaactacgcacagaagtttcaagggcaagaatttcgattactgcggacgactccacgaccacggcctatttcgggaggtgagaggcctaacgactacgtagacgacgacggccgttactattacgtgtcgtcgaggaggacgggtcgggtcggtaacgtctagggtcgttttaggggagttttagtcgggtcgtcgttgtagtttagttcgggggacctaacggggaaccccgtagggtccgtacccggttcttcgttacgacgccctacccgtaacccggaaacgggccccaaagttcccgggttcccttcccccccgggg

SEQ ID NO: 231535 - DNA, 569 bp, Homo sapiens
  misc_feature: GYAE6OF01DBP4S.43.44.D11.1.454.CMB.1.raw
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgctgcagtctgggactgaggtgaaaaagcctgggtcctcagtgacggtgtcctgcaagtctaccggaggcatcttcagcagccaaactataagttgggtgcgacaggccctggagaaggacttgaatggagtgggggggatcgagtccgaggcttagggaacaacaaactacgcaacagaagttcagggcagattcgattactgcgacgactccacgaccacggcctatttcggaggtgagaggacctaacatcgtgacgacgaccggccgtctattacgtgtgcgagagaggcgtggactctgtcgtttgggatttagtggtcgctgtattaggttgggacctaacgggacccgtaggtccgaccgttcttcgttcacgtccctacccgaccgaacgggccctacgtccggttcccttcccccgg

SEQ ID NO: 231536 - DNA, 595 bp, Homo sapiens
  misc_feature: GYAE6OF01BPQSZ.43.44.D11.1.454.CMB.1.raw
  modified_base (347)..(347): a, c, t, g, unknown or other
  misc_feature (347)..(347): n is a, c, g, or t
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgctgcagtctgggactgaggtgaaaagcctgggtcctcagtgacggtgtcctgcaagtctaccggaggcatcttcagcagccaaactataagttgggtgcgacaggcccctggagaaggacttgaatggagtggggggatcgagtcccgaggcttaggaacaacaaactacgcaacagaagttcaggacagtaattcgattacngcgacgactccacgaccacgcctagttggagtgagaggacctaacgatcgtacgtacgacgacggacctactacgttacgtgtcgacgtagagacgggcggtaggactacgtggtcgtttagggacgtttagcggtcgtcgtgtagtttagtcggggaccagggtacccgtagggtcctaccggttctcgttccgacgtccctaccgaccgtaacggcccctaacgttcccggtcccttaccccccgg

SEQ ID NO: 231537 - DNA, 699 bp, Homo sapiens
  misc_feature: GYAE6OF01BRRJS.43.44.D11.1.454.CMB.1.raw
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgctgcagtctgggactgaggtgaaaagcctgggtcctcagtgacggtgtcctgcaagtctaccggaggcatcttcagcagaccaaactataagttggtgcgacacggccctggagaaggacttgaagtggagtggggggatacgagtccggaggcgttaggaacaacaacgtacgacacagtaagttacgaggacaagtaattcgtattacgtgacggacgactaccgacgaccgacggccttagttaggaggtgacgacggtacctaacgtactacgtacgacggaacgtaccgggtccgttactaagttaccgtagtacgacggtagaggaggtcggtaggacgttcgtaggtcggtttagggtacgtttaggtgggtacgtacgttacggtaagtttagggttacggggtacccggtaacgggtaaccccgtaagggttacccgtaacccggttacggttaccgttaccggtaccgtaccccggttaccccgtaaacccggtaacccggggtacccctaaccggttccccgggttccccgtttaccccccggg

SEQ ID NO: 231538 - DNA, 613 bp, Homo sapiens
  misc_feature: GYAE6OF01B3J1B.43.44.D11.1.454.CMB.1.raw
  modified_base (409)..(409): a, c, t, g, unknown or other
  misc_feature (409)..(409): n is a, c, g, or t
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgctgcagtctgggactgaggtgaaaaagcctgggtcctcagtgacggtgtcctgcaagtctaccggaggcatcttcagcagccaaactataagttgggtgcgacaggcccctggagaaggacttgaatgggagtggggggggatcgagtccccggaggtcttagggaaacaaaccgaaaacgtaaccgacaacgagaagttttaccagggcaagtaatttcgattactgcggacgactccacgaccacggcctagttggagtgagnggactaacatctgacgacgacggaccgtctattactgtgacgagaggaggcggtggactctgtcgtttgggtagtttagtggcgtgtgtagttagttcggggaccgtagggtaacccgagggttcccgtaaccggttccgttaccttcgaccgtcccgtacccaacccgacgggacccctcgttccggtcccgttaccccccgg

SEQ ID NO: 231539 - DNA, 682 bp, Homo sapiens
  misc_feature: GYAE6OF01BCX1S.43.44.D11.1.454.CMB.1.raw
tcagtgtgagtagtcacgaccggtgctcgatttagcgcagtacgaagggggccccgtgggagcacagctcagcaccatggactggacctggaggttcctctttgtggtggcaacagctacaggtgtccaatcccaggtgcaactgctgcagtctgggactgaggtgaaaagcctgggtcctcagtgacggtgtcctgcaagtctaccggaggcatcttcagcagccaaactataagttggtgcgacaggcccctggagaacggacttgaatggagtgggggggatcgagtcccgaggcgttaggaactaacaaacgtacgacacagaagtttcaggcagtattcgattactgcggacgactccacgtacacggacctacgtttaggaggtgaggtacggactaacatcgtgaaccgacgaccggtccgtactacttacgtggtagcggtagacggagggcgggtacggacttcgttgtcgtttaggggtagttttacggtggtcgtaccgttggtaacgtttagggttacggggaccgtaaccggggtaaccccgtagggttacccgtacccggttaccgttcccgtttacgtacccggtccccgtttaaccccgaacccggtaaaccgggggtaccccccttacggttacccccgggttccccgttttaccccccccgggg

SEQ ID NO: 231540 - DNA, 657 bp, Homo sapiens
  misc_feature: GYAE6OF01DZF5I.43.44.D11.1.454.CMB.1.raw
  modified_base (334)..(334): a, c, t, g, unknown or other
  misc_feature (334)..(334): n is a, c, g, or t
tcagtgtgagtagtcacgaccggtgctcgatttagcgcagtacgaagggggccccggtgggagcacagctcagcaccgatggacctggacctgggaggttccgtctttgtggtggcaacagcctacaggtgtccaatcccaggtgcaactgctgcagtctgggactgaggtgaaaagcctgggtcctgagtgacggtgtcctgcaagtcctaccggacggcatcttcagcagccaaactataagttgggtagcgacaggcccctggagaaggaccttgaatcggagtggggggaatccagtcccgaggtcttaggaacaacgaaactacgcaanagagtttcaggcagtattcgattactgcggactactccgacgaccacgacctagttggacggtgagtacgacctaacgactactacgacggaacacgggtacccgtcttagtacgtgtacgtacgaggtaggtacgggcgggtacgtacgtcgtgtcgtttacgggtagtttaagtgggtcgtcgttggtacgtttaggttcgggaccgtacggggaaccctacgggttccgacccggttcttaccgttccgaaccgttcccgtaacccgtacccggtaacccgggtccctaacggttcccggtccccgtttacccccccggg

SEQ ID NO: 231541 - DNA, 590 bp, Homo sapiens
  misc_feature: GYAE6OF01AUYPB.43.44.D11.1.454.CMB.1.raw
  modified_base (439)..(439): a, c, t, g, unknown or other
  misc_feature (439)..(439): n is a, c, g, or t
  modified_base (472)..(472): a, c, t, g, unknown or other
  misc_feature (472)..(472): n is a, c, g, or t
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgctgcagtctgggactgaggtgaaaaagcctgggtcctcagtgacggtgtcctgcaagtctaccggaggcatcttcagcagccaaactataagttgggtgcgacaggcccctggagaggacttgaatggatgggggggatcgatcccggaggcttggaacaacgaaactacgacacagtaagtttcagggcagaatttcgattactgacggacgactccgacgaccacggtcctagtttggaggtgaggacgcctaacgatctgacgacgacggccgtctattactgtgcgagagnggcggtggacctcgtgtcgtttgggagtttagngggtcgtcgtgtagttagttggggacctagggtacccctagggtcccacggttcctacgttccgacgtccctaccgaacccgtacgggacccctacgtccggttcccttccccccggg

SEQ ID NO: 231542 - DNA, 679 bp, Homo sapiens
  misc_feature: GYAE6OF01D9PG3.43.44.D11.1.454.CMB.1.raw
  modified_base (429)..(429): a, c, t, g, unknown or other
  misc_feature (429)..(429): n is a, c, g, or t
tcagtgtgagtagtcacgaccggtgctcgatttagcgcagtacgaagggggccccgtgggagcacagctcagcaccatggactggaccctggaggttcctctttgtggtggcaacagctacaggtgtccaatcccaggtgcaactgactgtcagtctgggactgaggtagaaaacgcctgggtcctcagtggacggtgtcctgccaagtccgtaccggaggcagtccttcgagcagaccaaatataacgtgggtagacgacacggcccctaggagaagactggaagtggacggtggggggatcgacgtccggaggtcttaggaaaccaacgaactacgacaacgagtaagttcgagggacagtatttacgattacgtggacggacgactaccgaccgaccacgtctagttggagtgagacgacctaacntacgtgaccgtacgtaccgtcgtactattacgtgtagtaccgagaggtacggcggtggtactgtagtcgtttagggtacgtttaggtcggtcggttacgttgtaacggtttacgggtcggggaaccctaacggggtaaccgtacgggttacccgaaccggtttccgtacccgttccggacccggttacccctaacccgtacccgtaaccgggcccctttaccggtcccgttcccccgtttaccccccggg

SEQ ID NO: 231543 - DNA, 630 bp, Homo sapiens
  misc_feature: GYAE6OF01B2BIT.43.44.D11.1.454.CMB.1.raw
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgctgcagtctgggactgaggtgaaaaagcctgggtcctcagtgacggtgtcctgcaagtctaccggaggcatcttcagcagaccaaactataagttgggtgcgacacggccctggagaaggacttgaatggagtgggggggatcgagtccggaggcttaggaacaacgaaactacgacacagaagtttcagggcaagtaattcgattactgcggacgactcacgaccacggcctagttggaggtgagacgctaacatcgtgacacgacggccgtatacttactgtgcgagaggacggcggtggactcgtgtcgtttgggatttaggtcgggtcgcgttagtagtttacggtcggggtacccggtaacggggtaaccccgtagggttcccgtaccggttccttacgttccgaaccggtcccttaccccggtaaccggaacccgggtccccctaacggttccccgggttccccgtttacccccccgggg

SEQ ID NO: 231544 - DNA, 702 bp, Homo sapiens
  misc_feature: GYAE6OF01AJVQX.43.44.D11.1.454.CMB.1.raw
  modified_base (242)..(242): a, c, t, g, unknown or other
  misc_feature (242)..(242): n is a, c, g, or t
  modified_base (275)..(275): a, c, t, g, unknown or other
  misc_feature (275)..(275): n is a, c, g, or t
  modified_base (556)..(556): a, c, t, g, unknown or other
  misc_feature (556)..(556): n is a, c, g, or t
tcagtgtgagtagtcacgaccggtgctcgatttagcgcagtacgaagggggccccgtgggagcacagctcagcaccatggactggacctggaggttcctctttgtggtggcaacagctacaggtgtccaatcccaggtgcaactgctgcagtctgggactgaggtgaaaagcctgggtcctcagtgacggtgtcctgcaagtctaccggagcatcttcagcagacctaactataaggttggngcgacgacggcccgtggagaaggtactagtagnggtagtaggggggtactcgacgtaccccggagggtaccttagggaaaccaaacgtaaacgtacgaccgaacgaggtaacgtttacggacgggactaagtaaacgtttccggtaattaccgtggaccggaacgtaccgtacccgacgaaccgaccggtaccttagttggaacggtggaacggacggtacctaacgtactacgtacggacgaccgtaccggtccgtacttaacgttctaggttcgacgtaggtaacgacgggcgttaggtaccgtcgttaggngtttagggtaagtttacggtcgggtcgtacgtgttagtttaggtccggggtactaacgggtaacccgcggtaccggtccttagttccgttcgaccgtacctacccgaccgtaacggcccctcggttccgttcccgttacccccggg

SEQ ID NO: 231545 - DNA, 887 bp, Homo sapiens
  misc_feature: GYAE6OF01DIZRR.43.44.D11.1.454.CMB.1.raw
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgctgcagtctgggactgaggtagaaaagccgtgggtcctcagtgacggttgtcctgactaagtcgtaccggaggctatctcagcagaccaaactagtaaggttgggtgacggacgacggcccgtaggaagaacggtacgttagtaaggtagggagggtggggggtactcgtacgtacccggtaggtacgttacgggaaaacctaaacgaaaccgtaacgaccgtaacgaaaggttaacggtttacggaggtactaagtaacgtttacgtaacgtttaccgtacggaccgggtaaccgtaacccgtacccgaaccggtaacccggtaaccggttacccgttaaggtttacggggtagggtacgggtaaacggtaccgggtaaacccgtaaacgtacgttacggttaacccggaaccggtaaccgtaccccgggtttaccgttaaccttaacgtttaccgtagggttaccggacgggaagggtacgggacgggtaccgggttacggtaaccgtttcggttcgggtttaccggttttaggggttacggttttacgggtcgggttccggtagtttacggttaaggttttacgggtcgggggtaaacccggtaacccggggtaacccggtacgggttaaccccgttcccggttaccctttacccggtaccgtacccgtaccccgtacccggtaaaccccgtaccgggtacccccgttcggttcccccggttccccgtttaccccccggg

SEQ ID NO: 231546 - DNA, 669 bp, Homo sapiens
  misc_feature: GYAE6OF01BGBVX.43.44.D11.1.454.CMB.1.raw
  modified_base (332)..(332): a, c, t, g, unknown or other
  misc_feature (332)..(332): n is a, c, g, or t
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgctgcagtctgggactgaggtgaaaaagcctgggtcctcagtgacggtgtcctgcaagtctaccggagcatcttcagcacgaccaaactataaggttgggtgcgacaggcccctggagaaggacttggaatggaggtgggggggatcgacgtcccggaggcgttaggaacaaacaaaccgtacgccganagtaacgtttacgagggcaaggtaatttcgaattacgtgacggacgactaccaccgaccacggtcctagtttggagtggagacggacctaagactcgtacgacgacgaccggccgttactacgttacgtgtaggacgaaggtaggagggtcggtagggtacttcggtgggttcgttttaggggtacggttttagtcggggtaccgttacgttagtaggtttacggttacggggccgtaaccggggtaacccgtacggtcccgtaccgttcgtaccgttcgaccgtcccttacccgaccgtaccggaccctacgttcccggttcccgttacccccggg

SEQ ID NO: 231547 - DNA, 633 bp, Homo sapiens
  misc_feature: GYAE6OF01BKE53.43.44.D11.1.454.CMB.1.raw
  modified_base (526)..(526): a, c, t, g, unknown or other
  misc_feature (526)..(526): n is a, c, g, or t
  modified_base (563)..(563): a, c, t, g, unknown or other
  misc_feature (563)..(563): n is a, c, g, or t
tcagtgtgagtagtcacgaccggtgctcgatttagcgcagtacgaagggggcccctgggagcacagctcagcaccatggactggaccctggaggttcctctttgtggtggcaacagctacaggtgtccaatcccaggtgcaactgctgcagtctgggactgaggtgaaaaagcctgggtcctcagtgacggtgtcctgcaagtctaccggagcatcttcagcagaccaaactagtaaggttgggtgaccgacacggtcccctaggaagaaggtacttggaagtgggagtggggggatacgacgtacccggaggtacgttaggaaaccaactaaaccgtaccgacacgaagtaacggtttcaagggacagtaattacgaattacgtgacggacaccgtacccgacgaccgacggtccttagttggaggtgacgagaccctaagactacgtagaccgacgaccggtcgtactagttactagtcgacgagaggaggtcgggtagaccgtgtgtcgtttgggagtttagnggtcgactgtagttcggttggccgaacgggtacccgnggttaccaccgtctaccgttcgacgtccctacccgaccgaccggacccacgttcccggtccttcccccgg

SEQ ID NO: 231548 - DNA, 715 bp, Homo sapiens
  misc_feature: GYAE6OF01A46PZ.43.44.D11.1.454.CMB.1.raw
  modified_base (271)..(271): a, c, t, g, unknown or other
  misc_feature (271)..(271): n is a, c, g, or t
  modified_base (540)..(540): a, c, t, g, unknown or other
  misc_feature (540)..(540): n is a, c, g, or t
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaatgctgcagtctgggacgtgaggtgaaaaagacctgggtcctcagtgacggtgtcctgcaagtctaccggaggcatcttcagcagccaaactataagttgggtgcgacaggccctggagaaggacttgaanggtagtggggggagtcagtcccgaggcgttaggaacaaacaacctacgcaacaagtaacgtttcgagggctaacgaatttcgatacgttgacggacgacctcacgaccacggacctatttgggaggtagacgaacgggcctaacacgttactcggaacgacgtacggcccgttattacttaacgtgtcggtcgaacgggagtaacggggccgggtacgggtaaccgtttcttcggggtcgtttttaacgggggtaaggttttttaacgngggttaccgtcgtttaggtaacgttttacgttcggggggtacccgacgggggttaaacccccaagggttcccgtaacccgggtacctttcggttacccgtaccggtccccgttaccccgtaacccggaaaccggggttaccccacgttcccggggttacccctttcccccccggg

SEQ ID NO: 231549 - DNA, 704 bp, Homo sapiens
  misc_feature: GYAE6OF01AYETQ.43.44.D11.1.454.CMB.1.raw
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgctgcagtctgggactgaggtagaaaaagcctgggtcctcagtgacggtgtcctgcaagtctaccggagcatcttcagcagaccaaactataagttgggtgcgacacggcccgtggagaaggtacgttagaagtgggaggtggggggatcacgtcccggaggtcgttacggaaacaaacaaacgtacgacacgaagtaacgtttacgagggacaagtaagtttacgagttacgtggacggaccgacctaccgaaccgacccgacggtcgtagttacggaggtaggacgacggacctaacactcgtacgacgaccgaccggtaccgttacttacgttacgtgtacggacggaagaggtacgggcggttaggacttcgtcggttggtttagggtaagttttagacgggtcgtagttggtagtttacgggtaccggggtcggtaaccgggtacccgtacgggttacccgtcccgttaccttccgttaccggtcccgtaccctccccgggaaaccccgtaccgggtacccctaacggttccccgggttccccgttaccccccggg

SEQ ID NO: 231550 - DNA, 674 bp, Homo sapiens
  misc_feature: GYAE6OF01CBTSS.43.44.D11.1.454.CMB.1.raw
tcagtgtgagtagtcacgaccggtgctcgatttagcgcagtacgaagggggcccctgggagcacagctcagcaccatggactgaacctggaggttcctctttgtggtggcaacagctacaggtgtccaatcccaggtgcaactgctgcagtctgggactgaggtgaaaaagcctgggtcctcagtgacggtgtcctgcaagtctaccggaggcatcttcagcagccaaactataagttgggtgcgacaggcccctggagaaggactgaagtggagtgggggggatcgagtcccgaggcttaggaacaacaaactacgacacagaagttcgagggacaagtaatttcgaattacgtcggcggacgactcccgacgaacccgacggtaccgttacgtttgggacgggtcggaacggacgggtacctaacgtatacgtacggaccgaactaccgttccgttacttaactttactcggttgacgtaggaggacgggcgggtggtactcgtacgtcggtttagggtacgtttagtcggtcggtctaggtagtttaggttcgggggacccgtacggggacccgtacgggtacccgtacccggttacgttacccgttcaccgttaccctaccccgacccgaacgggtcccctacgttccccgggttccccttccccccggg

SEQ ID NO: 231551 - DNA, 706 bp, Homo sapiens
  misc_feature: GYAE6OF01DCZIB.43.44.D11.1.454.CMB.1.raw
  modified_base (211)..(211): a, c, t, g, unknown or other
  misc_feature (211)..(211): n is a, c, g, or t
  modified_base (371)..(371): a, c, t, g, unknown or other
  misc_feature (371)..(371): n is a, c, g, or t
tcagtgtgagtagtcacgaccggtgctcgatttagcgcagtacgaagggggcccctgggagcacagctcagcaccatggactggacctggaggttcctcttttgtggtggcaacagctacaggtgtccaatcccaggtgcaactgctgcagtctgggactgaggtagaaaagcctgggtcctcagtgacggtgtcctgcaagtctaccggnggcatcttcagcacgaccaaactagtaagtgggtgcgacacggccctaggagaaggtacttagaagtggaggtggggggatcgacgtcccggaggtcgttaggaaaccaacgaacgtacgacaacgagtaagttcgagggacaagtatttacgattacgngacggacacgtaccacgaccgacggtcttagttacggaggtagacgacggacctaacgtagtacgtacgaaccggaccgacggtccgttacttacgttacgtggtacggcgtagggacggacgggtcgggtacggtacgttcggttaggttcggtttacggggttaggtttacggtcgggtcggtacgtttaggtacggtttacgggtcgggtacccggtaacggggtaacccgtacgggttaccctaccggtttccttaccggttccgaccggtcccctaccccgacccggtaaccggccccgttacggttccccggttccccttacccccggg

SEQ ID NO: 231552 - DNA, 1010 bp, Homo sapiens
  misc_feature: GYAE6OF01CTBAP.43.44.D11.1.454.CMB.1.raw
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgctgcagtctgggactgaggtgaaaagcctgggtcctcagtgacggtgtcctgcaagtcgtaccggaggcgatcttcagcacgaccaaactagtaacggttgggtcgacgacgtacggcccgtagggacggaaggacttaggaagtgggaggtacgggggggataccgacgtccccggaggtacgtttacgggaacctaaaccgaaaccgttaccggaccgaaccgaacggttaaacggttttacccggaacggggtaccgtaaacggttaaacgtttttaccggaagttttaaccgtacgggtaccggtaaacccggtaacccgttaccccggaaaccccggtaaccccggtaaacccgggttacccgttaacggttttaacggggtacggggtttaacgggaaacgggtaaccgggttaaccccgttaaacgtaaccgtttaccggtaacgggtaaacccgtaccccgggtaacccggggtccccgtttaaccgtttaaacgttttaccggttacgggttacggtaccgggtaaagggtaaccgggtaacgggggtacccgggtttacgggtaacccgttttcggttacgggttttacgggttttaacggggttaacggtttttacgggttacggggttacccggtttacgttacgggttttaacggtttacgggggtttaccgggggtaacccgggttaaacccgggggttaaaccccggtacgggtttaccccgtttaaccccggttacccggtttacggttacccgggttaccccgtaccccgttaaccccggtaacccggtaacccggggttaccccctaacccgggtttccccgggtttaacccccgttttccccccggg

SEQ ID NO: 231553 - DNA, 675 bp, Homo sapiens
  misc_feature: GYAE6OF01CEC3S.43.44.D11.1.454.CMB.1.raw
  modified_base (367)..(367): a, c, t, g, unknown or other
  misc_feature (367)..(367): n is a, c, g, or t
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgctgcagtctgggactgaggtgaaaaagcctgggtcctcagtgacggtgtcctgcaagtctaccgggaggcatcttcagcagaccaaactataagtgggtgcgacaggccctggagaaggacttagaatgggagtgggggggatcgagtcccggaggcgttaggaaccaaacaaacgtacgacaacaggtaacgtttcgaggtcaagtaatttcgtaattacgnggtcggaacgacaccgtaccgaccacggtccttaagttcgggaggtcggaggacggtacctaacgatacgtagaccggtacaccgggtccgtacttacgttaactggtcggaccgtaagaggagggtcggtaggtacgtcgtaggtccgtttggggtaagttttacgtaggggtccgttggttacgttagttacgggtacggggtccgtaagggaccccggtaggtaccgtcccgttaacgtcccgttcgaccgtccgtacccggtaccgaacgggtacccctcgttacccggtcccttacccccggg

SEQ ID NO: 231554 - DNA, 714 bp, Homo sapiens
  misc_feature: GYAE6OF01DEYMF.43.44.D11.1.454.CMB.1.raw
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgctgcagtctgggactgaggtagaaaagcctgggtcctcagtgacggtgtcctgacaagtctaccggagcatcttacagcagaccaaactagtaacggttgggtgcgacacggaccctaggaagaaggacttagaagtgggaggtaggggggactcgacgtccggaggtacgtacggaaacaaacgaaacgtacgacgaacgagtaacgttcgaagggactaagtaactttacgattacgtggaccggaacgtaccgtacccaaccggaccgtaaccggtccttaagtttagggaggttagacggacgtacctaacacgtacgtacgaacgaccgtaccggtaccgttacttaattacgtacgtacggtacgaacggaggacgggtcggtacgtacgttcgtacggttcggtttagggtagttttaggcgggttacgtacggttagttacggttagggttccggggtacgtaaaccgggacccggttacggtccggtaccgtcttaccgtcgaccgtccccgtacccgaaccggaccggtacccacggttccccgtcccgttacccccggg

SEQ ID NO: 231555 - DNA, 688 bp, Homo sapiens
  misc_feature: GYAE6OF01CSVIT.43.44.D11.1.454.CMB.1.raw
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgctgcagtctgggactgaggtagaaaagcctgggtcctcagtgacggtgtcctgcagtctaccggagcatcttcagcagaccaaactagtaaggttgggtgacgacacggcccctagggaagaaggtacgttagaagtgggtaggtagggggggactacgacgtcccggaggtacgttacggaacaaacaactacgacaacgagtaagttcgaggtacaagtattacgatacgtcgacgacgactaccgacgacacgtctagttggaggtagagacgtactatactcgtagacgacgacggccgtactagttacgtgtgacgaggtacggaggtcgggtacgtacgttcgtcgggttacggttttagggtagttttacggtcgggtaccgtgtttacggtaggtttacggtaccggggtacccggtaacggggaaaccccggtacggtaccccgttacggttcccgttacgtaccgtaccgtcccgtaaccccgtaaccggaacccgggtcctaccggttccccgggttccccgttaccccccgg

SEQ ID NO: 231556 - DNA, 968 bp, Homo sapiens
  misc_feature: GYAE6OF01C3X93.43.44.D11.1.454.CMB.1.raw
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgctgcagtctgggactgaggtagaaaaagccgtgggtcctcgagtgacggtgtcctgcaagtctacggaggcatcttcagcagaccaaactagtaaggttgggtgacgacgacggccccgtaggaaggaaggtacgttaggaagtagggaggtagggggggtactacgacgtaccggaggtacgttaacggaaaccaaaccgtaaacgtacgactaacgtaaggttaacgtttacggacggtaacgtaacgttaaagtttaccgtaacgtttaacgtacggtaaccggttaaccgaacccgttaacccgaaccggtaacccgtaacccggtaccgtttaacggttttacggggaacgggtacgggtaacggtaacggtaacccgttaaaccgtaacgtttaccgtaacggtaaaccggtaaccgtacccgggtttacccgttaacgtttaaaccgtttacggtggttacggtaaccgggtaagggtaacgggttacggggtaccgggttacgggtaaccgtttcggtttacgggttaccgggtttttaagggggtaaccggtttttaacgggtcggggttaccggttaccggttagggttaacggttttaaccgggggttccgggggttaaacccgggaaccgggggttaaaacccccggtacgggtttaacccccggttaccccggtttaccgtttaccccggtttaacccggtacccggttaacccccccgttaaccccggtaaaccccgggtaaacccggggttacccccgttaacccgggttttccccccggttaaccccccggttttccccccccggggg

SEQ ID NO: 231557 - DNA, 729 bp, Homo sapiens
  misc_feature: GYAE6OF01CY8SG.43.44.D11.1.454.CMB.1.raw
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgctgcagtcgtgggactgaggtagaaaagcctgggtcctcgagtgacggtgtcctgacaagtccgtaccggagctatcttacagcacgacctaaactagtaacggttgggtcgacgtacgaccggcccgtaggagaaggtacgttggaagtaggaggtaggggggatacgacgtaccggaggtcgttaggaaaccaaacgaacgtacgacaacgaagtaacgtttcgaaggtactaagtattacgtacttacgtcgacggaccgactaccgaaccgtaccgtacggtacttaggttacggaggtagacggacgtaccgtaacgtacgtacgtacgacgtaaccgtacggtaccgttactacttacgtcggtagacggtaaggtaggtacggacggttcggtacgttggtacggttcgggtttaggtacgttttacggcggtcgttacgttagttaacgtttagggtaccggggaaccgtaaccgggacccgttaggtacccgtaccggttacgttccgtacgaccgtacccctaccgtaaccccgggactaccccgtacgttccccgggttcccttacccccgggg

SEQ ID NO: 231558 - DNA, 564 bp, Homo sapiens
  misc_feature: GYAE6OF01DT2L2.43.44.D11.1.454.CMB.1.raw
  modified_base (359)..(359): a, c, t, g, unknown or other
  misc_feature (359)..(359): n is a, c, g, or t
  modified_base (405)..(405): a, c, t, g, unknown or other
  misc_feature (405)..(405): n is a, c, g, or t
  modified_base (481)..(481): a, c, t, g, unknown or other
  misc_feature (481)..(481): n is a, c, g, or t
  modified_base (511)..(511): a, c, t, g, unknown or other
  misc_feature (511)..(511): n is a, c, g, or t
tcagtgtgagtagtcacgaccggtgctcgatttagcgcagtacgaagggggccccctgggagcacagctcagcaccatggactggacctggaggttcctctttgtggtggcaacagctacaggtgtccaatcccaggtgcaactgctgcagtctgggactgaggtgaaaaagcctgggtcctcagtgacggtgtcctgcaagtctaccggaggcatctcagcagccaaactataagttgggtgcgacacggcccctaggagaaggacttgaatgggagtgggggggatcgagtcccggaggcttaggaacaacaaacgtacgacacagaagtttcgagggacagtaatttacgattacngcggacgactccacgaccacggctattggaggtgaggaggcctaanatctagacgacacgcgtactattactgtcgcgagaggaggtcggtagctctgtcgtttgggagtttagtggtcgtnttggtattgttggggccctaagggacccgnggtcctacgtctctcacgcctaccacgacggcccacgtccgtccctcccccgg

SEQ ID NO: 231559 - DNA, 810 bp, Homo sapiens
  misc_feature: GYAE6OF01CC4BE.43.44.D11.1.454.CMB.1.raw
  modified_base (210)..(210): a, c, t, g, unknown or other
  misc_feature (210)..(210): n is a, c, g, or t
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgctgcagtctgggactgaggtagaaaagcctgggtcctcagtgacggtgtcctgcaagtctaccggngcactctcagctaacgaccaaactagttaaggtgggtgacgaccgcggtcccgtagggacgaaggtacgttaggaagtagggtagggtaggggggatcgtacgtcccggaggtcgttacggaaacaaaccgtaaaccgtacgactaacgaggtaacgttcgagggtacaagtaacgttcgtaagttacgtacggtaccggaccgacctacccgaaccgtaaccgtaccggtaccgttaaggtttacgggaacgggtacgaacgggtaaccggtaacctaacgtacgttacgtaccggtaaacccgtaccggaacccggttacccggttaaccttacggttacgtacggttacggaccgtaaggacgggtacggcgggtacgtacgttcggtaggttaccggtttgggttacgtttaggtcggggtctcgggttaagttcggtttacgggtcggggtaacccgtaacgggggacccccgttagggtcccgtaacccggtttccttaccggtcccgtaccggttacccccctaccgggtaccccgaaaccggggttccccaaacccgggtttttcccccggtccccggtttacccccccggg

SEQ ID NO: 231560 - DNA, 767 bp, Homo sapiens
  misc_feature: GYAE6OF01C5UX7.43.44.D11.1.454.CMB.1.raw
  modified_base (447)..(447): a, c, t, g, unknown or other
  misc_feature (447)..(447): n is a, c, g, or t
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgctgcagtctgggactgaggtagaaaagcctgggtcctcagtgacggtgtcctgacagtctaccggagcatctcagcacgaccaaactagtaaggttgggtgcgacacggtcccgtaggagaaggtacttagaagtgggaggtagggggggatcgagtcccggaggtcgttaggaacaaacaaacgtacgacaacaggtaagtttcgaagggactaagaatttacgattacgtgacggaacgtactaccgaaccgaccacggtcctagtttgggagggttagacggtaacggtacctaaacgtntaccgtacgaccgaaccgtacgggtacccgtacgttacttaacggtaggtacggacgaaggacggtacgggtcggggtcggtaacgtcgttacggttacggtttacgggtaacgttttaggtcgggtccggttcgttacgggttaagtttacggggtcggggtaaccccggtaacgggggtaaaccccgttagggtaccccgttaacccggttccgtttaccggttacctaccggtcccccgttaaaccccgtaaccccgggaaaccgggtacccccgttaaaccggttccccgggtttaccccgttaccccccccgggg

SEQ ID NO: 231561 - DNA, 851 bp, Homo sapiens
  misc_feature: GYAE6OF01AVWFZ.43.44.D11.1.454.CMB.1.raw
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgctgcagtcgtgggactggaggtagaaaacgcctcgggtcctcgagtggacggttgtcctgctaacgtccgtaccggaggctagtcttacgacgtcacgaccctaaactagttaaggttgggtacgaccgacgaccggtcccgtaggacggaaacggtacgttaggaagtgggtaagggtaggggggtaactcgacggtaccggtaggtacgttacggaaacctaaaaccgaaacgtaacggaccgaacgtaacggttaacggtttacgaagggtactaacggttaaacgtttaacgttaacgttaccgtcggggtaacggtaaccgtaccctaaccccggtaacggacccggaccggttaaccgtttaaggttacgggtaacgggtaggtaaccggtaccggtaaccctaaacggtcttaccggtaacggtacccgtaaccgtaccggttacccgttaacttaccttacggtcggtaacggtaggacggtaacgggacggtcggtacggtcttacggtcgtttacgggtttaggttaggttacggtagggtccgttacgttaggttaggttaccgggttacgggtaccggtaaccgggtaccggtaaccggtccgtaccggttcgttaccgtacccgtacggtaccccgttaccggacccgttaacccggtaccgtaccgtttcccgggtcccccgttacccccggg

SEQ ID NO: 231562 - DNA, 893 bp, Homo sapiens
  misc_feature: GYAE6OF01ED87U.43.44.D11.1.454.CMB.1.raw
tcagtgtgagtagtcacgaccggtgctcgatttagcgcagtacgaagggggcccctgggagcacagctcagcaccatggactggacctggaggttcctctttgtggtggcaacagctacaggtcgtccaatcccgaggtgcaactgctgcagtctggactgaggtagaaaaagccgtaggtcctcagtgacggtgtccgtgcgtaagtcgtaccggagctatcttcagacagacctaaacgtagtaaggttgggtagaccgtaccgacggtaccccgtagggaacgtaaaggtaccgttaggaaaggtaggggtaagggttacgggggggtaacgtaccgtaaccggtaccccggtaacgggtaccggtttaacggtaaaacccgtaaaaccggtaaaacccgttaaccggaaccgtaaaccggtaacggtaacggttttacggaacgggtaaccgtaaagttaaaccgttttacgtaacgttaaccgtacggtaccggtaaccgtaaccgttacccgaaaccggaacccgtaaccggtacccgtttaagtttacggggtaggtaacggtaacggaacggtaaccctaaacgtacgtacgtaaccggaaccgtacccgtacgggtacccgttaacgttaacgttaccgttagtacggaacggaaggtaggtacgggtcggtacggtaccgttgttacggttcggtttagggttagtttagtcgggtacgttcggttagtacgtttaacgggtccgggaaacccgtaacgggtacccgtacggttcccgtaccggtttaccgttcccgtttacccgaccgttaccccggaacccgtaacccggtaacccgggaccccctttacgggttcccccgttccccgttaacccccgggg

SEQ ID NO: 231563 - DNA, 703 bp, Homo sapiens
  misc_feature: GYAE6OF01B6WP5.43.44.D11.1.454.CMB.1.raw
tcagtgtgagtagtcacgaccggtgctcgatttagcgcagtacgaagggggccccctgggagcacagctcagcaccatggactggacctggaggttcctctttgtggtggcaacagctacaggtgtccaatcccaggtgcaactgctgcagtctgggactgaggtagaaaaagccgtgggtcctcagtgacggtgtcctgcagtctaccggagcatctcagcagccaaactataaggtggtgcgacgacggcccgtggacgaaggtacgttagaagtgggtaggtggggggatcgacgtcccggaggtcgttaggaaccaaacgaactacgacgacgaagtacgttacgaggtactaagtaagtttcgtagttactggacggacgaccgtaccgaccgacaccggtaccttagttggagtgacgacgtacctacacgtcgtacgaccgaacgaccgtccgtacgtaacttacgtacgtcgacgtaggacggacgggtcggtggtaaccgtcggtgttcgggtttagggttaaggttttacggcgggtacggtcgtttaggtaacgtttagggtaccggggaccgaccggggtaacccgtaacggttccccggttaccgttcgttacccgttccggaccgtcccgttaccccgaacccgttaccgggacccctttaccgtcccccggttcccgtttccccccgg

SEQ ID NO: 231564 - DNA, 813 bp, Homo sapiens
  misc_feature: GYAE6OF01AR4ZG.43.44.D11.1.454.CMB.1.raw
  modified_base (142)..(142): a, c, t, g, unknown or other
  misc_feature (142)..(142): n is a, c, g, or t
tcagtgtgagtagtcacgaccggtgctcgatttagcgcagtacgaagggggcccctgggagcacagctcagcaccatggactggacctggaggttcctctttgtggtggcaacagctacgaggtgtaccaactcccgaggtnacaactgctgacagtcgtggactaggtaggtaagaaacggtcgtcggtacctcgaggtacggtacggtcgtccgtagacgtaacgtaccgtacgggtacggactacgttactacgacgactaacgtaaccgtaaacgttagtaacggttcgggcgaccgaccgtacggccgtagggaacgtaacggtacgttaggaaggtacggggtagggtacgggggtacctacgtaccggtccggtaaggtaccgttaacggaaacctaaacgaccgtaacgacgaacgtaagttacgtacggacggacttaagttacgtacgttacgtacggtgaccgtaacgtcctaacggaaccgaccgtttaccgtacgtaacggtttcgggacgacgtaggtaccgtacttacgacgtacgacggtaaccacggtaccgtacttacgttaacgtcgtcgtaggacgtaggtacggtacgtacggtacggacgtttcgggtaacggttcgggtttaacgttagggttacggtcgggttacttaggttacggttagggttaccggtacgggtaccggtaccgggtaaccgtccgggtaccgtaccggttccgtaccgtaccggtacctcccggaaccgtcccggaacccggtacccgtcgggttaccccggttcccgtaacccgg

SEQ ID NO: 231565 - DNA, 864 bp, Homo sapiens
  misc_feature: GYAE6OF01CWPWW.43.44.D11.1.454.CMB.1.raw
  modified_base (200)..(200): a, c, t, g, unknown or other
  misc_feature (200)..(200): n is a, c, g, or t
  modified_base (230)..(230): a, c, t, g, unknown or other
  misc_feature (230)..(230): n is a, c, g, or t
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgcgtcgcacgtcgtgggactgaggtagaaaagtccgtggtcctcgagtggacggttntcctgacagtcgtaccggagctactctacngacacgacctaaactataggttggcgcgacgaccggccgtaggagtaaggtactagtagtggaggtgggggtatacgtacgtccggaggtacgtaacggaaccaaacgtaaccgtacgacaacgtaagttaacgttacgacggagtagtacgttacgtatacggtcggacgacgtacgtccgaccggaccgtacggtacttaggttacgggacggtagacggtacgtacgtaacgacgttctaacggaccgtaaccggaccggttaccgtacgtttacgttacgggtacgttggaccgtaaggacgggtacggttacgggtaccggttacgttcgggttttaccgggtttgggtttttaacggggtaggtttttaaggtaccggggttcggttaaccgtttacgggttaaccgggtttttcgggaaaccccggggggtaacccgggtttaaacccggggtaaccccccgggttaacgggtttaccccgtaaaccccgggttttccccgttaaacccggtttcccggtaacccccgtttaaccccccggttaccccggaaaaccccgggttaccccggtaacccccggtttacccccggggtttccccgtttacccccccggggtttcccccggg

SEQ ID NO: 231566 - DNA, 872 bp, Homo sapiens
  misc_feature: GYAE6OF01D5RQI.43.44.D11.1.454.CMB.1.raw
  modified_base (186)..(186): a, c, t, g, unknown or other
  misc_feature (186)..(186): n is a, c, g, or t
tcagtgtgagtagtcacgaccggtgctcgatttagcgcagtacgaaggggcccctgggagcacagctcagcaccatgactggacctggaggttcctctttgtggtggcaacagctacaggtgtccaatcccgaggtgcaactgctgcagtctgggactggaggtagaaaagccgtcggtacctcgngtggtacggtcgtccgtagcgtaacgtcgtaccgggaggctacttcgtcgacgacacgacctaaacgtaagttaggttggtcgacgacgacggccgtacgaggaagtcgttagaggtggtacgggtggggtacgtacgtaacggcccggtaggttacgtaaggaaaccgtaaacgtaaactaccggacaacgaacgggttaacgttacggaacggtacgtaacgtaagttaccgtaagttacggtcgaccggacgtacccaacgtaccgtaccccgaggtttaccgtaggttttaacgggacgggtacggtaacggtaaccgtaacccgttaaacgtacgttacgaacggtaacccgaaccgtaccgggtacccgttaacccggttaacgtttaccgtaggttacggtacgggtaacgggtacgggacgggtacgggtaccgggtaccttcgggttaacggtttaccgggtttagggttaacgggttttccggtacgggttacggttccggtttaacgggttaggtttaacgggttacccggggttaacgtaaccgggtaaaccgggttccggtaaacccggttcccggtttaaccgttacccggttccggtacccccggtacccgttacccgggaacccggttacccgcggtttcccccgggttacccgtccccggtaccccggg

SEQ ID NO: 231567 - DNA, 901 bp, Homo sapiens
  misc_feature: GYAE6OF01A0ECQ.43.44.D11.1.454.CMB.1.raw
  modified_base (877)..(877): a, c, t, g, unknown or other
  misc_feature (877)..(877): n is a, c, g, or t
tcagtgtgagtagtcacgaccggtgctcgatttagcgcagtacgaagggggcccctgggagcacagctcagcaccatggactggacctggaggttcctctttgtggtggcaacagcttacgaggtgtaccaacttcccgaggtcgaccaacgtgctgctaggtcgtgggactggagtagaaacgtccgtggtctcagtcgtcggtctccgtgacgtagtcgtaccgggagactcgtctagacgtccgacgtaacctaaacgttagttaacggttcgggtacgaccgtaaccggtaccggtcccggttaggaacggaaccggttacgttaaggtaaggtgggggtaagggttaccggggggtacttaccgtacggggtacccggtaaggtacccggttaaacggaaacccgtaaaaccgtaaccgtaaccgaacgtaacggtaacggttaaccgggttaccggagggaacgtaacggttaacgtttaacgtacgttaccggtacggtaacccgtaccgtaaccgtacccgaacccggaacccgtaccgggttaccgttaacggggttaggtacgggttaacggaaccgggtaccaaccgttaacgccgtttaaccggaccgaccggtaaccggtacccggttcttacccggttacgttcggttacgggacgtaaccggggtaaggtacgggtaagggacccgggttatcccggtttcgggtaagggttttccgggttaacgggtttcggtttaacgggcgggtacgttcggttacggttaccggtttaacggggtccggggaacgtaccgggttaccggtccgttaaccggtccttacgtcgtacccgaccgtaccgaccgtaccggaccgttacccncccggtccgttaccccggtcccgg

SEQ ID NO: 231568 - DNA, 805 bp, Homo sapiens
  misc_feature: GYAE6OF01BGSMM.43.44.D11.1.454.CMB.1.raw
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgctgcagtctgggactgaggtagaaaaagccgtggtcctcgagtgacggtgtcctgacaacgtcgtaccggaggcagtcttacagcagacctaaactacgtaaggttggtcgacgacgacggccgtggagaaggactagaagtggaggtagggggactcgacgtccggaggtcgtacggaaactaaacgaacgtacgacgaacgtaacgtaacggttacgaggtactaaggtaacgttacgtacgtacgtacggtacggtaccgtaccgtaccgaccgaacccgtacggtaccgttaacggttacgggtacgggtaggaacggtacggtaaccgtaacgtacgttaccgtaggtaccggtaccgtacccggtacgttacgtaacgttacgttcggtacggacggtaacggaggtaacgggtacgggtacggtaacgttcggttaacggttcggtttaggggtaacgtttaggtccggggttacgtaccgttaggttaaccggtttacgggttacgggggacccgtaacggggttaacccggaacgggtttccgtaacccgtttcggttacccgtttaccgaccgggttaccccctaaccggtaaccccggttacccgggtaccttaaacccggtttccccggttaccccggttaccccccgg

SEQ ID NO: 231569 - DNA, 821 bp, Homo sapiens
  misc_feature: GYAE6OF01B12VC.43.44.D11.1.454.CMB.1.raw
tcagtgtgagtagtcacgaccggtgctcgatttagcgcagtacgaagggggcccctgggagcacagctcagcaccatggactggacctggaggttcctctttgtggtggcaacagctacaggtgtaccaactcccaggtgacaactgctgcagtcgtgggactgaggtagaaaaagccgtgggtcctcagtgacggtgtcctgcgagtcgtaccggagctatcttcagcacgaccaaaatagttaagtttgggtacgacggaccgtacggccccgtagggaagaacggtacgttaggtaacggtggggtagggtacggggggtactacggacggtacccgggtacggtcgttaacgggaaaacctaaaaccgtaaacctaccggaaccaacgtaaacggttaacgttttaccgggaacgggaactaacgttaaagttcgtaacgtttcggaaccgggtacgtaaccgtaacccgtacccgaacccgtaacccgtacccgggtaccttaggtttacgggtacggagggtaacgtaccggtaactacgtacgtcgtaacggaccgaaccgtacgtaccgttacccgttagttaccgtggacggtaccgtaaagggcggtacggggtacgtaccggtacgtttgggaccggttttggtttaacggggtagtttcgggtcgtcggtaggttagttacggttcggttacggggaccggtaacccgggtaccggccgttacccgtacccggttcttacgtacccgtcccgtacctacccggtaccgtaaccgggacccttaccggttcccggtccccgttaccccgg

SEQ ID NO: 231570 - DNA, 915 bp, Homo sapiens
  misc_feature: GYAE6OF01AOYQ4.43.44.D11.1.454.CMB.1.raw
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaatgctgcagtcgtgggactgaggtagaaaacgccgtgggtcctcagtggacggttgtccgtgcgaacgttcgtaccgggagcctatcttcagccacgacctaaactacgtaaggttcgggtagcgaccgtacggcccgtgggaagaacggtacgttgaaggtgggtaggggtagggggtactacgcgttaccggaggggtcgtaacggaaacgtaaaccgtaactacggtaccaaggtacggtaacggttacggaagggtacaaggttaactttaccggtacgtttaaccggcggtacccgtaacgtacccgtaacccgaaccccggtaacccgaccggttaaccgtttacgggtttacgggaaacggggtacgtaaacggtaaccggttaacccgttaaaccgtacgttttaccgtaacgggaccgttaacccgggtaaccccgggttccgtttaacttaaaccgggttacgtttcggaacgggaacgtttacggggaacggttaccgggggacgggttacgttacggttaaccggtccgggtttacggggttttacggggttaacggtttcgggtagggtaccggttcggttaaggtttacgggtttacggggtacgggacccgggtaccgggttaaaacccggtccgggtttacccgaaccggttttccccggaagttccccgtaccggtttaaaccccggtaccccgaaccgggggttaaaccccgttcccggtaacccgggttttcccggtccccccggggtttacccgg

SEQ ID NO: 231571 - DNA, 1055 bp, Homo sapiens
  misc_feature: GYAE6OF01A9JO0.43.44.D11.1.454.CMB.1.raw
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgctgcagtcgtgggactggaggtagaaaaagccgtgggtcctcagtggacggtgtccgtgactaagtccgtaccgggaggctacgtcttacagcaacgaccaaacgttaagttaacggttgggtacgacggaacgtaccgggaccccgtgggaacggtaaacggtacgttaggaacgtggggtaaggtgggggggaactaccgacggtaccccggacgggtccgttacggaaaacctaaaccgtaaaccgtaaccgacgaaccgtaacggtaacggtttaacggaacgggtacgtaaacggttaacgtttacggttaacgtttaaccggtacggggtaacccggtaacccgtaaaccggtaccccgaacccggtaacccggtaacccgggtacccgtttaacggtttaacgggggtaacgggttacgggaaacgggtaaccgggtaaacccttaacgtaaccgttacggttaaccgggaaccccggtaaccggtaccccgggttacccgtttaaccgttaaacgttttaccgggttagggtacccgggtaacgggtaaacgggtaaccggggttaacggggtaccggggtttaccgggtaacccgtttcgggttaccgggttttaaccgggtttagggggttaacgtttttacgggggaccggggtttaccggtacccggttttaaaggggttacccgttttacggggggtaacccgggggttaaccccgggtaaaacccggggggttaaccccgtaaaaccgggggttcccgttaaacccccgggtttcctttacccggttaacccccggtaccgggtacccccgttaacccccggtaaacccggggaacccccgggtttcccgttaaccccgggtttccccggtttacccccggttaaccccccccgggg

SEQ ID NO: 231572 - DNA, 554 bp, Homo sapiens
  misc_feature: GYAE6OF02FVKNF.43.44.D11.1.454.CMB.1.raw
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgctgcagtctgggactgaggtgaaaaagcctgggtcctcagtgacggtgtcctgcaagtctaccggaggcatcttcagcagccaaactataagttgggtgcgacaggcccctggagaaggacttgaatggatgggggggatcatcccgaggcttggaacaacaaactacgcacagaagtttcagggcagaatttcgattactgcggacgactccacgaccacggcctattggagtgagaggcctaacatctgacgacacggccgtctattactgtgcgagagaggcggtggactctgctttggggagttttagtggcgtcgttgtatttagttggggcctagggacccagggtcctaccggtcttccgttcgacgccctccaccgaagggccccagtccggtcttcccccg

SEQ ID NO: 231573 - DNA, 526 bp, Homo sapiens
  misc_feature: GYAE6OF02IZ1LJ.43.44.D11.1.454.CMB.1.raw
  modified_base (454)..(454): a, c, t, g, unknown or other
  misc_feature (454)..(454): n is a, c, g, or t
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgctgcagtctgggactgaggtgaaaaagcctgggtcctcagtgacggtgtcctgcaagtctaccggaggcatcttcagcagccaaactataagttgggtgcgacaggcccctggagaaggacttgaatggatgggggggatcatcccgaggcttggaacaacaaactacgcacagaagtttcagggcagaatttcgattactgcggacgactccacgaccacggcctattggagtgagaggcctaacatctgacgacacggccgtctattactgtgcgagagaggcggtggactctgctttgggatttagnggcgctgattattggggccagggaccaggtcaccgtctctcagcctccacacggccagtccggtcttccccg

SEQ ID NO: 231574 - DNA, 569 bp, Homo sapiens
  misc_feature: GYAE6OF02FUCQ9.43.44.D11.1.454.CMB.1.raw
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgctgcagtctgggactgaggtgaaaaagcctgggtcctcagtgacggtgtcctgcaagtctaccggaggcatcttcagcagccaaactataagttgggtgcgacaggcccctggagaaggacttgaatggatgggggggatcatcccgaggcttggaacaacaaactacgcacagaagtttcagggcagaatttcgattactgcggacgactccacgaccacggcctattggaggtgagaggcctaacatctgacgacacggccgtctattactgtgcgagagaggcggtggactctgcgtttggggagttttagtggtcgcgttgagttagttgggggcctaggggacccagggtccgaacccggttctacgttccgacgtccctcccaccgaaccgggtcccacgttccggtccttccccccgg

SEQ ID NO: 231575 - DNA, 926 bp, Homo sapiens
  misc_feature: GYAE6OF02IKSSH.43.44.D11.1.454.CMB.1.raw
tcagtgtgagtagtcacgaccggtgctcgattttagcgcagtacgaagggggccccgggtgggagcgacgagctcagcaccgatggacctggacctggaggttccgtctttgtggtggctaaccagcctaccaggtgtccaagtcccaggtggcaacgtcgctgcacgtctgggactgacggtgaaaacgccctgggtcctcgagttgacgggtgtcctgcaagtcctaccggacggcatcttcgagccagccaaactactaaagttgggttagtcgacacggtcccctaggagaaggacgttagaaactacgggagtacgggggggaataccgaacgttccccggaggtccttagggtaaacctaaaccgaaaacgttaccggaccaaacgtaacggtaaacggttttaccaacggggtaccgtaacggtaaacgttttaccggtaacttttaaccttacggtaccgggtaacccttaaccgttacccgtaaccggtaaccccgtaaccgggtaaccccttaacggttttaccggggtaaccgggttacggtaaacgggtaacgggttaccccgttaaaccgtacggttacccgtttacggaaacccggaacccgtaaccggggacccggttacgttaaacgtttaccgttaggttacggtacggtaacgggaggtacgggtacgggttacggtaccgttacgttcggtcggttttaagggggtaggtttttaacgggtgggttaccggttcggttagggttacggttttaaggttccggggggaaccctaacgggggaacccgtagggttaccccgtaacccggtttccgtacgtttacccggaccgtaccccgttacccgtaaccccgggtaacccgggttacccccgaacggtttcccgggttcccctttacccccccgggg

SEQ ID NO: 231576 - DNA, 583 bp, Homo sapiens
  misc_feature: GYAE6OF02GB64E.43.44.D11.1.454.CMB.1.raw
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgctgcagtctgggactgaggtgaaaaagcctgggtcctcagtgacggtgtcctgcaagtctaccggaggcatcttcagcagccaaaactataagttgggtgcgacaggcccctggagaaggacttgaatgggagtgggggggatcgagtcccgaggcgttggaacaacaaactacgcacagaagtttcagggcagaattcgattactgcgacgactccacgaccacgcctagttggagtgagaggcctaacatctgacgacacggccgtctatactgtgcgagagagcggtgactcgtgtcgtttgggagtttagtgggtcgtcgttgtagtttagtcggggcctaaggggtacccagggtccgaacccgttcgttacgttccgacgtcccgtacccgaccggaaccggtcccgtacgttcccgggtcccttcccccggg

SEQ ID NO: 231577 - DNA, 579 bp, Homo sapiens
  misc_feature: GYAE6OF02IGSGR.43.44.D11.1.454.CMB.1.raw
tcagtgtgagtagtcacgaccggtgctcgatttagcgcagtacgaagggggccccctgggagcacagctcagcaccatggactggacctggaggttcctctttgtggtggcaacagctacaggtgtccaatcccaggtgcaactgctgcagtctgggactgaggtgaaaaagcctgggtcctcagtgacggtgtcctgcaagtctaccggaggcatcttcagcagccaaactataagttgggtgcgacaggcccctggagaaggacttgaatggatgggggggatcgatcccgaggcttggaacaacaaactacgcacagaagtttcagggcagaatttcgattactgcggacgactccacgaccacggctatttggagtgagaggcctaacatctgacgacacggccgtctaattactgtgcgagaggaggcgggtggacttgtcgtcgtttggggagttttagtgggtcgtcgttgatttaggttcggggaccaggggaacccgagggtccgaccggttctacgttccgacgtccctccgaccgtaacgggccccagttcccggtccttccccccgg

SEQ ID NO: 231578 - DNA, 569 bp, Homo sapiens
  misc_feature: GYAE6OF02I36K8.43.44.D11.1.454.CMB.1.raw
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgctgcagtctgggactgaggtgaaaagcctgggtcctcagtgacggtgtcctgcaagtctaccggaggcatctcagcagccaaactataagttgggtgacgacaggccctggagaaggacttgaatggatggggggatcgatccgaggcttaggaacaacaaactacgacacagagttcaggcagattcgattactgacgacgactcacgaccacggcctagttagacggtaggagacggactaacgatcgtagacgacacggacgtcgtactacgtggctacggataggaggtacggtggacctcgtcgtcgttgggtagttagtaggtcgtcgtgtagttatcggggtcaacgggaccgaggtcgtaccggtctctacgacgcccgtacgaccgtacgggccctagtccgttaccgttccccgg

SEQ ID NO: 231579 - DNA, 591 bp, Homo sapiens
  misc_feature: GYAE6OF02HSAH0.43.44.D11.1.454.CMB.1.raw
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgctgcagtctgggactgaggtgaaaaagcctgggtcctcagtgacggtgtcctgcaagtctaccggaggcatcttcagcagccaaactataagttgggtgcgacaggcccctggagaaggacttgaatggatgggggggatcgatcccgaggcttggaacaacaaactacgcacagaagtttcagggcagaatttcgattactgcggacgactccacgaccacggctatttggaggtgagaggcctaacatctgacgacgacggccgtctattactgtgcgagaggaggcgggtggactcgtggtcgtttggggagttttagtgggtcgtcttgtagtttagtcgggggccaaggggtaccctagggtccgaaccggttcctcgtttccgacgtcccgtcccgaacccgtaacgggtcccccaagttcccgggtccctttccccccgg

SEQ ID NO: 231580 - DNA, 602 bp, Homo sapiens
  misc_feature: GYAE6OF02GXSYI.43.44.D11.1.454.CMB.1.raw
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgctgcagtctgggactgaggtgaaaaagcctgggtcctcagtgacggtgtcctgcaagtctaccggaggcatcttcagcagccaaactataagttgggtgcgacaggcccctggagaaggacttgaatggagtggggggggatcgagtcccgaggcttggaacaacaaactacgcacagaagtttagggcagaattcgattactgcgacgactccacgaccacggcctatttggagtgagaggcctaacatctagacgacacggccgtctattactgtgcgagagaggcggtggactcgtgtcgtttgggagttttagtggtcgtcgtgtatttaggttcggggaccgtacggggaaccctagggtccgtacccggttcgttaccgttccgacgtccccgttacccgacccgaacgggtcccctaaggttccccgggttaccctttccccccgtccggg

SEQ ID NO: 231581 - DNA, 604 bp, Homo sapiens
  misc_feature: GYAE6OF02GCEKX.43.44.D11.1.454.CMB.1.raw
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgctgcagtctgggactgaggtgaaaaagcctgggtcctcagtgacggtgtcctgcaagtctaccggaggcatcttcagcagccaaactataagttgggtgcgacaggcccctggagaaggacttgaatggatgggggggatcgatcccgaggcttggaacaacaaactacgcacagaagtttcagggcagaatttcgattactgcggacgactccacgaccacggcctattggaggtgagaggcctaacatctgacgacacggccgtctattactgtgcgagagaggcggtgactctgcgtttgggagttttagtgggtcgtcgttggtatttacggttgggggtcctaacggggtaccccgagggttacccgtaacccggttccttccgtttccgacggtcccgttacccgacccgtaaacgggccccctaagttcccgggttccctttacccccccggg

SEQ ID NO: 231582 - DNA, 562 bp, Homo sapiens
  misc_feature: GYAE6OF02FXZ6P.43.44.D11.1.454.CMB.1.raw
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgctgcagtctgggactgaggtgaaaaagcctgggtcctcagtgacggtgtcctgcaagtctaccggaggcatcttcagcagccaaactataagttgggtgcgacaggcccctggagaaggacttgaatggatgggggggatcgatcccgaggcttggaacaacaaactacgcacagaagtttcagggcagaatttcgattactgcggacgactccacgaccacggctattggagtgagaggcctaacatctgacgacacggccgtctattactgtgcgagagaggcggtggactctgtctttgggagtttgtgggcgtctgtattagttggggccgagggaccctgggtaccacccggttctccgttccgacgtccctcccgaccgaacgggaccccacgtcccggtcccttcccccgg

SEQ ID NO: 231583 - DNA, 612 bp, Homo sapiens
  misc_feature: GYAE6OF02G2MWV.43.44.D11.1.454.CMB.1.raw
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgctgcagtctgggactgaggtgaaaaagcctgggtcctcagtgacggtgtcctgcaagtctaccggaggcatcttcagcagccaaactataagttgggtgcgacaggcccctggagaaggacttgaatggagtgggggggatcgatccgaggcttggaacaacaaactacgcaacagaagtttcagggcagaattcgattactgcggacgactccacgaccacggctagttggaggtgagaggacctaagactcgtagacgacgacggccgtctaatactgtcgcgaggagagggcggtaggactcgtaggtcgtttggggtaatttaggtggtcgtcgttagtagtttagtggggacctaggggtaacccgtagggttacccgaccgggttccttccgttaccgacgttacccgtacccgacccggtaaaccgggcccctacggttcccggttccccttacccccggg

SEQ ID NO: 231584 - DNA, 589 bp, Homo sapiens
  misc_feature: GYAE6OF02HN9O6.43.44.D11.1.454.CMB.1.raw
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgctgcagtctgggactgaggtgaaaaagcctgggtcctcagtgacggtgtcctgcaagtctaccggaggcatcttcagcagccaaaactataagttgggtgcgacaggcccctggagaaggacttgaatggatgggggggatcgatcccgaggcttggaacaacaaactacgcacagaagtttcagggcagaattgattactgcggacgactccacgaccacggctagttggaggtgagaggcctaacatctgacacgacggccgtctattactgtgcgagagaggcggtggactcgtgtcgtttggggagtttagtggcgtcgttgtatttagtcggggtaccgagggtacccgtaggttccgtaaccggttccttacgtccgtacggtcccttaccgacccgtaacgggtcccctaacgttcccggttaccctttccccccggg

SEQ ID NO: 231585 - DNA, 908 bp, Homo sapiens
  misc_feature: GYAE6OF02J10U6.43.44.D11.1.454.CMB.1.raw
tcagtgtgagtagtcacgaccggtgctcgatttagcgcagtacgaaggggcccgtgggagcacagctcagcaccatggactggacctggaggttcctctttgtggtggcaacagctacaggtgtccaatcccaggtgcaactgtctgacacgtcgtaggactggaggtaaggaaaacgccggttacgggtcctacgtaggtacggtacggttcgttccgtcgacgtaacgttccgtaaccggggacggactaacgtttccttaccgacgacgaaccgaaccctaaaaacttaagttaagggtttgggtacgacgaaccggacccggtaccccgtagggaacggaacggtaccgttaggtaaggtacgggtaagggggtacgggggggtactaccgtaccggtacccgggtacggtacggttaacgggaaaccgtaaaaccgaaaacgttaccgaacgaacgtaaacggttaacgtttacggaacgggacgtaaacggttaacgtttaaccgtaagttacgttacgggaaccggtaaccgtacctaacccggaaccgaacccggtaaccggtacccgtttaggttacgggtaggttagaacggacggtaaccgaactacgtacgtacggaaccgtaccggaccgggtaccgttattaaccgttacgtacggtacggtacggacggtaacggacgggtacggtacggtaccgtacgtcgttacgggttaggttaacggtttggtacggtacgttacgttagtaacggttttcgggacgggtacccgtaacgggtaacgaccggttaaccggtacccgttccgttaacgtcccggtaaccgtaccccgttaccgaacccgggaaacccgggttccccacgggtttaccccggtttacccctacccccgggg

SEQ ID NO: 231586 - DNA, 588 bp, Homo sapiens
  misc_feature: GYAE6OF02JO55I.43.44.D11.1.454.CMB.1.raw
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgctgcagtctgggactgaggtgaaaagcctgggtcctcagtgacggtgtcctgcaagtctaccggaggcatcttcagcagccaaactataagttgggtgcgacaggcccctggagaaggacttgaagtggagtggggggatcgagtccgaggcttggaacaacaaacgtacgcacagaagttcgaggcagaatttcgaattactagacggacgactccgacgaccgacggctagttggagtcgagagctaacatactgacgacgacggccgtctatacgtgtcgacgagagaggcgggtagacgtgtcgtgttgggtagtttagtcggcgtcgtgtagttagttcgggtacgtacggacccgtaggtaccgaccgttcgtccgttaccgacgttacccgtaccgtaccggtaacggtccctacgtcccggtcccgttacccccgg

SEQ ID NO: 231587 - DNA, 642 bp, Homo sapiens
  misc_feature: GYAE6OF02IXL34.43.44.D11.1.454.CMB.1.raw
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgctgcagtctgggactgaggtgaaaaagcctgggtcctcagtgacggtgtcctgcaagtctaccggaggcatcttcagcagccaaactataagttgggtgcgacaggcccctggagaaggacttgaatggagtgggggggatcgagtcccgaggcttaggaacaacaaactacgcacagaagtttcaggcagaatttcgattactgacggacgactccgacgaccacggcctagtttggacggtgaagaggacctaacgactacgtcgaacgacacgggtccgtctattactgtcgacgaggaggaggcggtggacctcgtaggtccgtttagggagttttagtcgggtcgtcgttacggtagtttacggttcgggggtacccgacggggtaacccgtacgggttaccgtaacccggttcctttaccggttccgacggtcccgtacccgtaacccggtaaaccgggtccccacggttcccgggtccccgtttcccccgg

SEQ ID NO: 231588 - DNA, 706 bp, Homo sapiens
  misc_feature: GYAE6OF02FGWKQ.43.44.D11.1.454.CMB.1.raw
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgctgcagtctgggactgaggtgaaaaagcctgggtcctcagtgacggtgtcctgcaagtctaccggaggcatccttcagcagccaaactataagttgggtgccgacacggccccgtaggagaaggacttggaatgggagtgggggggatcgacgtcccggagtcgttaggaacaacaaactacgacaacgagtaacgtttacgagggactagtaatttacgattacgtcgacggtacgacctaccgaaccgtacccgaccggtacctagtttacgggaggttaggacgacgggtacctaacgactaccgtaggaccgaccgaccggtcccgttacttaacgtttaccgtggtacgacggaaggtacggacgggtacgggtcggaaccttcgtggtaccggttttagggagttttacgtgggtaccgtgttacggaatttacggttggggtacccgtaacgggtaccccgtaggtcccgtaaccggttctacccgttacacccgtcccttacccgaccggtaacccgggccctaccggttacccggttcccgttaccccccggg

SEQ ID NO: 231589 - DNA, 623 bp, Homo sapiens
  misc_feature: GYAE6OF02GNDW8.43.44.D11.1.454.CMB.1.raw
  modified_base (435)..(435): a, c, t, g, unknown or other
  misc_feature (435)..(435): n is a, c, g, or t
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgctgcagtctgggactgaggtgaaaaagcctgggtcctcagtgacggtgtcctgcaagtctaccggaggcatcttcagcagccaaactataagttgggtgcgacaggcccctggagaaggacttgaatggagtggggggggatcgagtccccggaggcttggaacaacaaactacgcacagaagtttcagggcagaatttcgattactgcggacgactccacgaccacggcctagttggaggtgagaggcctaacatctgacgacgacggccgtctattactgtgcgagagnggcggtggactcgtggcgtttgggagtttagtggtcgtcgttgtagtttaggttgggggaccgtacggggaacccgtacgggttaccgtaacccggttccttacccgtttccgaccggtccccgttacccgaacccgtaaccggggtacccccgtacggttaccccgggttccctttacccccccggg

SEQ ID NO: 231590 - DNA, 618 bp, Homo sapiens
  misc_feature: GYAE6OF02H81MC.43.44.D11.1.454.CMB.1.raw
tcagtgtgagtagtcacgaccggtgctcgatttagcgcagtacgaaggggggcccctgggagcacagctcagcaccatggactggacctggaggttcctctttgtggtggcaacagctacaggtgtccaatcccaggtgcaactgctgcagtctgggactgaggtgaaaaagcctgggtcctcagtgacggtgtcctgcaagtctaccggaggcatcttcagcagccaaaactataagttggtcgcgacaggcccctggaagaaggacttgaagtggagtaggggggggatcgagtcccggaggcgttaggaaacaaacaaaacgtacgacacagaacgtttcaagggcaagtaatttcgattacgtgacggacgactccacgaccacggcctaacgtttgggagtgaggacgtacctaacactacgtggaacgacgacggtcccgtacgttatacgtgtgacgagacggaggcggtgactcgtcgtcgtttagggtagtttagtgcgtcgtagttacttaggttcgggcctacgggaccctacggttacgacccgtctaccgtccgtacgccctaccgaccgaaccggccctacgttcccggtcccttaccccccgg

SEQ ID NO: 231591 - DNA, 712 bp, Homo sapiens
  misc_feature: GYAE6OF02HBZKH.43.44.D11.1.454.CMB.1.raw
tcagtgtgagtagtcacgaccggtgctcgatttagcgcagtacgaagggggcccctggggagcacagctcagcaccatggactggacctggaggttcctctttgtggtggcaacagctacaggtgtccaatcccaggtgcaactgctgcagtctgggactcgaggtgaaaaagcctgggtcctcagtgacggtgtcctgcaagtctaccggaggcatcttcagcagccaaaactataagttgggtgcgacacggcccctggagaaggacttgaatggataggggggggatcgatccggaggtcttagggaacaacaaaactacgacacaagaacgtttcgagggacagaatttcgattactgcggacgactccacgaaccacggcctagttcggagttggacggaggacctaacactactagaccgaacgaccgggcccgttacgtaactttactacggtcggtcggaaggacggacgggtccgggttaggggtaccctcggttcggtccgttttagggggtacggttttaagtcggggtccggtcgttacggttaagtttacggttacgggggacccgggtaacggggtaaccccggtagggttacccgtaacccggttccgtttaccgtttacgtaaccggtcccgttaccccggaaccggtaaccggggtaccccgtaaccggtttcccgggtaccctttccccccggg

SEQ ID NO: 231592 - DNA, 639 bp, Homo sapiens
  misc_feature: GYAE6OF02HORSL.43.44.D11.1.454.CMB.1.raw
  modified_base (420)..(420): a, c, t, g, unknown or other
  misc_feature (420)..(420): n is a, c, g, or t
  modified_base (510)..(510): a, c, t, g, unknown or other
  misc_feature (510)..(510): n is a, c, g, or t
tcagtgtgagtagtcacgaccggtgctcgatttagcgcagtacgaagggggccccctgggagcacagctcagcaccatggactggacctggaggttcctctttgtggtggcaacagctacaggtgtccaatcccaggtgcaactgctgcagtctgggactgaggtagaaaaagcctgggtcctcagtgacggtgtcctgcaagtctaccggaggcatcttcagcagaccaaaactagtaaaggttgggtgacgacacggcccctaggaggaaggtacttagaagtggaggtggggggatcgacgtccgaggtcttaggaacaaactaaacgtacgacaacgagtaagttcgaaggcaagtaattacgtatacgtgacgacgactaccacgacacgtctagttggagtgagacgactaacntacgacgacgacaccggtctacgtattacgtgtacgacgaggtaaggacggacggtaggactcgtaggtccgtttagggtagtttacggnggtcgtcgttagtgtttacggcggggacctaagggacccgtaggtaccgtaacccgtttctacgttacgaccgtcccgtacccgaaccggaaccgggcccttaaccggtccgttccccgttacccccgg

SEQ ID NO: 231593 - DNA, 565 bp, Homo sapiens
  misc_feature: GYAE6OF02HP3EJ.43.44.D11.1.454.CMB.1.raw
tcagtgtgagtagtcacgaccggtgctcgatttagcgcagtacgaaggggggcccctgggagcacagctcagcaccatggactggacctggaggttcctctttgtggtggcaacagctacaggtgtccaatcccaggtgcaactgctgcagtctgggactgaggtgaaaaagcctgggtcctcagtgacggtgtcctgcaagtctaccggaggcatcttcagcagccaaactataagttgggtgcgacaggcccctggagaaggacttgaatggatgggggggatcatcccgaggcttggaacaacaaactacgcacagaagtttcagggcagaatttcgattactgcggacgactccacgaccacggcctagtttgagtgagaggcctaacatctgacgacacggccgtctattactgtgcgagagaggcggtggactcgtgctttgggagtttagtgggtcgcgtgatttatgggggccaggggaccctaggtaccgaccggtcctacgttccgacgtcccgtaccacccgaacgggccccagtcccggtccttaccccccgg

SEQ ID NO: 231594 - DNA, 673 bp, Homo sapiens
  misc_feature: GYAE6OF02GL8HG.43.44.D11.1.454.CMB.1.raw
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgctgcagtctgggactgaggtgaaaaagcctgggtcctcagtgacggtgtcctgcaagtctaccggaggcatcttcagcagccaaaactataagttgggtgcgacacggcccctggagaaggacttgaatggagtggggggggatcgatcccggaggcgttagggaacaacgaaactacgcaacgaagaagttttcgagggacagtaactttcgaattacgtgacggacgactaccacgaccacggacctagtttggaggtgagagcctaacactacgtgacgacacggccgtactattactgtcgcgagagacgggcggtacggtactcgtcggtcgttttacgggtaggttttacggtgggtacgtcgttgtaagtttacggttacggggacccgttaacggggaaccccggttagggtaccgtaaccccggttaccgtttaccgttacccgtaccgtccccgttacccgtaacccgggaacccgggtaccccgtacggtttaccccggttacccctttccccccggg

SEQ ID NO: 231595 - DNA, 615 bp, Homo sapiens
  misc_feature: GYAE6OF02FZEC2.43.44.D11.1.454.CMB.1.raw
  modified_base (393)..(393): a, c, t, g, unknown or other
  misc_feature (393)..(393): n is a, c, g, or t
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgctgcagtctgggactgaggtgaaaaagcctgggtcctcagtgacggtgtcctgcaagtctaccggaggcatcttcagcagccaaactataagttgggtgcgacaggccctggagaaggacttgaatggagtgggggggatcgagtcccgaggcttggaacaacaaactacgacacagaagttcagggcagatttcgattactgcgacgactaccacgaccacggcctattggaggtgagaggcctaacntctgacgacacggccgtctattacctgtgcgtagagtaggcggtgctctggtcgtttgggagttttgtcggtcgtcgtagtagttagttcggggaccgtaggggacccgtagggttacccgtacccgggttaccgttaccgttacccgtacggtaccccttacccggaacccggtaaccggggtccccgacggtttccccgggtaccctttacccccccggg

SEQ ID NO: 231596 - DNA, 591 bp, Homo sapiens
  misc_feature: GYAE6OF02GYZ36.43.44.D11.1.454.CMB.1.raw
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgctgcagtctgggactgaggtgaaaagcctgggtcctcagtgacggtgtcctgcaagtctaccggaggcatcttcagcagccaaactataagttgggtgcgacaggcccctggagaaggacttgaatggagtggggggatcgatcccggaggcttaggaacaacaaactacgcacagaagttcaggcagaattgattactgcgacgactccgacgaccacggcctagttgggaggtgaggaggacctaactactctacgacgacgacggccgtctattactgtcgcgaggagaggcggtggactcgtgcgtttgggtagtttacgtggtcgtcgttggtattaggttggggtccgaacgggtacccgagggttccgcccggttccgttccgttccgacgtccctcccgaaccgacgggtcccctacggtcccggttcccttcccccgg

SEQ ID NO: 231597 - DNA, 820 bp, Homo sapiens
  misc_feature: GYAE6OF02JJY0T.43.44.D11.1.454.CMB.1.raw
tcagtgtgagtagtcacgaccggtgctcgatttagcgcagtacgaaggggccccgtgggagcacagctcagcaccatggactggacctggaggttcctctttgtggtggcaacagctacaggtgtccaatcccaggtgcaactgctgcagtctggactgaggtgaaaagcctgggtcctcgagtgacggtgtcctgcaagtctaccggaggcagtctcagcagaccaaactataacggttgggtgacgacacggccccgtggacgaaggacgttagaagtggaggtggggggatcgacgtcccggaggtaccgttaggaaccgaaactaaaccgtacgacgaacgtaagtaacgtttacgaagggacaagttaacgttacgtaacgttacgttaggaccggtacgtaccgtaccgaccgaaccgaacggtaccgttaacgtttacgggtagggttacgaacggtacgggtaacctaacgtacgtacgtacggaaccggttaaccgacccggtaccgttaccgttaacgtttaaccgttacggtacgggacgtaaacgggtaagggtacggggttaccgggttaccggtaccgtttaccgttacgggtttacgggtttaacggggtttaagttttacggtaacggggttccgtaggtttacgttaaggtttacgggttacggggtaaccggtaaccgggtaacccgtacggggtaccccgtaaccggttaccgtttaccggtacgttaacccggtccccgtttaccggaacccgtacggggttacccctacgggtttaccccggttacccgttcccccggg

SEQ ID NO: 231598 - DNA, 613 bp, Homo sapiens
  misc_feature: GYAE6OF02HU5VO.43.44.D11.1.454.CMB.1.raw
  modified_base (488)..(488): a, c, t, g, unknown or other
  misc_feature (488)..(488): n is a, c, g, or t
tcagtgtgagtagtcacgaccggtgctcgatttagcgcagtacgaaggggggcccctgggagcacagctcagcaccatggactggacctggaggttcctctttgtggtggcaacagctacaggtgtccaatcccaggtgcaactgctgcagtctgggactgaggtgaaaaagcctgggtcctcagtgacggtgtcctgcaagtctaccggaggcatcttcagcagccaaactataagttgggtgcgacacggccctggagaaggacttagaagtggagtggggggatcgagtccgaggcttaggaacaacaaactacgacacagaagttcgaggacagtaattcgtaattacgtgacggacgactccgacgaccgacgtcctagttaggagtgaggacgtacctaacgatacgagacgacgaccggccgttacttaattactgtacgcgaggaggaggcggtgtactcgtgtcgtttgggtatttagngtcgcgttagtacgttagtcggggtaccgacgggtacccgtgggtaccgtacccggttcttaccgttccgaccgtccctaccgacccgaaccgggtcccacggttacccggttcccttcccccgg

SEQ ID NO: 231599 - DNA, 628 bp, Homo sapiens
  misc_feature: GYAE6OF02G3N6V.43.44.D11.1.454.CMB.1.raw
  modified_base (405)..(405): a, c, t, g, unknown or other
  misc_feature (405)..(405): n is a, c, g, or t
  modified_base (407)..(407): a, c, t, g, unknown or other
  misc_feature (407)..(407): n is a, c, g, or t
  modified_base (417)..(417): a, c, t, g, unknown or other
  misc_feature (417)..(417): n is a, c, g, or t
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgctgcagtctgggactgaggtgaaaaagcctgggtcctcgagtgacggtgtcctgcaagtcgtaccggaggcatcttcgagcagaccaaactataaggttggtgcgacacggccccgtggagaaggacttgaatggagtgggggatcgagtccgaggcgttaggaacaaacgaacgtacgacacgaagaagtttcgaaggacaagtaagttcgtaatacgtgacgacgactcgacgaccgacgctagtgagtgagagcaacntntacgacgacncggccgtatactactgtgacgagagaggtcggtagtacctgtcggtgtttacgggtagttttaagcgggtacgtcgttggttaagtttacggttgggtaccgtaaccgggtaccgacggtccggtaacccgttgtacccgttcgaaccgtcccgtacccgtaacccggtaccggtaccccgtaggttacccggtcccgtttaccccccggg

SEQ ID NO: 231600 - DNA, 591 bp, Homo sapiens
  misc_feature: GYAE6OF02HIXMN.43.44.D11.1.454.CMB.1.raw
  modified_base (463)..(463): a, c, t, g, unknown or other
  misc_feature (463)..(463): n is a, c, g, or t
  modified_base (507)..(507): a, c, t, g, unknown or other
  misc_feature (507)..(507): n is a, c, g, or t
  modified_base (550)..(550): a, c, t, g, unknown or other
  misc_feature (550)..(550): n is a, c, g, or t
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgctgcagtctgggactgaggtgaaaaagcctgggcctcagtgacggtgtcctgcaagtctaccggaggcatcttcagcagccaaactataagttgggtgcgacacggcccctggagaaggacttgaatgggagtggggggggatcgagtccccggaggtcgttaggaacaacctaaaactacgacacaaggaacgtttcagggcagtaatttacgaattacgtgacggaacgacctaccaccgaccgacgtacctagttcggtaggtgacggaggtacctaactatcgtagacgacgacggccgttactattctggtcgngagaggacggtcggaggtctacgtcgtcgtttgggtagtttagnggtcgtctgtagttgtcgggcgacggaccgaggtccgacggtntcctcgcgtccctcaccgacgccacgtccgtccctccccgg

SEQ ID NO: 231601 - DNA, 644 bp, Homo sapiens
  misc_feature: GYAE6OF02HJXY8.43.44.D11.1.454.CMB.1.raw
  modified_base (242)..(242): a, c, t, g, unknown or other
  misc_feature (242)..(242): n is a, c, g, or t
  modified_base (365)..(365): a, c, t, g, unknown or other
  misc_feature (365)..(365): n is a, c, g, or t
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgctgcagtctgggactgaggtgaaaaagcctgggtcctcagtgacggtgtcctgcaagtctaccggaggcatcttcagcagccaaactataagtgggtncgacacggccctggagaaggacttgaagtggaggtggggggatacgacgtccggaggtcgttaggaacaaacaaacgtacgacacgaagaacgtttcgagggacaagtaatttacgattacgngacggacgactccgacgaccgacgtcctagttggagtgagacgacaacatcgacgacgacgacggccgtacttattacgtgtgacggagaggagggcggtggactcgtaggtcgtttagggtagtttagtcgggtcgtcgttgtaagtttggttaccggggaccgtaacggggaccccgtaggttacccgtaccggttcctccgttaccgaccggtaccccttacccggaacccgtaaccgggacccctacggttcccgggttaccccttccccccggg

SEQ ID NO: 231602 - DNA, 642 bp, Homo sapiens
  misc_feature: GYAE6OF02JLBFK.43.44.D11.1.454.CMB.1.raw
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgctgcagtctgggactgaggtgaaaagcctgggtcctcagtgacggtgtcctgcaagtctaccggaggcatcttcagcagccaaactataagttgggtgcgacacgcccctggagaaggacttgaactggacgtgggggggaatcgagtacccggaggtaccgttaggaacaacaaacgtacgacaccgagtaagttcagggacagtaattacgtattacgtgacgacgactaccacgaccacgacttagttcgagtacgagtacggactaactacgtcgtacgacgacgacggccgtacgtacttacgtcgtcgacggagacggtaggacggtcgacgtcgtgtacgtttcgggtagtttcgtagggtccgtgtcgttagttacgttacgggggacctacggggacctacgggtccgtaacccggtacttccgttcgaccggtccgtacccgaccggtaaccggacccgtacgttcccgggttacccttccccccggg

SEQ ID NO: 231603 - DNA, 841 bp, Homo sapiens
  misc_feature: GYAE6OF02I7PAD.43.44.D11.1.454.CMB.1.raw
  modified_base (219)..(219): a, c, t, g, unknown or other
  misc_feature (219)..(219): n is a, c, g, or t
tcagtgtgagtagtcacgaccggtgctcgatttagcgcagtacgaagggggcccctgggagcacagctcagcaccatggactggacctggaggttcctctttgtggtggcaacagctacaggtgtccaatccaggtgcaactgctgcagtctgggactgaggtagaaaagccgtgggtcctcagtgacgtgtcctgcagtcgtacggaggcatcttacngcagacctaaactataaggttggtcgcgtaacgcgcccgtggtacgaaggtctgaatgggaggtaggggggatcgacgtaccggacggtcgttaggaacctaacgaaacgtcgtaacgacgtaacgtaacggtttacgaagggtactaaggttaacgtttacgtaattacgtacggtacggtaccgtaacctcgaacctaccggaccggttaccgttagtttacggggaaggttacgtacggtacggtaacctaacgtacgtacggtacggtaacccggtaaccgtacccgggttacccgttaacttaacggttacgtaccgggttaggtaccggtacggtaagggtaccgggtcgggtacgggtaaccgttcggttaacggtcgggttttaacgggttaacggttttacggtcgggtttaaccggtcggttttacggttacggttttacgggtccggggttaaaccgggtaaccggggtacccggttacggttaaccccggttaaccggttacccggttaccgttaacccggtccggttaaccccgttacccggtaaaccgggtacccccggtttaccggtaacccgggtttccccgggttaacccctttccccccggggg

SEQ ID NO: 231604 - DNA, 569 bp, Homo sapiens
  misc_feature: GYAE6OF02GUKO9.43.44.D11.1.454.CMB.1.raw
  modified_base (336)..(336): a, c, t, g, unknown or other
  misc_feature (336)..(336): n is a, c, g, or t
  modified_base (513)..(513): a, c, t, g, unknown or other
  misc_feature (513)..(513): n is a, c, g, or t
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgctgcagtctgggactgaggtgaaaaagcctgggtcctcagtgacggtgtcctgcaagtctaccggaggcatcttcagcagccaaactataagttgggtgcgacaggcccctggagaaggacttgaatggagtgggggggatcgagtcccggaggcttaggaacaacaaactacgcacgagaagttcaggganagaatttcgaattactgacggacgacctccacgaccacggtcctattggaggtgagaggacctaacgatcgtagacgacacggaccgtactattacgtgtgcgagaggaggcggtgacgtctgtcgttggagtttagtggcgtcgtgtagttgtcggggccgagggaccgcggtacnccggtctcgtcagtccctaccgaccgtacggacccacgttccggtccttcccccgg

SEQ ID NO: 231605 - DNA, 623 bp, Homo sapiens
  misc_feature: GYAE6OF02IZKME.43.44.D11.1.454.CMB.1.raw
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgctgcagtctgggactgaggtgaaaaagcctgggtcctcagtgacggtgtcctgcaagtctaccggaggcatcttcagcagccaaactagtaagttgggtgcgacacggcccctgggagaaggacttggaatggagtgggggggactcacgtccgaggtcgttaggaacaacaactacgacacagaagttcagggcagtattcgattactagcgacgactccgacgaccgacggacttagttaggaggtgagacggaccgtaacagtactagacgacaccgggcctacgttattactgtgccgaggagaggtcggtgggactcgtagtcgtttaggggtagtttgtgggcgtcttagttagtttacggttcggggaccgtaacggggacccgtagggtcgcccggtttctacgttcctacgtaccctccgtaacccggacgggtccccgtaacgttacccggttcccctttacccccggg

SEQ ID NO: 231606 - DNA, 609 bp, Homo sapiens
  misc_feature: GYAE6OF02HEIXB.43.44.D11.1.454.CMB.1.raw
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgctgcagtctgggactgaggtgaaaagcctgggtcctcagtgacggtgtcctgcaagtctaccggaggcatcttcagcagccaaactataagtgggtgcgacaggcccctggagaagacttgaagtggagtgggggggatcgagtcccgaggcttaggaacaacaaacgtacgacacagtaagtttcgagggacagaatttcgattacgtgacggacgactccgacgaccacgccttagttggagtgagacgctacatactgacgacgacggccgttactagttactggtagcgaagagtaggcggtgactcgtagttcgttagggtagttagtcggtacgtcgtgttagttacggttcggggacctaggggaccccgtggtaacccgtccggtccgtttactaccgtaccgtacccgttaccgaccgtaaccgggtcccacggttcccggtaccctttcccccgg

SEQ ID NO: 231607 - DNA, 743 bp, Homo sapiens
  misc_feature: GYAE6OF02GG0U5.43.44.D11.1.454.CMB.1.raw
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgctgcagtctgggactgaggtgaaaagcctgggtcctcgagtgacggtgtcctgcaagtctaccggaggcatctcagcagaccaaactataagttgggtgcgacgacggtccccgtggacgaaggtacttggaatagggtagtgggggggactacgtaacgtccccggtaggtacgtttacgggaaaccaaaaccgtaaaaccgttacggacccgaacgtaacggtaaacgttttacgaacgggtacgaacggtaagtttacgtaacgttaccgtggtaccggacgtaaccgtacccgaacgaacccgacggtaccttagttggaggtggacgacggtactaacgatacacggtaacgacgaccggaccgttacgtacgttacgtgttacgacgtaggacgtagggccgggtaggtacctacgtggttcggttagggttagttaggtgtaccggtacgttgggtaactttaggttacggggaccgtaacggggtaccctcggttaccggtacccggttgttacccgttccgttaacgtccccgtacccgtaacccggtaacgggtcccctacggttaccccggtcccctttaacccccgg

SEQ ID NO: 231608 - DNA, 778 bp, Homo sapiens
  misc_feature: GYAE6OF02JI73U.43.44.D11.1.454.CMB.1.raw
  modified_base (193)..(193): a, c, t, g, unknown or other
  misc_feature (193)..(193): n is a, c, g, or t
  modified_base (221)..(221): a, c, t, g, unknown or other
  misc_feature (221)..(221): n is a, c, g, or t
tcagtgtgagtagtcacgaccggtgctcgatttagcgcagtacgaagggggcccctgggagcacagctcagcaccatggactggacctggaggttcctctttgtggtggcaacagctacaggtgtaccaatcccaggtgcaactgctgcagtctgggactgaggtagaaaagcctgggtcctcagtgacggtntcctgcaagtctaccggaggcatctacngcactaccaaactagtaacgttggtagacggactacggccccgtggaacggaaggtaccgttagtaagtggaggtagggggggatacgtacgtaccccggacggtcgttacggaacgaaactaaaccgaaccgaccgtaaccgaaacggtaaacgttttcgaacggggtacgtaacgtaacgtttacggtaactttaaccgtgggaccggttaacgaacccgttaaccaacccggaacccgtaccgggtacccgttaaggtttaccgggaagggttcgtaaggacggtacccgtaactacgtacgtacgtaaccgtaacggaccggtacccgttacgttacgttaaccgtggtaccgtcgaacggtaaggacgggtccgggtagacggttcacgttccgggtttagggttaagttttacgacgggtaccgtagttaccggtaagtttacggtccgggttacgaaccgggtacccgtaaggtcctaaccggtccttacgttcccggtaccgtaccaccggtaaccggccgtcgtaccggttcccttcccggtacccgg

SEQ ID NO: 231609 - DNA, 797 bp, Homo sapiens
  misc_feature: GYAE6OF02H6U7F.43.44.D11.1.454.CMB.1.raw
  modified_base (221)..(221): a, c, t, g, unknown or other
  misc_feature (221)..(221): n is a, c, g, or t
tcagtgtgagtagtcacgaccggtgctcgatttagcgcagtacgaaggggggcccctgggagcacagctcagcaccatggactggacctggaggttcctctttgtggtggcaacagctacaggtgtccaatcccaggtgcaactgctgcagtctgggactgaggtagaaaaagcctgggtcctcagtgacggtgtcctgcaagtctaccggaggcatcttnagcagaccaaactataagttggtgacgacgacggccctaggagaaggacttaggaatgggagtggggggagtacacgtccgaggtacgtaggtaacaaacgtaaaccgaacgtacaacgagtaaggtttacgacggataacgtaatttaccgtaagttactggtacgtaaccggtactacctaccgaccgtaaccggaccgtttaacgttagggtagggtaggacggtaaacggtacccgttaaaccgtacgttaccgtacgggtaaccgaacccggtaaacccggtcccgggtttaaccttaacgtttaacgttccggttaagggtaccgaagggtaagggacgggtaccgggttagggtaccgttcggtacggtttacggtttacggggtttaaggttacgggtttggtaccggttcgttaacggtagttacggttttaacggggccgggtaaaccgggtacccggtaccggttcgtaaccccggttcgtttacccttaacggtacccgtcccgtaccctaacccgggaaccgggttacccgaccggttttacccggtcccgtttaccccccgg

SEQ ID NO: 231610 - DNA, 781 bp, Homo sapiens
  misc_feature: GYAE6OF02GPZ37.43.44.D11.1.454.CMB.1.raw
  modified_base (71)..(71): a, c, t, g, unknown or other
  misc_feature (71)..(71): n is a, c, g, or t
tcagtgtgagtagtcacgaccggtgctcgatttagcgcagtacgaagggggcccctgggagcacagctcancaccatggactggacctggaggttcctctttgtggtggcaacagctacaggtgtccaatcccaggtgcaactgctgcagtctggactgaggtagaaaagccgtggtcctcagtgacggtgtcctgacacgtctaccggagctatcttcagcacgaccaaacttataaggttgggtagaccgacgacggccccgtaggagaacggtacgttagaagtacgggaggtaggggggagtcgtaacgtcccggaggtacgtttacgggaaaccgaaaccgaaaaccgttaccggaaccgaaccgtaacggtaacggtttacgaacgggtacgaaggtaacgttttagtaacgtttaacgcggtaccggaacccgtacgttacccgacccgtacccgtaaccggtaccgttacgtttagggacgggtacgaacgggtaccggaccgtaacgtacgtaccgtacgaaccggtaacccgacgggtacctacgttaacgttacgtgttacgacggtagacggtagggtcggtagtccgtcggtagttggtttacgggtaaggttttacggacgggtcgtacgttagttacggttcggttaacggggtaccgaaccgggtaccggttcggacccgtaacggttccgttacgtcccgtaccgtacccgtaccgtaacccggaacggttccccgtacgtttcccgggtacccttcccccggg

SEQ ID NO: 231611 - DNA, 876 bp, Homo sapiens
  misc_feature: GYAE6OF02IS2F8.43.44.D11.1.454.CMB.1.raw
  modified_base (726)..(726): a, c, t, g, unknown or other
  misc_feature (726)..(726): n is a, c, g, or t
tcagtgtgagtagtcacgaccggtgctcgatttagcgcagtacgaagggggcccctggggagcacagctcagcaccatggactggacctggaggttcctctttgtggtggcaacagctacaggtgtccaatcccaggtgcaactgctgcagtctgggactggaggtagaaaaagccgtagggtcctcgagtagacggtgtcctagacgtaaggttacctaccgggaggactactcgttacacgacacgaccaaaacgttagtaaacggttaggggtacggacgacgaacggtcccgtaggaacggaaaggacgttagaagtggacggtaggggggtactacgacgtaccggaggtacgttacggaaacctaaaccgtaaaacgttaccgacgaaacgtaaggtaacgttaacggacgggtaagaacgtaaacgtttacgtaacgttaacgtacggtaaccggtaacgtaaccgtacccgaaccggtaacccgtaaccgggttaccgttaaacggtttacggggtaacgggttaacggtaaggtaaccgggtaccgttaaaaccgtacttaccgggtaaggtaaaccccggaacggttaacccggggtaacccgtttaccgttaaaccgtttaacggttacgggtacggaccgggaaagtacgggtaaggggtacgggtacggtacgttacgttacggtacggttttacggggtaagttttacgggnggtacggtacgtttaggtaaagttcggtaacggggtaccgtaaccggggtaaccgtaggttaacccgcccggtttacgttacgttaccgacgttaccctacccggtaaccggaaacggtccccggtattcccggttccccgttaccccgg

SEQ ID NO: 231612 - DNA, 1183 bp, Homo sapiens
  misc_feature: GYAE6OF02GQX0M.43.44.D11.1.454.CMB.1.raw
  modified_base (1151)..(1151): a, c, t, g, unknown or other
  misc_feature (1151)..(1151): n is a, c, g, or t
  modified_base (1154)..(1155): a, c, t, g, unknown or other
  misc_feature (1154)..(1155): n is a, c, g, or t
  modified_base (1159)..(1159): a, c, t, g, unknown or other
  misc_feature (1159)..(1159): n is a, c, g, or t
  modified_base (1161)..(1161): a, c, t, g, unknown or other
  misc_feature (1161)..(1161): n is a, c, g, or t
  modified_base (1168)..(1168): a, c, t, g, unknown or other
  misc_feature (1168)..(1168): n is a, c, g, or t
  modified_base (1170)..(1170): a, c, t, g, unknown or other
  misc_feature (1170)..(1170): n is a, c, g, or t
  modified_base (1175)..(1175): a, c, t, g, unknown or other
  misc_feature (1175)..(1175): n is a, c, g, or t
tcagtgtgagtagtcacgaccggtgctcgatttagcgcagtacgaagggggcccctgggacgcacagctcagcaccatggactggacctggaggttcctctttgtggtggcaacagcttacaggtgtccgaatcccaggtgcaactgctagcagtctgggactgaggtgaaaacgccgtgggtcctcaggtgacggtgtcctgacaagtcgtaccggaggcatcttcagcacgaccaactagtaagttgggtgacgacgcggccgtggagaggacgttagaagtcggtaggtgggggatacgtacgtacccgaggtcgttacggaaacgtaaacgtaaaccgtaccgacgtaacgtaacggtaaacggttttaccggaacgggtaccgttaaaggttaaccgtttaaccggtacgtttaaccggtacgggtacccgggttaaaccgtaacccggttaccccgtaacccgggttaaccccggtaacccgggttaacccgggttttaacggttttaccggggtaaccgggggtttaaccggggtaaaccgggtaacccggggtttaaacccggttaaaacccgtttaccgggtttacccggttaaacccggggtaaaaccccgggttaaccgggtaacccccgggggtttaacccgggtttaaccccgtttaaacccggtttttaacgggttaaccgggggtttaacccgggtacccgggttaaaaccggggtaaacgggggttaaccccgggggggttttaaccccgggggtttaaacccggggggtttaaccccggggttttttaacccccggggggtttttaacccggggggttttttaaaaccccccccggggggggggggttttttttttttaaacggggggggggggggtttttaaaaaaaccccccgggtttttttttttttaaaaccgggggggggggtttttacccccccccgggggggggggttttttaaaaacccccccgggggttttttttttaaaaccccggggggggggttttttttaaaaaccccgggggtttttttttttaaaaaaccccccccggggggggggttttttttaaaaaccccgggggggggggttttttttttttaaccccccccccggggggggggggggggggggncgnngtcntnctgctcncncagcngtctctcg

SEQ ID NO: 231613 - DNA, 701 bp, Homo sapiens
  misc_feature: GYAE6OF02J1XLM.43.44.D11.1.454.CMB.1.raw
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgctgcagtctgggactgaggtgaaaaagcctgggtcctcagtgacggtgtcctgcaagtctaccggaggcatcttcagtcagccaaactagtaagttgggtgcgacacggccctggagagacttgaatggagtggggggatcacgtcccggaggtcgttagggaacaaactaaacctacgacaaccgaggtaagtttcagggtacaagtaactttacggaattacgtaggaacggacgtactccaacgacccgagccgttaagttcggaaggtcgaaggtacggtactaacgtagtcctaggaaccgtacgtaccggtaccggttactacgttacgtacggtgtaccggaggtacggacgggtacgggtggtaacgtcgtacggttcgtttaggggacgttttaacggtgggtaccggtcgttacgtacgtttacgggttacggggaccgtaaccgggtacccggtacggtccgtaacccggttccgtacgttacgtaccgtacccgtacccgaccggtaaccgggtccctaaccgttccggttacccgttcccccgg

SEQ ID NO: 231614 - DNA, 834 bp, Homo sapiens
  misc_feature: GYAE6OF02JRFNT.43.44.D11.1.454.CMB.1.raw
  modified_base (277)..(277): a, c, t, g, unknown or other
  misc_feature (277)..(277): n is a, c, g, or t
  modified_base (638)..(638): a, c, t, g, unknown or other
  misc_feature (638)..(638): n is a, c, g, or t
tcagtgtgagtagtcacgaccggtgctcgatttagcgcagtacgaaggggcccgtgggagcacagctcagcaccatggactggacctggaggttcctctttgtggtggcaacagctacaggtgtccaatcccaggtgcaactgctgcagtctagggacctgaggtgaaaaagccgtagggcctcgtagtgacggtcgtccgtcgacaacgtcctaaccggacggaccattcgttacacgtaccgacgacccaaaacttaagtaaaccgtttggggtntaccggactaacggcccccgttaggacggtaaaggtccgttagtaagttagggacggtacggggggtacttcgaccgttccggacggttccgttaacgggaaaccgtaaaccgtaaaaccgtaccgaaccgtaacgtaaaccggtaagttttaaccggacgggtacgtaaggtaacttttacgaactttacggcggaacggaccgtacgtcccgaaacgtaccgacccgtacttaacggttacggaaggttacgaacgtacgggtaacctaccgtacgtaccgtcgtaaccgaacgtaccggtacccgttaagtacgtttaccgtaggttacggtaccgaaggtacggtacggttaccggnggttaacctcgtaccggttacgttttaggggaccgtttaggcccggtacgttccgttaagttaccgttaaaggtccggggtaacgtacccgggtaactaccgggtcctaacccggttgttacccgttcgaaacggtcccctacccggtaaccggaaccggtcccgttaacggttcccgtaccccgtttacccccgg

SEQ ID NO: 231615 - DNA, 794 bp, Homo sapiens
  misc_feature: GYAE6OF02I9JCM.43.44.D11.1.454.CMB.1.raw
  modified_base (365)..(365): a, c, t, g, unknown or other
  misc_feature (365)..(365): n is a, c, g, or t
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgacaactgctgcagtctgggactgaggtagaaaacgccgtgggtcctacgaggtggacggtgtccgtgactaacggtcgtaacggaggctacttcgttacacgcaacgacctaaaactagtaaggttgggtacgacgacgacggtcccgtagggaacgaacggtacgtagaaggtagggaggtagggggactcgacgtaccggaggtcgtaggaacgaactaacgtanacgacgaagtacggttgaggtacagtaattcgatacgtgacgacgactaccgaacgaccgacgtacgttaggttacggtaggtagacggaacggtacctaacgtctacgtcgaacggtaccgaacgggtccgtaagttaacgttacggtagtcggtaaccgaaggggtacgtacggggtaccggttacggaccgttacggttcgggttaacggtttacgggttaaggtttacccggtagggtacccgttaggttaccgtttaaggttacgggttaaccggggaccggttaaccgggaccgttaccggtaccggttaacccgggttccttaacccggttaccggtacccggtttaccccgaaccggtttaacccggacccggggttaacccgtccggttttacccccgggttacccccttaccccggggg

SEQ ID NO: 231616 - DNA, 713 bp, Homo sapiens
  misc_feature: GYAE6OF02F3RN0.43.44.D11.1.454.CMB.1.raw
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgctgcagtctgggactgaggtgaaaagcctgggtcctcagtgacggtgtcctgcaagtctaccggaggcatcttcagcagccaaactataagttggtgcgacacggcccgtggagaaggacttagatggagtggggggatcgatcccggaggtcgttaggaaaccaacaaccgtacgaccaacaagtaacgttcgagggacaaggtaatttcgtattacgtggacggactacgtccaaccgaccgacggtaccgttagtttacgggaggttagaacggtacggaccctaaagacgtcgtaggaccgaccgtaccgggtcccgtactacgttacgttaggtacggtacggaaggaggtacgggtcgggttcggacgtcgtggttcgtttgggtacgttttagtcgggtcgtcgttaggttatttacgggttcggggtaccgtaaccggggtacccgtacgggtaccgttaacccggtcctttaccggttaccgtacccgtcccgttacccggaacccgggtaacccggccccggttaaccgttcccccgggtttacccgttcccccccggg

SEQ ID NO: 231617 - DNA, 685 bp, Homo sapiens
  misc_feature: GYAE6OF02FTSU4.43.44.D11.1.454.CMB.1.raw
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgctgcagtctgggactgaggtgaaaaagcctgggtcctcagtgacggtgtcctgcaagtctaccggaggcatcttcagcagaccaaactataagttgggtagcgacacggccctggagaaggacttgaatggagtagggggggatcgacgtcccggaggcttaggaaccaacgaaacgtacgacacgaggtaagtttacgagggacaagtaatttcgtattacgtggacggtacgacctaccaacgaccgaccggaccttagttgggtaggtggaaggcggacctaacgatacgtacgtaccgaccgaccggtccgttaccgtaattaccgttcggtacgacggtaggaaggtagggccgggtacggaccgttcgttcggtcgtttaggggtagtttaggtgggtccgtgttagtagtttacggttaggggtaccctaggggtaacccgtacggtaccgtaccggttccttaccggttccgtaccggtcccttaccgacccggtaaccgggtccctacggttcccggtccctttacccccgg

SEQ ID NO: 231618 - DNA, 716 bp, Homo sapiens
  misc_feature: GYAE6OF02GZ6AJ.43.44.D11.1.454.CMB.1.raw
  modified_base (153)..(153): a, c, t, g, unknown or other
  misc_feature (153)..(153): n is a, c, g, or t
  modified_base (232)..(232): a, c, t, g, unknown or other
  misc_feature (232)..(232): n is a, c, g, or t
tcagtgtgagtagtcacgaccggtgctcgatttagcgcagtacgaagggggcccctgggagcacagctcagcaccatggactggacctggaggttcctctttgtggtggcaacagctacaggtgtccaatcccaggtgcaactgctgcagtcngggactgaggtagaaaagcctgggtcctcagtgacggtgtcctgcaagtcctacggagcactctcagcagaccaaactntaaggttggtgaccgtagacggtccccgtggaacggtaacggacgttaggaacgtggtaggtagggggactcgacggtccgaggtcgttagaaccgaactaaccgtacgacgaacaggtaacgttacgacggtaccaaggtacttacgtacgtacgtggacgtacgtacgtccgaacgaccgacggtacgtacgttacgagtacggagacggtactaacgtagtcgtacgtaccgacgtaaccggccgtttagtaaccgttacgtacggtaccggaccgaaggttaacgggacgtaccgggtacgtcccggtagttaccgggtcgtttacgggttagttacggtacgtcggtacgttacgtacggttagtaccggggaccggttaccggtaaccgtcgggtaccgtcccgttaacgttccgtaccgtacggtcccgtaacccgaccggttaacgaccccgttcggtacccgttaccgtccccgg

SEQ ID NO: 231619 - DNA, 291 bp, Homo sapiens
  misc_feature: GYAE6OF01EB0CZ.16.13.B02.1.454.CMB.1.raw
  modified_base (290)..(291): a, c, t, g, unknown or other
  misc_feature (290)..(291): n is a, c, g, or t
tcagtgtactactccacgaccggtgctcgatttagtctagcgacttcccgggattcccgaccgattctctggctccaagtctggcacgtcagccaccctgggcatcgccgggctccagactgggacgaggcctattattactgcggaacatgggatgccagcctgcgtgttgtggtgttcggcggagggaccaagctgaccgtcctcggtcagcccaaggctgccccctcggtcactctgttcccaccctcctcgagtagtacactgagcgggctggcaaggcgcatagnn

SEQ ID NO: 231620 - DNA, 292 bp, Homo sapiens
  misc_feature: GYAE6OF01DBE8N.16.13.B02.1.454.CMB.1.raw
  modified_base (289)..(292): a, c, t, g, unknown or other
  misc_feature (289)..(292): n is a, c, g, or t
tcagtgtactactccacgaccggtgctcgatttagtctagcgacttccgcgggattcccgaccgattctctggctccaagtctggcacgtcagccaccctgggcatcgccgggctccagactggggacgaggcctattattactgcggaacatgggatgccagcctgcgtgttgtggtgttcggcggagggaccaagctgaccgtcctcggtcagcccaaggctgcccctcggtcactctgttcccgcctctcgagtagtacactgagcgggctggcaaggcgcatagnnnn

SEQ ID NO: 231621 - DNA, 296 bp, Homo sapiens
  misc_feature: GYAE6OF01D9MLO.16.13.B02.1.454.CMB.1.raw
  modified_base (292)..(296): a, c, t, g, unknown or other
  misc_feature (292)..(296): n is a, c, g, or t
tcagtgtactactccacgaccggtgctcgatttagtctagcgacttcccggggattcccgaccgattctctggctccaagtctggcacgtcagccaccctgggcatcgccgggctccagactggggacgaggcctattattactgcggaacatgggatgccagcctgcgtgttgtggtgttcggcggagggaccaagctgaccgtcctcggtcagcccaaggctgccccctcggtcactctgttcccaccctcctcgagtagtacactgagcgggctggcaaggcgcatagnnnnn

SEQ ID NO: 231622 - DNA, 311 bp, Homo sapiens
  misc_feature: GYAE6OF01C7VKC.16.13.B02.1.454.CMB.1.raw
  modified_base (298)..(311): a, c, t, g, unknown or other
  misc_feature (298)..(311): n is a, c, g, or t
tcagtgtactactccacgaccggtgctcgatttagtctagcgacttcccggggattcccgaccgattctctggctccaagtctggcacgtcagccaccctgggcatcgccgggctccagactggggacgaggcctattattactgcggaacatgggatgccagcctgcgtgttgtggtgttcggcggagggaccaagctgacccgtcctcggtcagcccaaggcctgcccccctggtccactctgttccccgccctcctcgagtagtacactggagcgggctggacaaggcgcatagnnnnnnnnnnnnnn

SEQ ID NO: 231623 - DNA, 305 bp, Homo sapiens
  misc_feature: GYAE6OF01EPB8P.16.13.B02.1.454.CMB.1.raw
  modified_base (292)..(305): a, c, t, g, unknown or other
  misc_feature (292)..(305): n is a, c, g, or t
tcagtgtactactccacgaccggtgctcgatttagtctagcgacttcccggggattcccgaccgattctctggctccaagtctggcacgtcagccaccctgggcatcgccggctccagactggggacgaggcctattattactgcggaacatgggatgccagcctgcgtgttgtggtgttcggcggagggaccaagctgacgtcctcggtcagcccaaggctgccccctggtcactctcgttccccgccctcctcgagagtacactgagcgggactggcaaggcgtcatagnnnnnnnnnnnnnn

SEQ ID NO: 231624 - DNA, 292 bp, Homo sapiens
  misc_feature: GYAE6OF02HP3U5.16.13.B02.1.454.CMB.1.raw
  modified_base (291)..(292): a, c, t, g, unknown or other
  misc_feature (291)..(292): n is a, c, g, or t
tcagtgtactactccacgaccggtgctcgatttagtctagcgacttcccggggattcccgaccgattctctggctccaagtctggcacgtcagccaccctgggcatcgccgggctccagactggggacgaggcctattattactgcggaacatgggatgccagcctgcgtgttgtggtgttcggcggagggaccaagctgaccgtcctcggtcagcccaaggctgccccctggtcactctgttcccaccctcctcgagtagtacactgagcgggctggcaaggcgcatagnn

SEQ ID NO: 231625 - DNA, 296 bp, Homo sapiens
  misc_feature: GYAE6OF02HKYZL.16.13.B02.1.454.CMB.1.raw
  modified_base (290)..(296): a, c, t, g, unknown or other
  misc_feature (290)..(296): n is a, c, g, or t
tcagtgtactactccacgaccggtgctcgatttagtctagcgacttcccggggattcccgaccgattctctggctccaagtctggcacgtcagccaccctgggcatcgccgggctccagactggggacgaggcctattattactgcggaacatgggatgccagcctgcgtgttgtggtgttcggcggagggaccaagctgaccgtctcggtcagcccaaggctgccccctggtcactctgttcccaccctcctcgagtagtacactgagcgggctggcaaggcgcatagnnnnnnn

SEQ ID NO: 231626 - DNA, 294 bp, Homo sapiens
  misc_feature: GYAE6OF02IUNGF.16.13.B02.1.454.CMB.1.raw
  modified_base (290)..(294): a, c, t, g, unknown or other
  misc_feature (290)..(294): n is a, c, g, or t
tcagtgtactactccacgaccggtgctcgatttagtctagcgacttcccggggattcccgaccgattctctggctccaagtctggcacgtcagccaccctgggcatcgccgggctccagactggggacgaggcctattattactgcggaacatgggatgccagcctgcgtgttgtggtgttcggcggagggccaagctgaccgtcctcggtcagcccaaggctgccccctggtcactctgttccccacctcctcgagtagtacactgagcgggctggcaaggcgcatagnnnnn

SEQ ID NO: 231627 - DNA, 509 bp, Homo sapiens
  misc_feature: GYAE6OF01B0XMC.36.21.B10.1.454.CMB.1.raw
  modified_base (350)..(350): a, c, t, g, unknown or other
  misc_feature (350)..(350): n is a, c, g, or t
tcagtacgctgtctcacgaccggtgctcgatttagtgtcgtcgcaagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggttcccaggctcatcatctatggtgcatccaccagggccactggtatcccagccacctttagtggcagtgggtctgggacngagttcacgtctcaccatcagcagcctgcagtctgaagtattttgctagtttattactgtacaactatacaatgactggcctctctactttcgggcggtacgggaccgaaggtggagataccgaaagtacgtggtggacgtgacaccatctgtcttacg

SEQ ID NO: 231628 - DNA, 496 bp, Homo sapiens
  misc_feature: GYAE6OF01EIEJT.36.21.B10.1.454.CMB.1.raw
  modified_base (413)..(413): a, c, t, g, unknown or other
  misc_feature (413)..(413): n is a, c, g, or t
tcagtacgctgtctcacgaccggtgctcgatttagtgtcgtcgcaagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggttcccaggctcatcatctatggtgcatccaccagggccactggtatcccagccacctttagtggcagtgggtctgggacagagttcactctcaccatcagcagcctgcagtctgaagtattttgctagtttattactgtcaanagtaacaatgactggcctctcacgtttcggcggagggaccaaggtggagatcgaaagactggtggctagcacatctgtcttac

SEQ ID NO: 231629 - DNA, 563 bp, Homo sapiens
  misc_feature: GYAE6OF01BO7SC.36.21.B10.1.454.CMB.1.raw
  modified_base (379)..(379): a, c, t, g, unknown or other
  misc_feature (379)..(379): n is a, c, g, or t
tcagtacgctgtctcacgaccggtgctcgatttagtgtcgtcgcaagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcaagaacctggccaggttcccaggctcatcatctatggtgcatccaccgagggccacgtggtactcccagtcctacgtttagcggctaggtgggtctgggactagagttcactctacaccatcancagcctgctagtctagtaacgtatttgacttagtttattactgtacaactagtaacaatcgacgtcggccttctcctacgtttccgggacgggtaacgggaccgtaagggtacggtagaacgtaacgaaaggtaaccgttggacggtacgtcggtacctaaccgtattcgttcgttcgttaccg

SEQ ID NO: 231630 - DNA, 551 bp, Homo sapiens
  misc_feature: GYAE6OF01A12NN.36.21.B10.1.454.CMB.1.raw
  modified_base (398)..(398): a, c, t, g, unknown or other
  misc_feature (398)..(398): n is a, c, g, or t
tcagtacgctgtctcacgaccggtgctcgatttagtgtcgtcgcaagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggttcccaggctcatcatctatggtgcatccaccgagggccacgtggtactccccagccctacctttagcggcaggtgggtctgggacagagttcactctcaccatcgagcagcctgcagtctagaagtnttttggacttagtttattactagtacaactagtaactaagtgtactcggtccttctaccttacggtttacgggacgggaacggtaccgtaagggtggaagtacgtacgaaacgtacgtggtcggctacgtaccgacctatcgttgtcttaccg

SEQ ID NO: 231631 - DNA, 517 bp, Homo sapiens
  misc_feature: GYAE6OF01CQP2E.36.21.B10.1.454.CMB.1.raw
  modified_base (331)..(331): a, c, t, g, unknown or other
  misc_feature (331)..(331): n is a, c, g, or t
  modified_base (440)..(440): a, c, t, g, unknown or other
  misc_feature (440)..(440): n is a, c, g, or t
tcagtacgctgtctcacgaccggtgctcgatttagtgtcgtcgcaaggggggaggaactgctcagttaggacccagacggaaccatggaagccccagcgcagcttctcttcctcctgctactctggctcccagatatcactggagaaatagtgatgacgcagtctccagccaccctatctgtgtctccaggagaaaagagccaccctctcctgtagggccagtcagagtgttagcagcaacttgcctggtaccagcagaaacctggccaggttccaggctcatcatctatggtgcatccaccagggccactggtatcccagccactttagngcagtgggtctgggacagagttcgacttctcaccatcagcagcctgcagtctagaagtattttgctagttttattactgttacaactagtaacaatgactggctctacnctttcgggcggacggaccgaaggtcggaagacgtacgaaacgtaacgtggtaggctgtccacattctgttcgttacc

SEQ ID NO: 231632 - DNA, 489 bp, Homo sapiens
  misc_feature: GYAE6OF01B9V8D.36.21.B10.1.454.CMB.1.raw
  modified_base (475)..(475): a, c, t, g, unknown or other
  misc_feature (475)..(475): n is a, c, g, or t
tcagtacgctgtctcacgaccggtgctcgatttagtgtcgtcgcaagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggttcccaggctcatcatctatggtgcatccaccagggccactggtatcccagccacctttagtgcagtgggtctgggacagagttcactctcaccatcagcagcctgcagtctgaagtatttgctagtttattactgtcaacagtacaatgactggcctctctactttcggcggaggaccgaggtggagagtcaacgagtgcggcngcacatctgtctac

SEQ ID NO: 231633 - DNA, 809 bp, Homo sapiens
  misc_feature: GYAE6OF01D6LAF.36.21.B10.1.454.CMB.1.raw
  modified_base (231)..(231): a, c, t, g, unknown or other
  misc_feature (231)..(231): n is a, c, g, or t
tcagtacgctgtctcacgaccggtgctcgatttagtgtcgtcgcaaggagtagagggggaggaactgctcgacgttacggacccagacggaaccaatggaagaccccagtcgcgtacgtccttcctcctttccgtccgtgctacctcctggcttccccgagatacccacgtggagaaatgtgatgacgcgagtctccgagccacctgtcctgtcgtcctccgagggaaacncgccacccttcgttcctgcgtacgggcctagtcagtacgtgttaaacgaattacgttagcctacggtaacccaacgacgacgaccgtggccgacggtcgtcccgaggactcctacacttctagtggtgacactacccaccgacgggccctacgtggtactccgacgccagttacaaggtcgacgtacggtacggtcgtacggaactacgtacggttccaccgttcgaacctacctacgttaccgacgtacccgtaaaccgtcggaccgtacgttaccggtaacggtaaacggtttacgtttttacggacttttaaacggtttttaactttaccggtttacgttaccgtaaacggtccgttaaagggttaaactttaaacgttgggttaaacccgtaaccggggttaccccgttaacccgggggtttaaccttttcgggacccggtttaacggggtacccgtaaacgggttccggtacgggtaacggtaaccggtttaaccgaaaacccgggtaacgttccgggtaccggtaccgtttaccggacccgttaaccgtaccgttccgccggtttaaccccg

SEQ ID NO: 231634 - DNA, 600 bp, Homo sapiens
  misc_feature: GYAE6OF01C3XE9.36.21.B10.1.454.CMB.1.raw
  modified_base (225)..(225): a, c, t, g, unknown or other
  misc_feature (225)..(225): n is a, c, g, or t
  modified_base (334)..(334): a, c, t, g, unknown or other
  misc_feature (334)..(334): n is a, c, g, or t
tcagtacgctgtctcacgaccggtgctcgatttagtgtcgtcgcaaggagtagaggggggaggaactgctcgagttaggacccagacggaaccatggaagaccccagcgcgtagtccttcctccttccgtccgtgctactcctggctccccgagatacccacgtggagaaatgtgatgacgcgagtctccgagccaccctgtcctggtcgtcctccgaggggaancgccaccctctcctgcgagggccctagtcagtagtgttaacgaatacttagcctggtaccaacacgacgaccgtggccgaggctccgaggactcctcatctagtgggtncactacccaccgacgggcccacgtggtactcccgagcccaggttcagtcggactaggtcgggtctgggaacagtacgttccactcgacaccagtcacgtccaccgtcgccgacgtcgtacgaacgtatttgtacttagtttattactgtcgagcgtagtataatgacgtacggtccgtacggtactttcggccgtagggtccgtaggtcgtcggacgtacgtacgaaacggtacgtcggtcgacgtcgaccacactcgtcgtaccg

SEQ ID NO: 231635 - DNA, 532 bp, Homo sapiens
  misc_feature: GYAE6OF01BQ0N3.36.21.B10.1.454.CMB.1.raw
  modified_base (196)..(196): a, c, t, g, unknown or other
  misc_feature (196)..(196): n is a, c, g, or t
  modified_base (352)..(352): a, c, t, g, unknown or other
  misc_feature (352)..(352): n is a, c, g, or t
  modified_base (393)..(393): a, c, t, g, unknown or other
  misc_feature (393)..(393): n is a, c, g, or t
  modified_base (398)..(398): a, c, t, g, unknown or other
  misc_feature (398)..(398): n is a, c, g, or t
tcagtacgctgtctcacgaccggtgctcgatttagtgtcgtcgcaagggggaggaactgctcagttaggacccagacggaaccatggaagccccagcgcagcttctcttcctcctgctactctggctcccagatatcactggagaatagtgatgacgcagtctccagccaccctatctgtgtctccaggagaaagngccaccctctcctgtacggccagtcagagtgttagcagcaacttagcctggtaccagcagaaacctgccaggtccaggctcatcatctatggtgcatccaccagggccaacgtggtactccccagccctacctttagcggcagtgggtctgggacnggattcactctcacctatcagcagcctgcagtctagaagtnttttnctagttttattactgtacaactagtacaattgacttggccttctctacgtttcgggacggtagggaccgtaagggtggagtacgtacgaaacgacttggtcggctggaccctacgacttcgttcgtccttaccg

SEQ ID NO: 231636 - DNA, 635 bp, Homo sapiens
  misc_feature: GYAE6OF01B3O6W.36.21.B10.1.454.CMB.1.raw
  modified_base (292)..(292): a, c, t, g, unknown or other
  misc_feature (292)..(292): n is a, c, g, or t
tcagtacgctgtctcacgaccggtgctcgatttagtgtcgtcgcaagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttgcctggtaccagcagaacctggaccaggttccaggctcatcatctatggtncatccacgacggccacgtcggtactcccgagtccctacgtttaggcggctagggttcgggtctagggactaggtacgttcacttccgtacacctagttaccgacgccaagtcctgaccgtagtcgtagtaacgttatttcgacttagttttatactgtacaacgtagtaaccaagttcgtaaccgtcggtacccttcgtaccgttacggtttaccggggacgggtaaacggggtaacccgtaaggggttacgggaaagtaaccgtaaccggtaaaacgggtacggttcgggtacggaccgtttacggaccctaacgttaacgttccgttggttccctttaccg

SEQ ID NO: 231637 - DNA, 617 bp, Homo sapiens
  misc_feature: GYAE6OF01A147X.36.21.B10.1.454.CMB.1.raw
tcagtacgctgtctcacgaccggtgctcgatttagtgtcgtcgcaagggggaggaactgactcagttaggacccagacggaaccatggaagccccagcgcagcttctcttcctcctgctactctggctccagatatcactggagaatagtgatgacgcagtctccagccacctatctgtgtctccaggagaagcgccacctctcctggtacggccagtcagagtgttagcagctaacttagcctggtaccagcagaacctggaccaggttccaggctacatcatcgtagtggtgctacgtccacgacgggcctacgttacggtactacccgagtaccctaacgtttaggtcggactagggttcgggtcgtaggggaacctagggtacgtttccaccgttctaccgaacctagtaccacgcaaccgtccctcggactacggttacgtaggtaacgttagttttcggactttaagttttactacgttagtaccaacgtagtaactaagtcgtaccttcggtacccttacgttacgttacgtttacgggacggtacgggaacggtagggtcgtaagtacgtacgaacgtagtgtacgctcgaccactagtctgttctacg

SEQ ID NO: 231638 - DNA, 574 bp, Homo sapiens
  misc_feature: GYAE6OF01DJIZB.36.21.B10.1.454.CMB.1.raw
  modified_base (349)..(349): a, c, t, g, unknown or other
  misc_feature (349)..(349): n is a, c, g, or t
  modified_base (409)..(409): a, c, t, g, unknown or other
  misc_feature (409)..(409): n is a, c, g, or t
tcagtacgctgtctcacgaccggtgctcgatttagtgtcgtcgcaaggggggaggaactgctcagttaggacccagacggaaccatggaagccccagcgcagcttctcttcctcctgctactctggctcccagatatcactggagaaatagtgatgacgcagtctccagccaccctatctgtgtctccaggagaaaagacgcccaccctctcctggtacgggccagtcagagtgtagcagcaacttgcctggtaccagacagaaacctggccaggttcccaggctcatcatctagtggtcgcactcccacgacgggcctagtcggtactcccagccctactttagcggntaggtcgggtctgggactagacgttcactcctcacctatcagcacgctgcagtctgaatntttgacttagtttatacgtgtacaatagtaacagtgacgtcggtccttctcgttacgtttccggggacggtaacggggtaacctaaggggtaggaacgtaacgtaaccgaaaacgtacgttggtacgggtcctaggccctaacgtagtccgttgttacccttacg

SEQ ID NO: 231639 - DNA, 515 bp, Homo sapiens
  misc_feature: GYAE6OF01APGVV.36.21.B10.1.454.CMB.1.raw
  modified_base (331)..(331): a, c, t, g, unknown or other
  misc_feature (331)..(331): n is a, c, g, or t
tcagtacgctgtctcacgaccggtgctcgatttagtgtcgtcgcaagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaacctggccaggttcccaggctcatcatctatggtgcatccaccagggccactggtatcccagcccactttagnggcagtgggtctgggacagagttcactctcaccatcagcagcctgcagtctagaagtattttgctagtttattacgtgtactaactagtacaatgaactcggcctctctacgtttcgggcggacgggacaggtcggagtacgtacgtaaacgacgtgtcgtctcgacaccattctgtcttaccg

SEQ ID NO: 231640 - DNA, 556 bp, Homo sapiens
  misc_feature: GYAE6OF01BCSLM.36.21.B10.1.454.CMB.1.raw
  modified_base (197)..(197): a, c, t, g, unknown or other
  misc_feature (197)..(197): n is a, c, g, or t
tcagtacgctgtctcacgaccggtgctcgatttagtgtcgtcgcaagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagngccaccctctcctgtagggccagtcagagtgttagcagcaacttagcctggtaccagcagaaacctggccaggttccaggctcatcatctagtggtgcatccaccgagggccagtggtactcccacgccctaccgtttaggtcggcgtaggtgggtcgtgggactagacgttcacgtctacaccatcagcacgcctgcagtctagaagttattttgcttaagtttattactgtactaactagtaataatgaactggccttctcgtacgtttcgggacgggtaacgggaccgtaagggtggaagtacgtacgtaaagacgttcggtggactcggacctacctagttccttgttccttacg

SEQ ID NO: 231641 - DNA, 618 bp, Homo sapiens
  misc_feature: GYAE6OF01ATWOG.36.21.B10.1.454.CMB.1.raw
tcagtacgctgtctcacgaccggtgctcgatttagtgtcgtcgcaagggggaggaactgctcagttaggacccagacggaaccatggaagccccagcgcagcttctcttcctcctgctactctggctcccagatatcactggagaaatagtgatgacgcagtctccagcccaccctatctgtgtctccaggagaaagacgcccaccctctccgtgtacgggccagtcagagtgttagcagcaacttagcctggtaccagcagaacctggccaggttcccaggctcatcatctatggtgcatcccgaccgagggcctacgtcggtactcccgagtccctaaccgttttaggcgcgtaggttcgggtcgtaggggacctaggtacgttccgacttctaccgaacctatcccgaagctaacgtccgtcgacgtacgttacctaggaagttatttttacggacttaaggttttacttacgtagttaccaaagtacgtaactagttgaccgttcggtccttacgttactaccgtttacgggacggacggaacccgtaggggtcgaagtacgtaacgaaacgtcgtcggtcgctacggtaccacgtatcgttacgttcttaccg

SEQ ID NO: 231642 - DNA, 542 bp, Homo sapiens
  misc_feature: GYAE6OF01EO9AH.36.21.B10.1.454.CMB.1.raw
  modified_base (265)..(265): a, c, t, g, unknown or other
  misc_feature (265)..(265): n is a, c, g, or t
  modified_base (399)..(399): a, c, t, g, unknown or other
  misc_feature (399)..(399): n is a, c, g, or t
  modified_base (510)..(510): a, c, t, g, unknown or other
  misc_feature (510)..(510): n is a, c, g, or t
tcagtacgctgtctcacgaccggtgctcgatttagtgtcgtcgcaagggggaggaactgctcagttaggacccagacggaaccatggaagccccagcgcagcttctcttcctcctgctactctggctcccagatatcactgggagaaatagtgatgacgcagtctccagccaccctatctgtgtctccaggagaaagagcccaccctctcctgtagggccagtcagagtgttagcagcaacttagcctggtaccagcagaaaccnggaccaggttccaggctcatcatctatggtgcatccacagggccactggtactcccagcctaaccgtttagcggctaggtcgggtctggggacagtagtcactctcaccatcagcagtcctgcagtctgaagtntttgcttagtttattactgtacaatagtacaatcgtactcggccttctaccgtactttcgggacgggtaacgggacgtagggtggaacgtagtaccgtaaagacgttcggnggactcgactaacccattcctggttcttaccg

SEQ ID NO: 231643 - DNA, 709 bp, Homo sapiens
  misc_feature: GYAE6OF01ARRXP.36.21.B10.1.454.CMB.1.raw
tcagtacgctgtctcacgaccggtgctcgatttagtgtcgtcgcaagggggaggaactgctcagttaggacccagacggaaccatggaaaccccagcgcagcttctcttcctcctgctactctggctcccagacaccaccggagaggttgtgttgacgcagtttccagacaccctgtctttgtctccaggagacagagccaccctctcctgcagggccagtcagagtatcagaagcgactacgtagcctggtaccgcagaaacctggccaggcctccagtctcctcatctatgatgcactccaggtacggccgctcggcacgtcccgaagacgtaggttcaggtcggcgtaggtgggtcgtggggacctacgtaccgttcgaaccgtccttacgaacccgtataccgagtaccgacggtaaccgttaccgggtaaccccgtagggaaacgttacgttttacggacgttaacggtttaccttaacgttttaaccggttaccgttacgtacggtaccgtaacggttaagtacgggttaaactaaccgtaacccggttccgggtaaccgtttaccgggaccgtaaacggggaaccgtaaggggtaacgtaaaacgtacgaaaaccgggtaacgtacgggtacggaccgttacggaccgtaccgtagttaccgttacggtttacttaccgtacgttcccgttacccgtacccg

SEQ ID NO: 231644 - DNA, 658 bp, Homo sapiens
  misc_feature: GYAE6OF01EORDW.36.21.B10.1.454.CMB.1.raw
  modified_base (446)..(446): a, c, t, g, unknown or other
  misc_feature (446)..(446): n is a, c, g, or t
tcagtacgctgtctcacgaccggtgctcgatttagtgtcgtcgcaaggggggaggaactgctcagttaggacccagacggaaccatggaagccccagcgcagcttctcttcctcctgctactctggctcccagatatcactggagaaatagtgatgacgcagtctccagccaccctatctgtcgtctccaggagaaagcgacccaccctctccgtggtacgggcctagtcagagttgttagcagctaacgttcgcctaggtaccagcaacgaacctggacctacggtcccaggtctactactctatctagtcggtgcctacgtcccaccggacgggcctacgtcggtactacccacgtcccttaccgtttggcggcgtagggttcgggtacgtgggacaggtacgttctactcctcacctagtcacgcgactccgagctacggttntaggtaagttgttttcgacgtttacgtttaattacgttacgtacaacttacgtaactacgttgtaccgtcgtcccttacgcgtttaacgttccggggacgggaacggtaccgggtaagggtcggtaacgtacggaaacccgtaagggttaacggttgggtaccgttacgacggtaccccttacgtacgtttccttacggttcccttaacccg

SEQ ID NO: 231645 - DNA, 625 bp, Homo sapiens
  misc_feature: GYAE6OF01CJG2V.36.21.B10.1.454.CMB.1.raw
  modified_base (192)..(192): a, c, t, g, unknown or other
  misc_feature (192)..(192): n is a, c, g, or t
  modified_base (197)..(197): a, c, t, g, unknown or other
  misc_feature (197)..(197): n is a, c, g, or t
  modified_base (224)..(224): a, c, t, g, unknown or other
  misc_feature (224)..(224): n is a, c, g, or t
  modified_base (291)..(291): a, c, t, g, unknown or other
  misc_feature (291)..(291): n is a, c, g, or t
tcagtacgctgtctcacgaccggtgctcgatttagtgtcgtcgcaagggggaggaactgctcagttaggacccagacggaaccatggaagccccagcgcagcttctcttcctcctgctactctggctcccagatatcactggagaaatagtgatgacgcagtctccagccaccctatctgtgtctccagganaaagngccacctctcctgtagggccagtcagngtgttagcagcaattgcctggtaccagcagaacctggcctacggttccaggctcatcatctagtggncatccacgagggccacgtgcactccagccgtaggttcaggtcgcgaggttgggtcgtcgggacacgtacttcgactcctaccgacctatcacgccacggtaccctaaggaacccttggtaaagttacgttttgactttaaggtttttataccgttagtaccgaggttaccgaagggtcggtaacggtaccgggtttcccggttttacccggggcccgttaaagggggaaccctaaagggttcgaacttacgaaccgtaaaagtacgtcggtggccttacggacctaaccgtatttccgttacgttcccttagtccgttcccccgttccgtaacg

SEQ ID NO: 231646 - DNA, 591 bp, Homo sapiens
  misc_feature: GYAE6OF01CA4UF.36.21.B10.1.454.CMB.1.raw
  modified_base (292)..(292): a, c, t, g, unknown or other
  misc_feature (292)..(292): n is a, c, g, or t
  modified_base (374)..(374): a, c, t, g, unknown or other
  misc_feature (374)..(374): n is a, c, g, or t
tcagtacgctgtctcacgaccggtgctcgatttagtgtcgtcgcaagggggaggaactgctcagttaggacccagacggaaccatggaagccccagcgcagcttctcttcctcctgctactctggctcccagatatcactggagaaatagtgatgagcagtctccagccaccctatctgtgtctccaggagaaagcgcccaccctctcctgtagggccagtcagagtgttagcagcaacttagcctggtaccagcagaacctggccaggttccaggctcatcatctatggtncactccaccgagggccacgtggtactcccagccctactttaggcggctaggtggggtcctgggaacaggtacgttcacttcncacctatcagccagcctgctagtcctagagttatttggactagttttacttacgtgttaccaaagtacgttaacaagttcgacttacggtccctctaccgttacggtttcgggacgggtaaggacccgtaaggggtcggaacggtaacgtaaccgtaaaacggacgttcggtacggtaccttacggacctaccgtacttcgttaacggttcttaccg

SEQ ID NO: 231647 - DNA, 600 bp, Homo sapiens
  misc_feature: GYAE6OF01A4UWB.36.21.B10.1.454.CMB.1.raw
  modified_base (195)..(195): a, c, t, g, unknown or other
  misc_feature (195)..(195): n is a, c, g, or t
tcagtacgctgtctcacgaccggtgctcgatttagtgtcgtcgcaagggggaggaacgtgctcagttaggacccagacggaaccgatggaagccccagcgcagcttctcttcctcctgcttactctggctcccagatatcactggagaaatgtgatgacgcagtcctccagcccacctatctgtgtctcgagganaagcgccacctctcgtgtacggccagtcaggagtgttagctagctaacgttgcctaggtaaccagactaacgaacctggcctacgggttcccaggctacgatcatctagtcggtcgcacgtccacgacggtctacgtgtacctcccgagtccgtacgttacgcgacgtaggttcgggtacgtcgggaactacgtcgtcctacgtccttacacctagtacgacgtcacgtcctgacgtagttcgtagtaactgtttagactttagtttaagtcgtacgtactaagtagttaactacgtacgtacgttccgtacttacgtacgtttacggtccgggtacggtacggtaaccgtaggtagaacggtactaacgaacgtgtcggcgcagtaccactgtcgtctcttacg

SEQ ID NO: 231648 - DNA, 774 bp, Homo sapiens
  misc_feature: GYAE6OF01D3C8E.36.21.B10.1.454.CMB.1.raw
tcagtacgctgtctcacgaccggtgctcgatttagtgtcgtcgcaagggggaggaactgctcagttaggacccagacggaaccatggaagccccagcgcagcttctcttcctcctgctactctggctccagatatcactggagaatagtgatgacgcagtctccagccacctatctgtcgtctccgaggagaaagcgcccaccctctccgtggtacgggccagtcagtagttgtacgcagacctaacgtttcgccgttagggtaaccagaccgtaaacggaaacccgttcgggacccgtaacgggtttacccgaagggtccttaccaacttccgtaactttccgtttaaggttcgggttacgacctaaccgtacccgaaccggtacggggtaccctacggttcggtaacctcccgaacgtcccgttaacgtttacggcggtacgttagggttcggggtacggttacggggaactaacgggttacgttccaaccgttacctaccgtaacctacgttccgacgtaccgtaccggtccgtacgggtaccttacggttaccgtaagggttaaacgttttcgttttaacggtacgttttaaggtttttaacctacgttacgtaacctaaacggtacgtttaacacgttacggtaccgttcggccctttacgtacccgttacggtttaccgggacgggtaaccgggtacgaacggggtgaaacgtacgtaaccgaaacggttcgtcggtcggacctcgacctactatcgtcttaccgtcg

SEQ ID NO: 231649 - DNA, 798 bp, Homo sapiens
  misc_feature: GYAE6OF01DXGO2.36.21.B10.1.454.CMB.1.raw
  modified_base (178)..(178): a, c, t, g, unknown or other
  misc_feature (178)..(178): n is a, c, g, or t
  modified_base (194)..(194): a, c, t, g, unknown or other
  misc_feature (194)..(194): n is a, c, g, or t
  modified_base (199)..(199): a, c, t, g, unknown or other
  misc_feature (199)..(199): n is a, c, g, or t
tcagtacgctgtctcacgaccggtgctcgatttagtgtcgtcgcaagggggaggaactgctcagttaggacccagacggaaccatggaagccccagcgcagcttctcttcctcctgctactctggcctccagatatcactggagaaatagtgatgacgcagtcctccagcccaccctntctgtgtctcgagganaagcnccacctctcgtgtacggcagtcagtagtgtagcagactaacgttcgccgtacggtaaccaggtaccgaaacgaaccgtcggacctacggttcccgacggtcctacgactctactacgttaggtcggtacacctaccgtacccgaaccggaccgggtacctaacggttaccggtacctaccccgtacgtccctttaacggttttacggaccggtcggttaggggtttaccggggtacgtaacggggtaacgtaacggttacgtttaaccctacccgtaccttacccgaaaccgtacgttcccggaacgtaccgtaaccgtcccgttacggtaccgttaacggttaccggtaaacggttaaggttttacgttttacgtaacgtttttaacggtttacgtttaaccgttacggttaaccctaaacggtaacttaaacgtacggttaccgtacggttccgtaccctttacctacccggtttacggtccggggaacgggttacgggaaaccgtaggggtaaccggaactaacggtaaaccgtaacggttacggtggttaccggacttcggacccttaacgtcgtttaccgttcgttacttcccg

SEQ ID NO: 231650 - DNA, 658 bp, Homo sapiens
  misc_feature: GYAE6OF01EXB6C.36.21.B10.1.454.CMB.1.raw
  modified_base (196)..(196): a, c, t, g, unknown or other
  misc_feature (196)..(196): n is a, c, g, or t
  modified_base (523)..(523): a, c, t, g, unknown or other
  misc_feature (523)..(523): n is a, c, g, or t
tcagtacgctgtctcacgaccggtgctcgatttagtgtcgtcgcaagggggaggaactgctcagttaggacccagacggaaccatggaagccccagcgcagcttctcttcctcctgctactctggctcccagatatcactggagaaatagtgatgacgcagtctccagccacctatctgtgtctccaggagaaagngccacctctcctgtacgggccagtcagagtgttagcagctaacttacgctaggtaccagacacgaaaccgtcggacctacgggttccaggcctacactctactactagtcggtcgacactacccgaccgacgggcctacgttacggtaactccccgacggtcccttaaccgtttaggacgtcgtagggtcgggtacgtcgggaactaggtacgttcctacctctacacctacgtacacggtccagtccctgactacggttctaaggtaagtttacgttttcggaactttagtttttaacgttaacttacgtaactaaataaccgtanaagtcgtactacgtccgttacgtaccgttacggtttccgggacggtaggaaaccggttagggacggtaaagtaccgtaacggaaaacgttagtggtacgtactacgaccgttacctagttcgttcgttacgtacc

SEQ ID NO: 231651 - DNA, 798 bp, Homo sapiens
  misc_feature: GYAE6OF01A6U2R.36.21.B10.1.454.CMB.1.raw
  modified_base (159)..(159): a, c, t, g, unknown or other
  misc_feature (159)..(159): n is a, c, g, or t
  modified_base (202)..(202): a, c, t, g, unknown or other
  misc_feature (202)..(202): n is a, c, g, or t
tcagtacgctgtctcacgaccggtgctcgatttagtgtcgtcgcaagggggaggaactgctcagttaggacccagacggaaccatggaagccccagcgcagcttctcttcctcctgctactctggctcccagatatcactggagaaatagtgatgacgnagtctccgagcccacctatctgtcgtcctccgaggagaaagcncccacctctcgtggtacgggccaggtcagtagtgtagcagctaacttgcctaggtacagacacgaaccgtggacctacggttcccgaggtctacacgtcacttcgtagtcgggtacacctacgtcccgaaccgacgggaccctaggtcggttacctaccccgaccgtacccgttaaccggtttaggccggtacggttacgggttacgggggtaccctacgggggtaacctaaggggttaccctttacgacccgtttaccaccgttaaccgtaccttaccggaaccggtacctaacggcccgttagaccggtaaggttaccgtaaggttaaccgttaggttttaccgacgtttaacggtttttacgtaacgttacgttaaccgaacggtttaacgtaaccgtaaggtcccgttaaccgggttcccgtacccttacggtttaaccggttaccgggtttaccggggacggggttaaacgggaacccggtaaagggttccggggtaaattaaccggtaaaccgtaaaccgggtaaggttccggtaacggggtccttaacggaccgtaaccgttatttcccgtaccggtttccttaaccgg

SEQ ID NO: 231652 - DNA, 679 bp, Homo sapiens
  misc_feature: GYAE6OF01BTROB.36.21.B10.1.454.CMB.1.raw
  modified_base (197)..(197): a, c, t, g, unknown or other
  misc_feature (197)..(197): n is a, c, g, or t
  modified_base (300)..(300): a, c, t, g, unknown or other
  misc_feature (300)..(300): n is a, c, g, or t
  modified_base (304)..(304): a, c, t, g, unknown or other
  misc_feature (304)..(304): n is a, c, g, or t
tcagtacgctgtctcacgaccggtgctcgatttagtgtcgtcgcaagggggaggaactgctcagttaggacccagacggaaccatggaagccccagcgcagcttctcttcctcctgctactctggctcccagatatcactggagaaatagtgatgacgcagtctccagcccacctatctgtgtctccaggagaaagngcccacctctccgtggtacgggccagtcaggtgtgttagcagctaacgttagcctggtaccagtcaagaaccctggccacggttcccaggctcaatcatctanggtnctatccaccgaggccagtcggtactcccgagtccctaacgtttggcggcgtagggttcgggtacgtacggggactagggtacgttacaccgttccttaccgaaccgtatacccggagccgtaacgtcgtacgacgtagttaccgttaaggtaagtttacgtttacgtacgtttaacgttttacttaccgtacgttaactaaccgtaacgtaacctaagttacggtaacgttccgggtacccttacggttaccttaccgggtttacgggaaccggggtaacggacccggtaagggtaccggaacgtacgtaaccgtaaacggtaccgttgggtacgccttacggtaccaccgtacgttccgtacgttccgttaccg

SEQ ID NO: 231653 - DNA, 798 bp, Homo sapiens
  misc_feature: GYAE6OF01DS593.36.21.B10.1.454.CMB.1.raw
  modified_base (147)..(147): a, c, t, g, unknown or other
  misc_feature (147)..(147): n is a, c, g, or t
tcagtacgctgtctcacgaccggtgctcgatttagtgtcgtcgcaagggggaggaactgctcagttaggacccagacggaaccatggaagccccagcgcagcttctcttcctcctgctactctggcctcccagatatcacgtggaanaaatgtgatggacgcagtcctccacgaccctacctatctgtcgtcctacgaggaagaaacgcgccctaccctcgtccgtggtacggctagtcgagtagttgtagcaacgactaacgttcgaccgtacggtaccagaccgaacgtaaaccgtcggtacctacgggttcccgagtcctcaacttccgtacttacgtacgtcgggtactacctaccgtacccgaaccggtaccggggaccctacggttacggtaccctaccccgaccgtacccgttacgtttacggtcggaccggtaggggttcgggtacgtacgggtaaccgtaggttacgttacctaccgttacctaacctacccagttaccgaacgtcgtacctccggtcgtacgtacgtttacgtaacggtaacttttgtttaccgtaacgttttaaggttttaacctttacgttaacgttaaccgtaacgttaacgtaacgttaaggtaccgtaacccgtttcgacccgttttacccgtttacgttacccggggttaaccgggacggggtaaacccgggtacgtaaacggggtactaacggttaaacccgtaaggaaacccgttggttaccgtacggtcctacggtacctacggtcttaaccgttcgttactaaccccg

SEQ ID NO: 231654 - DNA, 669 bp, Homo sapiens
  misc_feature: GYAE6OF01CAKGO.36.21.B10.1.454.CMB.1.raw
  modified_base (176)..(176): a, c, t, g, unknown or other
  misc_feature (176)..(176): n is a, c, g, or t
  modified_base (638)..(638): a, c, t, g, unknown or other
  misc_feature (638)..(638): n is a, c, g, or t
tcagtacgctgtctcacgaccggtgctcgatttagtgtcgtcgcaaggggggaggaactgctcagttaggacccagacggaaccatggaagccccagcgcagcttctcttcctcctgctactctggctcccagatatcactggagaaatagtgatgacgcagtctccagccacctntctgtgtctcaggagaaagcgccctacctctccgtggtacgggccagtcaggtagtgtagctagctaattacgccgtaggtaccaggacaacggtaaacctcggaccctacggttcccgaggcctacacttacagttccgtaagtcgggtcacctactcccgaaccgtacgggaccctaacgtcgggtacctccccgaacgtaccctaaccggttttaggcggtacgtacgggttcggggtacgtacgggacgtaagtacgttccaaccttcgtaccaccgtactacgacgtccacgtccgtgacgtagttcgtaagtaacgttcgtttagactttaagtttacgttctacgtacaaactagtaactagtcgtacgtcggttacctctacggtacggttccgggacggtaacgggtaacgtagggagtaacgtacgtaacgtaaacggtcgtgggtacgtanccggtacacttagtccttagtccgttacccg

SEQ ID NO: 231655 - DNA, 686 bp, Homo sapiens
  misc_feature: GYAE6OF01D6BJI.36.21.B10.1.454.CMB.1.raw
  modified_base (218)..(218): a, c, t, g, unknown or other
  misc_feature (218)..(218): n is a, c, g, or t
  modified_base (251)..(251): a, c, t, g, unknown or other
  misc_feature (251)..(251): n is a, c, g, or t
tcagtacgctgtctcacgaccggtgctcgatttagtgtcgtcgcaagagaggaggggggaggaactgctcagttaggacccagacggaaccatggaacgcccagcgcagcttctcttcctcctgctactctggctcccagactaccacgtggaagtaaaatgtgatagactcagtccaccacgccctacctgtctgtcgtcctacggaaggggaaacncgccctacctcgtcgcgacgacgggcctaggtnaagtacgttaacgtaaacacttaacgttcgccgttaacggtaaccaacgtaacgtaccgtaccggtccggtaccgaacggtaccctcccggaacggttccctcgtaccgtacgttacgtagtcggtacaccgtacctacccgacgacggtctacggttacgtaccacccgtacgaccggtgtaccgaggtcggacgtaggtcggtacgtggactggtactcacctctacactcgacgacgctactcgacgtactacgtacgtagttacgtcgttattagttacgtgtacgtacgtacgtacgtagtaatacggtaacgtaccggtaccgtaccggtacggttacggtcggtacggacggacgtaccgacggtacggaagtaccgtaagaaccgtacgtcggtacgacgtacctagaaccgtcttacgtcgttacc

SEQ ID NO: 231656 - DNA, 803 bp, Homo sapiens
  misc_feature: GYAE6OF01BBLWJ.36.21.B10.1.454.CMB.1.raw
tcagtacgctgtctcacgaccggtgctcgatttagtgtcgtcgcaagggggaggaactgctcagttaggacccagacggaaccatggaagccccagcgcagcttctcttcctcctgctactctggctcccagatatcactggagaatagtgatgacgcagtctccagccaccctatctgtgtcctccaggagaaagacgcccacctctccgtggtacgggcctaagtcaagtagttggttagccgagtacctaacgtttagcccgtaggtaccagcaacgaaccgtggacctaacggtcccaggctacagtcatctagtgtgccatccacgacgggcctagtcggtacctcccgacgtacccttacgtttacggcggtactaacggggtttcggaccggttggggaacctacgggtacgtttaccacccgttacccgtacctaaacccttacgaccgtaacggcctaaccgggtacccttacgggacccgttacgttacccggtaaaggttaaacggtttacgttttacgggtaacttttaacgggttttaacctttaacgttacggttaaccctaacggttaacttaaccgttaaacgttccgggttaaaccgttccggtacccctttaccgttaaccgttaccggggtttacccgggaccggggtaaccgggttaaaccgaagggggttaccgtaaacggtaaacgtaacccgggtaaaacgacgggtttcgaacggggttaccctagggtaacccttaaccggttaccgttacccggtttacgttaccgttttaaacccg

SEQ ID NO: 231657 - DNA, 632 bp, Homo sapiens
  misc_feature: GYAE6OF01BE9Z3.36.21.B10.1.454.CMB.1.raw
  modified_base (198)..(198): a, c, t, g, unknown or other
  misc_feature (198)..(198): n is a, c, g, or t
tcagtacgctgtctcacgaccggtgctcgatttagtgtcgtcgcaagggggaggaactgctcagttaggacccagacggaaccatggaagccccagcgcagcttctcttcctcctgctactctggctcccagatatcactggagaaatagtgatgacgcagtctccagccaccctatctgtgtctccgaggagaaagngcccaccctctcctggtacggccagtcagagtgttagcagctaacgttagccgtggtaccagcaaggaaaccctggcctacggttccaggtctcatccatctagtggtcgctactcccgaccgacgggccctacgtcgggttactccccgagtcccttaaccgtttaggcggtacgtagggtcggggtcgtaggggtaacaggtacgttcacttcctaccaacatcgacgcacgtctgctaacggtctagtaattgttttacgacgtttagtttacttcgttagtactaactagttaacaacgtgtaccgttcggtctacccttcgttaccgtttacgggacggtaacgggaaccgtaagggtcggaaacgttacgtaacctaaggtaacgtcggtagccgtacgtacctacgtattacgttcgttccttaccg

SEQ ID NO: 231658 - DNA, 736 bp, Homo sapiens
  misc_feature: GYAE6OF01DCICL.36.21.B10.1.454.CMB.1.raw
  modified_base (196)..(196): a, c, t, g, unknown or other
  misc_feature (196)..(196): n is a, c, g, or t
  modified_base (328)..(328): a, c, t, g, unknown or other
  misc_feature (328)..(328): n is a, c, g, or t
tcagtacgctgtctcacgaccggtgctcgatttagtgtcgtcgcaagggggaggaactgctcagttaggacccagacggaaccatggaacgccccagcgcagcttctcttcctcctgctactctggcctcccagatatcactggaagaaatgtgactgacgcagtctccagcccacctatctgtgtctccgagganaaagcgcccaccctcgtcctaggtacgggccagtcagtgttagtagcagaccaacgttagcctagtaccagacaaacgaactcggaccgtacggttacccaggcctcactctaacttcgtaattcgggtacnccgtaactacccgaccggtacgggccctaacgttcgggtaacctccccgaagttcccctaacgttttaggcggtaccgtagggtcgggtacgtacgggacgtaggtaccgttaccacgttccacctaacctagtacgacgacgcgtaccgttcgaccgtagttacgtacgttaaagtttcgtttacgtaacgtttacggttttaaacttcggtaaccgttaactaaacgtaacttaactaacggttacgtaaccgttccggtaccctttcgtacgttaccgggtttacggggaccggtaacgggtaaccgtaaaggggtcgtaaacgtaacgtaaacccggtaaaggttacgtcgggttcgtacgtaccgaccgtaacgttacgtttcttaaccggttccttaacccg

SEQ ID NO: 231659 - DNA, 898 bp, Homo sapiens
  misc_feature: GYAE6OF01DMPT3.36.21.B10.1.454.CMB.1.raw
  modified_base (205)..(205): a, c, t, g, unknown or other
  misc_feature (205)..(205): n is a, c, g, or t
  modified_base (215)..(215): a, c, t, g, unknown or other
  misc_feature (215)..(215): n is a, c, g, or t
tcagtacgctgtctcacgaccggtgctcgatttagtgtcgtcgcaagagaggaggggggaggaactgctcagttaggacccagacggaaccatggaagccccagcgcagcttctcttcctcctgctactctggctcccagataccactggagaaatagtgatgacgcagtctccagccaccctgtctgtgtcctccaggggaaangcccaccctntccttcagggccagtcagagtgttaaacaataacttagcctggaaccaacagacacctggaccaggcctacccaggcctcctacactctaacgtggtagcctaattcccgaaggttacgggccctacgttcgggacctaacgtccccgaaggtaccgtaacgggtttaccagggttacgggaccttaaggggttcgggggttaccttacggggggaaacctaacgggttaaccctttaccggtaaacccgtttaccgtaacccctaaccccgtaaagtttaccccggaaacggtaacccgtaacgggttaacccggtttacgggggaaacccgttccccgtttaagggtaaaaccggttttaacggttttttacccggggtaccccgggtttaaggttttaaacccgttttaccggttacgggtttaaccctaaaaccgtttaacccgtttaacggtttaaccgggtttaacccctttcgtttaacccgtttacgggtttaaccctttaaccggtttttaccggggaacccggtaacggggggtaaacccctaaacgggtacccggttacgggaacgtaaccgttaaaccggaaaaaccggttaaccggtttacgggtaccgggtaccttaccggtaccctaaacccgttaggtttacccgttggtttaccctttaaccccgg

SEQ ID NO: 231660 - DNA, 695 bp, Homo sapiens
  misc_feature: GYAE6OF01CM21J.36.21.B10.1.454.CMB.1.raw
  modified_base (206)..(206): a, c, t, g, unknown or other
  misc_feature (206)..(206): n is a, c, g, or t
tcagtacgctgtctcacgaccggtgctcgatttagtgtcgtcgcaagagaggaggggggaggaactgctcagttaggacccagacggaaccatggaagccccagcgcagcttctcttcctcctgctactctggctcccagataccactgggagaaatagtgatgacgcagtctccagccaccctgtctgtgtctccgaaggggaancgcccaccctctcctgcgagggccagtcagagtgttaacaataactgcctaggtaccaacagacaccgtcggccacggcctccaggtcctccacattctagtggtcacacgtacccacgacgggccagtcggtactcccagtccgtaggttcgaggttcggacgtaggttcggggtacgtggggaactacggtacttccgtacgttacctccaaccttataccgacgtaccctaaccgtcggaccgacggttacgtacggtaagtttacgtttttcgaacttttaacgtttttacgtttacccgttacggttaacctaacctaagttaaaccgtaagtttcgtaacgttccggttacccttcgttaccgttacggtttccgggacgggtaccggtaacggtagggtacgtacggtaaactaccggtaaaacgtaccggttggtaccggtacgtacgcccgttaacagtttacctccggtttcttacccg

SEQ ID NO: 231661 - DNA, 724 bp, Homo sapiens
  misc_feature: GYAE6OF01DKCR0.36.21.B10.1.454.CMB.1.raw
  modified_base (386)..(386): a, c, t, g, unknown or other
  misc_feature (386)..(386): n is a, c, g, or t
tcagtacgctgtctcacgaccggtgctcgatttagtgtcgtcgcaagggggaggaactgctcagttaggacccagacggaaccatggaagccccagcgcagcttctcttcctcctgctactctggctccagatatcactggaagaaatagtgatgacgcagtctccgagcccaccctatctgtgtctaccgaggaagaaaacgcgccctaccctccttccgtagggtacgggccctaggttaccaaggtaggttgttaagcaagtacctaaacgttacggccgttacgggtaaccagaccgaaacgaaaccgtcggacccgtacggttcccaggtctacactctatctacgtggtcactacgtccacggacggcctagtcgtaccnccacgtcctacgttagcgtagtagggtcggtcgtagggactaaggtactcctacgtctaccaacgtataccgagcgtaacgtcccgtacgactacgttacgtaaggtaacgttttagtttcgaaccgttttaagttttaaccgtttacgaccgttaactaaacgtaagttaacacgttacggtaccgtaccgttaccttacgttccgttaaacgggttccgggacgggaacgggtaacgtagggttacgaaagtaacccgtaaaacgggaaaccggttcggttcggtcgggtaaccttcggaaacccttagtagtttacccgttcgtttaacctaccg

SEQ ID NO: 231662 - DNA, 872 bp, Homo sapiens
  misc_feature: GYAE6OF01DF5AT.36.21.B10.1.454.CMB.1.raw
  modified_base (200)..(200): a, c, t, g, unknown or other
  misc_feature (200)..(200): n is a, c, g, or t
  modified_base (816)..(816): a, c, t, g, unknown or other
  misc_feature (816)..(816): n is a, c, g, or t
tcagtacgctgtctcacgaccggtgctcgatttagtgtcgtcgcaagagaggaggggggggagaggacgcccagcactagaagtcggcggttgtttccagttcggtgatcagcactagaacacagacggactcaccagtggtaggtttgggctgagtcgtttcgggtttttccctcggttgtcttttacgttttaaaggnggttcgtaccgtagtgtacgaggtcgacgtaacggtgggtaggacggttcgggtagggggggacgtcggtacgtacctacccgacgggtcccggtagggggtaccgttaccccgtaggaacgtcccgttccgttccgtcggtacgtccgacggtcccttacgtacggtaaccttacccttaaccttactaaagttacgtacttacggtcggactaggttacggaccgtaccgggttccggggacccgtaccggacggtaccgtaccggaagggaccggtaacggggtcgttacggggacgggttcgggtaccgaaaccctaaacgtagtaaccgcggggtaccggtaaggtaagggtaacggttaaacgaaacggaaccgttagttgggtaaggtacgggtacggttcggtaaggggttaaccgggaacggtccccgtttaatcccggtaaacctacttcccgggtaaaccgaaggtaacccgaaacccgaacgtaaaccaacggtttaactccgttacgttttacgtcaagtaccgtaactccgaccgtacgtaccgaggtaccggaccggttcggtaaccgtcgttccgtaccttcgtttaagtcttacgggtnacccgggaagcgggttaacgtcgggtttaactttacgggtttaggtcctttccggg

SEQ ID NO: 231663 - DNA, 716 bp, Homo sapiens
  misc_feature: GYAE6OF01B84YJ.36.21.B10.1.454.CMB.1.raw
  modified_base (304)..(304): a, c, t, g, unknown or other
  misc_feature (304)..(304): n is a, c, g, or t
tcagtacgctgtctcacgaccggtgctcgatttagtgtcgtcgcaaggggggaggaactgctcagttaggacccagacggaaccatggaagccccagcgcagcttctcttcctcctgctactctggctcccagatatcactggagaaatagtgatgacgcagtctccagcccaccctatctgtcgtctccaagggacaaaagacgcccaccctctccctggtaacgggccagtcagagtgttagctagcaacttagcctggtaccagcagaactggcacggtccaggctcatcatctatggtcncactccacgacgggccaacgtcggtaactccccacggtaccctacttttacgggcggaccgtagggttcggggtccgttaggggactaagggtacgtttacgaaacctttccgtacccaaccgtactaccgaacggacaccggtaccctggacctacgggttaccttagggtaaacttagtttttacggacctttaaggttttacttaacgtacgtactaaaaccgtaggttaaacctaagttcgaacgttcggtaccctttaccgtccgttaaccggttttaccggggacgggtaaacggggtacccggtaaagggttcggggtaaacgtaagtaaccgtaaaacggtaacgttgggttaaccggtcgttacgaccctaacgtaaccgttacgttggttccctttaacccg

SEQ ID NO: 231664 - DNA, 803 bp, Homo sapiens
  misc_feature: GYAE6OF01CE7NP.36.21.B10.1.454.CMB.1.raw
  modified_base (791)..(791): a, c, t, g, unknown or other
  misc_feature (791)..(791): n is a, c, g, or t
tcagtacgctgtctcacgaccggtgctcgatttagtgtcgtcgcaagggggaggaactgctcgagttaggacccagacggaaccatggaagccccagcgcagcttcgtcttcctctgctactctggcctcccagatatcgactggacgtaaatgtgaatgacgcagtctccagcccacctagtcctggtcgtctccgaaggtacgaaaagcgccctacctcgtcctggtacggcctaggtcaggtagttacgtacgcgaacgtcgtaaacgttcggcctaggttaacccaagggccctaaacggtaaaacccgttcgggtaccgtaaccggtttccccgaacgggttccttacccggtaacgttaccgtaacgtttacccgtaggttcgggttacgacctaaacgttccccgaaccggtacgggtacccttacgggtaccgggttactaccccggtaggtaccccttaccggtttacgggtacgtacggttacggttaacggggtccgtacgggggtaacctacggtaacgttttccccgggaaccttttacccgttaccgaacccttaacggtttaccgaaccggtaccgtaacggtcgttaccggtaccgtacggtacgtacgtaagttacgtttacgtacgttagtttacgtaacgtcgtaacgtacgtacgtaccgtaagtcgtacttaccgtacgttacgtcgttaaccggtttcggaccggtacggtacgtaggtaccgagtacgtaccgaagttacgcggtactacgtcgacctacgtaccgtntcgtcgttaccg

SEQ ID NO: 231665 - DNA, 763 bp, Homo sapiens
  misc_feature: GYAE6OF01DTJE4.36.21.B10.1.454.CMB.1.raw
tcagtacgctgtctcacgaccggtgctcgatttagtgtcgtcgcaaggggggaggaactgctcagttaggacccagacggaaccatggaagcccagcgcagcttctcttcctcctgctactctggctcccagatatcactggagaaatagtgatgacgcagtctaccagcccacctatctgtgtctccaggagaaaacggacgcccaacccccttccgtacgtacggaccgacgtagtacgaggtagttaggtacgacgaacaaccgttaacgtccgtacggtacgtaaccgacgaacgtaaaccgtaacggtaccgaccggttacccggtacgacgtccactactactataccgtaggtcggtacacgtaccgtacccgaacgggacctaccgtacgttacgtaccgacccgaccgttaacccgttagttacgggtcggtaggtcggggttacgggtacggtacgggaacggtaacggttaccgtacctaccttacccgaaccctaaccgtacgtaaccggtacaccgtaccggtacgcgtacggtacttaggtaacgttaagtttagtacgttagtttaacgtttaacgtacgttaacgtaacgtaactaacgtaacgtacggtcggtaactccgttccgtacgttacgggttccgggttaacggggacgggaaaccggtaacggtagggataaacggaacgtaaacgaacgtcggtcggtaagtccacgtacctaagttaccgttacgtcgttactaccg

SEQ ID NO: 231666 - DNA, 756 bp, Homo sapiens
  misc_feature: GYAE6OF01CFR3R.36.21.B10.1.454.CMB.1.raw
  modified_base (148)..(148): a, c, t, g, unknown or other
  misc_feature (148)..(148): n is a, c, g, or t
  modified_base (183)..(183): a, c, t, g, unknown or other
  misc_feature (183)..(183): n is a, c, g, or t
tcagtacgctgtctcacgaccggtgctcgatttagtgtcgtcgcaagggggaggaactgctcagttaggacccagacggaaccatggaagccccagcgcagcttctcttcctcctgctactcgtggcctccagatactcacgtggaanaaatagtgatgacgctagtcctccacgcccacctntctgtcgtctcgaaggaagaacgcgaccctacctctcctggtacggcagtcgagtacgtgtacgacagtcctaaacgttcgccgttacgggtaaccacgacgaaacggtaaaccctcgggcccttaacgggttacccaggtcctactacttaccgtagttaccgttaaggtcgggtcaaccttacccggtaccccggaaccggaccggggtcctaacgggttcggttaaacccctccccggaaacggttccccgtttaacgtttagggacgggtcgtaagggtttcggggtccggtagggactacgggtactttccgacctccgttaacacctaggtactaccgacgtacgtcccgtacgtaccgtaacggttacgtacgtaaacgttttgtttaaccggtacgtttacgttttataccgttacgtacctaacgtaacgtactagtcgtaccgtcgtacctcgttacgttaccgtcgggacgtaaccgggtacgtagggtacgtaaagtacgaaacgtaacggtacgtaggttaccgacgtcgtaaccgtactacttccgtagttcctacccg

SEQ ID NO: 231667 - DNA, 782 bp, Homo sapiens
  misc_feature: GYAE6OF01EBDTT.36.21.B10.1.454.CMB.1.raw
  modified_base (408)..(408): a, c, t, g, unknown or other
  misc_feature (408)..(408): n is a, c, g, or t
tcagtacgctgtctcacgaccggtgctcgatttagtgtcgtcgcaaggggggaggaactgctcagttaggacccagacggaaccatggaacgccccagcgcagcttctcttcctctgctactctggcctccagtatatccacgtggaagaaatagtgatgactcacgtcctccacgccacccttattctggtcgtcctaccgaaggaaggaaacgaccgccctaccctctccgtaggtacgggccaaggtcagtagttgttacgctacgactaacttacgtccgtcgaacacggacaaacgtaaccgtcgaccggtacggttaccgcgtactacgatcctagtctaggttcggtacgactctacccacgggacggccacgtacggtacacccgtacgcctacgttagnggtctagggtcggtcgtaggacgtagtaccgtctccgttacaccgtaactacgcgtacgacgtccgacgtcgtacgacgttacgtaacggtacttaacgtttacggtaacgtttaacgtttaacttaccggttaacgtaacctaacggttaacggttaacctaacggttaccgttaccgggttcccgttacccgttaccgtttacccgtttaccggggttaacccggggaacggggttaaccggggaaaccgtaaacgggggttacgtaaacggttaacccggtaaacgtaaaaccggttaggttccgggttaaccgacgttaccggtcctttaaaccggttaccgtaccttttccgggttaccttaccccggg

SEQ ID NO: 231668 - DNA, 827 bp, Homo sapiens
  misc_feature: GYAE6OF01A4VN6.36.21.B10.1.454.CMB.1.raw
  modified_base (153)..(153): a, c, t, g, unknown or other
  misc_feature (153)..(153): n is a, c, g, or t
  modified_base (207)..(207): a, c, t, g, unknown or other
  misc_feature (207)..(207): n is a, c, g, or t
tcagtacgctgtctcacgaccggtgctcgatttagtgtcgtcgcaagagaggaggggggaggaactgctcagttaggacccagacggaaccatggaagccccagcgcagcttctcttcctcctgctactctggctcccagactaccactgganaaatgtgatgacgcagtctccagcccaccctgtctgtgtctccgaaggggaaancgcctaccctctcctggcagggccagtcagtagttacgttaaacaattaaccgttagccgttaggtaacccaacgacgaccaccgtgggacccaacggcctcccgaggtccctcctcattctagtggtcgacctacgtacccgacgtacgggccctacgttcggtaacctcccgagtccgtaggttcacggtcggcgtaggtcgggtacgtacgggactaggtaactttcaccgtttcaccgaacctagtccgacggtaccgacgtccgttagaccgtaaggtaacggtacggtaaagttcggtttacccgaggttttaacgttttaacgtttacggtttacggttaaccgtaagggtaaccgtttaaagttaaactttaaaacccgggtttacccggttaccgggtttaaccccgggtttacccggtttaacccggtttaacccggggtttccggggtaaaccgggggtaaccggggttaaacccggtaaggggttaacccggggtaaacgttaaaccggtaaaacccgggtaaacccggttaaacggtttaccggggtacggtaccccgtacgggtaacccctaaaccgtttcggttacccgttttacggttaccccg

SEQ ID NO: 231669 - DNA, 991 bp, Homo sapiens
  misc_feature: GYAE6OF01CRAAE.36.21.B10.1.454.CMB.1.raw
tcagtacgctgtctcacgaccggtgctcgatttagtgtcgtcgcaagagaggaggggggggagaggagcccagcactagaagtcggcggtgtttccagttcggtgatcagcactgaacacaggaggactcacagtgggagtttgggctgacgtcgtttcgggtttttccctcgtttgtactttacgtttttaaaggaggttcgtacccgtagttcgtacgtaggggtcacgtaacggttgggtggtacggtcgggtaggggggacggccggttagtacctacccgacggcccggttgggggaaccgttcccctagggaaccttccgttccctccggtggtacgcctacgtcccgttacggtaggtaaaccttccctaaccccgttaacgtaaataccgggtcttaacgggtcggtacccgtaagttccgggccccggtaaccgggtttcccggggcccgaccccggtagggtacccccgtaccgggacgggtaccggggtaaaggggttcccggtagggggttggggtttacggggttcgtttttaaccggttttaacttttacggaacgtttaagggttacgaacgggtttaggaaacgggtttaattaaggttaacgggtaaccttaaacggtgtaccgtacggtaccggtttaccggaccggttaagggaccggtacccgtttaacaccccgtaactaccgttaacccgaaccgtaacgaaccggttaaaccctaaaccggtaacctaaaccggtaacccgtacggttacccttaagggtaccccgttacgtaaggaaaccgttaagggtaaccggtaaccgtaacctaaacgggtggtaaaccggttaaccgggtaacgaaccggtttaacgtccgggttaacgtttaggttaacggtttaccgttacggggtttcccggaccccgggttacccccggggttacccgggttaggggtaacccgtttacgggtacggggttttccggg

SEQ ID NO: 231670 - DNA, 745 bp, Homo sapiens
  misc_feature: GYAE6OF01EYJNA.36.21.B10.1.454.CMB.1.raw
tcagtacgctgtctcacgaccggtgctcgatttagtgtcgtcgcaagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagcgcccacctctccgtggtacggccagtcagtagttgttagcagactaacgttacgccgtacggtaccagacgaacgaaccgtcggaccgtacgggttcccaggtcctacgactacatctagtggtcgcactccgaccggacggacctaggtcgtaccacccgtacgtacccttacgttaggcgacggtagggttcgggtaccggtagggactaggtacgtacctacgtcctaaccactacgtacgacgtcgaccgtccgtcgacgttacgttacgtaagtaacgttttagttttacgacgttttaacgttttaacgtttacgttaacgtaacctaaacgttaacgttaaacgttaacgttacggttaccggtacccgttacccttaccgttaccggtttaccgggttaccggggaacgggtaaccgggtaacggtaacggggttacggaacgttaaacgtaaacccggtaaaaggttacggttacggggtaccggtacgtaccgtaaccgttaaccgtagttttacccgttgtttacccgtttaacccg

SEQ ID NO: 231671 - DNA, 783 bp, Homo sapiens
  misc_feature: GYAE6OF01A1S61.36.21.B10.1.454.CMB.1.raw
  modified_base (210)..(210): a, c, t, g, unknown or other
  misc_feature (210)..(210): n is a, c, g, or t
  modified_base (347)..(347): a, c, t, g, unknown or other
  misc_feature (347)..(347): n is a, c, g, or t
tcagtacgctgtctcacgaccggtgctcgatttagtgtcgtcgcaaagagaggaggggggaggaactgctcagttaggacccagacgaaccatggaagccccagcgcagcttctcttcctcctgctactctggctcccagactaccactggataaatgtgatgacgcagtctccagccctacctgtctgtcgtcgtaccgaaggggaacncgcccacctctccgtgccgagggccagtcgagtagtaacgttaaacaattaaccgttacgaccgttacgggtaacccaaacgacgacctaccgtcggaccgtaggccctaccgaggtccctctacatactagtgganccaaccttcccgaccgacggtacctacgtggtacctacccgagtaccgagtacgaggtggacgtagggttcggtcgtacggtaacagttacgttaccctactcccgtaaccacccggtataccgaacgtacccgtaccgtccgtacgtacggttacgtaacggtaatttacggttttacgaccgttttaaacgttttaacgttaccgttacggtacgtaacgttaacgtaagttaacgttaaccggtaacgtacccggttaccggaacccgggtttaccgggtttaacggttaaccggggaccgggtaaacggggtacccgtaacgggttaccggtaacgggtaacgtaaccggttaaacggaaacggttaaccggtacgggttaacgtccgtaacgtaccctaacccgtttacgttaacggtttccttaacccgg

SEQ ID NO: 231672 - DNA, 518 bp, Homo sapiens
  misc_feature: GYAE6OF02H0FI0.36.21.B10.1.454.CMB.1.raw
  modified_base (333)..(333): a, c, t, g, unknown or other
  misc_feature (333)..(333): n is a, c, g, or t
  modified_base (393)..(393): a, c, t, g, unknown or other
  misc_feature (393)..(393): n is a, c, g, or t
tcagtacgctgtctcacgaccggtgctcgatttagtgtcgtcgcaagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggttcccaggctcatcatctatggtgcatccaccagggccactggtactcccagcctactttagnggctaggtgggtctgggacagagttcactctcaccatcagcagcctgcagtctagaagtntttgactagtttatactgtacaatagtactatcgactcggccttctctacgttcgggacggacggtaccgaggtgagtacgtaacgaacgtagtgtcgctagccacctattcgtcgttacctacg

SEQ ID NO: 231673 - DNA, 493 bp, Homo sapiens
  misc_feature: GYAE6OF02IA85T.36.21.B10.1.454.CMB.1.raw
tcagtacgctgtctcacgaccggtgctcgatttagtgtcgtcgcaagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggttcccaggctcatcatctatggtgcatccaccagggccactggtactcccagccacctttagtggcagtgggctgggacagagttcactctcaccatcagcagcctgcagtctgaagattttgctagtttattactgtcaacagtacaatgacttgcctctctacgtttcggcggagggacaagggtggagatcaaacgactgtgcgtgcaccatctgtcttc

SEQ ID NO: 231674 - DNA, 496 bp, Homo sapiens
  misc_feature: GYAE6OF02GN95Z.36.21.B10.1.454.CMB.1.raw
tcagtacgctgtctcacgaccggtgctcgatttagtgtcgtcgcaagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggttcccaggctcatcatctatggtgcatccaccagggccactggtatcccagccacctttagtggcagtgggtctggggacagagttcactctcaccatcagcagcctgcagtctgaagattttgctagtttattactgttcaacagtacaatgactggcctctctacgtttcggcggagggaccaggtggagagtcgaacgacgtgtgctgcaccatctgtctacg

SEQ ID NO: 231675 - DNA, 500 bp, Homo sapiens
  misc_feature: GYAE6OF02GQC2C.36.21.B10.1.454.CMB.1.raw
  modified_base (356)..(356): a, c, t, g, unknown or other
  misc_feature (356)..(356): n is a, c, g, or t
  modified_base (480)..(480): a, c, t, g, unknown or other
  misc_feature (480)..(480): n is a, c, g, or t
tcagtacgctgtctcacgaccggtgctcgatttagtgtcgtcgcaagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggttcccaggctcatcatctatggtgcatccaccagggccactggtatcccagccacctttagtggcagtgggtctgggacagagttnactctcaccatcagcagcctgcagtctgaagtatttgctagtttattactgtcaactagtacaatgactggcctctctactttcggcggtagggaccaaggtggagtatacaaacgacgtgtgntcgcaccatcgtagtcttac

SEQ ID NO: 231676 - DNA, 500 bp, Homo sapiens
  misc_feature: GYAE6OF02GJEIB.36.21.B10.1.454.CMB.1.raw
tcagtacgctgtctcacgaccggtgctcgatttagtgtcgtcgcaagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggttcccaggctcatcatctatggtgcatccaccagggccactggtatcccagcccacctttagtcggcaggtgggtctgggacaggagttcactctcaccatcagcacgcctgcagtctgaagtatttgctagtttattactgtacaactagtacaatgactcggcctctctacgttcggcggacgggacaagggtgagagtacgaaacgactgtgctgcacatctgtctc

SEQ ID NO: 231677 - DNA, 508 bp, Homo sapiens
  misc_feature: GYAE6OF02G2TOR.36.21.B10.1.454.CMB.1.raw
  modified_base (332)..(332): a, c, t, g, unknown or other
  misc_feature (332)..(332): n is a, c, g, or t
  modified_base (493)..(493): a, c, t, g, unknown or other
  misc_feature (493)..(493): n is a, c, g, or t
tcagtacgctgtctcacgaccggtgctcgatttagtgtcgtcgcaagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggttcccaggctcatcatctatggtgcatccaccagggccactggtactcccagccactttagnggcagtgggtctgggacagacgttcactctcaccatcagcacgcctgcagtctagaagtatttgactagtttattacttgtacaactagtacaatgactgcctctctacgtttcggacggtacgggaccgaagggtggagagtacgaaacgacgtgtcggntcgcacatctgtctc

SEQ ID NO: 231678 - DNA, 506 bp, Homo sapiens
  misc_feature: GYAE6OF02HHRU2.36.21.B10.1.454.CMB.1.raw
  modified_base (333)..(333): a, c, t, g, unknown or other
  misc_feature (333)..(333): n is a, c, g, or t
tcagtacgctgtctcacgaccggtgctcgatttagtgtcgtcgcaagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggttcccaggctcatcatctatggtgcatccaccagggccactggtactcccagccacctttagnggcaggtgggtctgggacagagttcactctcaccatcagcagcctgcagtctgaagtatttgctagtttattactgtacaactagtacaatgactggcctctctacgtttcggcggaggaccgaaggtggagtacgtacgaaacgtactggtgcgtcgcaccatctgtcttac

SEQ ID NO: 231679 - DNA, 588 bp, Homo sapiens
  misc_feature: GYAE6OF02IXY9P.36.21.B10.1.454.CMB.1.raw
  modified_base (205)..(205): a, c, t, g, unknown or other
  misc_feature (205)..(205): n is a, c, g, or t
  modified_base (214)..(214): a, c, t, g, unknown or other
  misc_feature (214)..(214): n is a, c, g, or t
  modified_base (293)..(293): a, c, t, g, unknown or other
  misc_feature (293)..(293): n is a, c, g, or t
  modified_base (305)..(305): a, c, t, g, unknown or other
  misc_feature (305)..(305): n is a, c, g, or t
  modified_base (315)..(315): a, c, t, g, unknown or other
  misc_feature (315)..(315): n is a, c, g, or t
tcagtacgctgtctcacgaccggtgctcgatttagtgtcgtcgcaaggagagaggggggaggaactgctcaggttaggacccagacggaaccatggaagccccagcgcagccttctcttcctcctgctactctggctcccagataccactggagaaatagtgatgacgcagtctccagccacctgtctgtgtctccaggggaaangccaccctntcctgcagggccagtcagagtgttaacaatacttagcctaggtaccaacagacacctggccaggcctcccaggctcctnattctatggtancatcccaacngggccactggtactcccagtccaggttcagtgacaggtggtctgggaacaggtagttcaactcgtacaccgtatcgacgcaacgtgacagttctagaagttattttcgacgttaagtttactttacgtgtacacgtactaagttataagtgaacgtacgggtccgtaccgggtaacgtttccgggacggtacgggttaccgaaggtcggaagtacgtaacgaaacgacgttggtacggtactcggacctaccgtatacgttcgtaccttaccg

SEQ ID NO: 231680 - DNA, 543 bp, Homo sapiens
  misc_feature: GYAE6OF02GMZU8.36.21.B10.1.454.CMB.1.raw
tcagtacgctgtctcacgaccggtgctcgatttagtgtcgtcgcaagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggttcccaggctcatcatctatggtgcatccaccagggcccatggtactcccagccactttgcgcagtgggtctggggacaggacgttcactctacaccatcgagcacgtcctgcagtctgaagtatttcgcttagtttactacttgtacaactagtactaatgacgtggccttctctacgtttcggcggtaacgggaccgtaagggtcggaagtacgtaacgaaacgtaccgtaggtacggtcgtacgctaacctacgtcgttcgttcttaccg

SEQ ID NO: 231681 - DNA, 591 bp, Homo sapiens
  misc_feature: GYAE6OF02IRLJE.36.21.B10.1.454.CMB.1.raw
  modified_base (403)..(403): a, c, t, g, unknown or other
  misc_feature (403)..(403): n is a, c, g, or t
tcagtacgctgtctcacgaccggtgctcgatttagtgtcgtcgcaagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggttcccaggctcatcatctatggtgcatccaccgagggccacgtcggtatccccgagcctacctttaggtcggcaggtgggtctgggacagtagttcacgtctcaccatcgagcacgcctgctagtctgaagtntttgcttagtttattacttgtacaactagtacaagtgacgtcggtcccttctaccgtaccgttttacgggaccgggtaacggggacccgtaagggttcgggaacggtaagtaaccgaaaaccggtaacgttggtacgggtaccgttaggtacccgtaaccgtacgttaccgttcggttacctttaccg

SEQ ID NO: 231682 - DNA, 686 bp, Homo sapiens
  misc_feature: GYAE6OF02JKDI5.36.21.B10.1.454.CMB.1.raw
tcagtacgctgtctcacgaccggtgctcgatttagtgtcgtcgcaagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggttccccaggctcatcatctatggtgcactccaccgagggccctaacgttggtactaccccgagccctaaccgtttaggtcggtactaggttgggtccgtacggggactaacggtacgttcaacctccgtaccaaccatccgacgtaccacgtaccccgttgacccgtaacggtcctaggtaaacgttagtttttcggaccgttaaggtttttaacttacgtttacgtacctaaaccgtagtaacctaatacggtacctaggtcccttcgttaccgttaaccgttttccgggaccggggaacggtaacccggtaagggttcgggtaacggtaacgttaacccggaaaaccggtaaccgttaggtacgggttaccgtacggtaccaaccccgtatttaccgtcgtttaccgttacccg

SEQ ID NO: 231683 - DNA, 750 bp, Homo sapiens
  misc_feature: GYAE6OF02I5BWA.36.21.B10.1.454.CMB.1.raw
  modified_base (194)..(194): a, c, t, g, unknown or other
  misc_feature (194)..(194): n is a, c, g, or t
  modified_base (302)..(302): a, c, t, g, unknown or other
  misc_feature (302)..(302): n is a, c, g, or t
tcagtacgctgtctcacgaccggtgctcgatttagtgtcgtcgcaagggggaggaactgctcagttaggacccagacggaaccatggaagccccagcgcagcttctcttcctcctgctactctggcctcccagatatcactggagaaatagtgatgacgcagtctccagcccaccctatctgtgtctccagganaaagcgcccaccctctcctggtacggccagtcagagtgtagcagcaacttagcctggtaccagcaagaacctggcctacggttcccaggctcatcatctagtcggtcnctactcccaaccgagggtccctaacgtcggtacctccccgtaagtccctaaccgttttaggcggccgtaagggttcgggtaccgtacggggaaccaggttacgtttccaccgtttccaccgaaccctagtaccaacgccgtaacggtcccttcgggacctacggttaccgtaaggtaaacgttagttttcggacctttaaaggtttttaactttacgtacggttaacctaaaccgtagtttaaaccgtaaacgttcggtaaccgttccgggtacccctttaccgttacccgttaaccgggtttcccggggaacggggttaaacgggtaacccgtaaggggtttacgggaaacgttaaccgttaaaccggaaaaccggttacggttacgggtacggtcgttaaccgacccgttaaccgtaacgtttccgttaccggtttcccttaaccg

SEQ ID NO: 231684 - DNA, 497 bp, Homo sapiens
  misc_feature: GYAE6OF02IY7DY.36.21.B10.1.454.CMB.1.raw
  modified_base (192)..(192): a, c, t, g, unknown or other
  misc_feature (192)..(192): n is a, c, g, or t
  modified_base (296)..(296): a, c, t, g, unknown or other
  misc_feature (296)..(296): n is a, c, g, or t
  modified_base (333)..(333): a, c, t, g, unknown or other
  misc_feature (333)..(333): n is a, c, g, or t
  modified_base (459)..(459): a, c, t, g, unknown or other
  misc_feature (459)..(459): n is a, c, g, or t
tcagtacgctgtctcacgaccggtgctcgatttagtgtcgtcgcaagggggaggaactgctcagttaggacccagacggaaccatggaagccccagcgcagcttctcttcctcctgctactctggctcccagatatcactggagaaatagtgatgacgcagtctccagccaccctatctgtgtctccagganaaaagagccaccctctcctgtagggccagtcagagtgttagcagcaaacttagcctggtaccagcagaaacctggccaggttcccaggctcatcatctatggtncatccaccagggccactggtatcccagccactttagngcagtgggtctgggacagagttcactctcacatcagcagcctgcagtctagaagtattttgctagtttattactgtcaacagtacaatgactggacctctcacgttttcggcggagggaccaaggngagagtacaaacgaactgtagctgcaccatctgtctac

SEQ ID NO: 231685 - DNA, 605 bp, Homo sapiens
  misc_feature: GYAE6OF02GAPSN.36.21.B10.1.454.CMB.1.raw
  modified_base (197)..(197): a, c, t, g, unknown or other
  misc_feature (197)..(197): n is a, c, g, or t
  modified_base (292)..(292): a, c, t, g, unknown or other
  misc_feature (292)..(292): n is a, c, g, or t
tcagtacgctgtctcacgaccggtgctcgatttagtgtcgtcgcaagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagngccaccctctcctgtagggccagtcagagtgtagcagcaacttgcctggtaccagcagaacctggccaggttcccaggctcatcatctagtggtncactccaccgacgggccacgtggtactcccgagtccctaccgtttagcggctaggtcgggtcgtagggactaggtacgttcacgttcctaccacctatcgacgctacgccgtggctaggtctaggtaagttgttttcgacttaagttttaactcgtttacgtactaaacgtacgtaactaagttcgacgttcggtccttccttaccgttaccgtttaccgggacgggtaacggtaaccgtaagggttacggagtaacgtaaccgaaacggtacgtggtacggctacggacctaccgcttcgtacgttcttacc

SEQ ID NO: 231686 - DNA, 702 bp, Homo sapiens
  misc_feature: GYAE6OF02HGYMO.36.21.B10.1.454.CMB.1.raw
  modified_base (208)..(208): a, c, t, g, unknown or other
  misc_feature (208)..(208): n is a, c, g, or t
tcagtacgctgtctcacgaccggtgctcgatttagtgtcgtcgcaagagaggaggggggaggaactgctcagttaggacccagacggaaccatggaagccccagcgcagcttctcttcctcctgctactctggctcccagataccactggagaaatagtgatgacgcagtctccagcccaccctgtctgtgtcctccgaaggggaaancgcccaccctctcctgcgagggccagtcagagtagttaaacataactgcctaggtaccaacagaccacctggccaggcctcccgaggcctcctcatctagtggtcacactccaccgacgggcccacgtggtaacctcccgacggtcccgtaggttcaaggttcgggaccgtagggtcgggtcgtagggactaggtacgttccacgttcctaccgacctagtaccgacgaccgtaaccctcgtaccgtacgtacgttaagtaaacggttattttacgtacgtttaacgttttaactttacgttcggttaccgacggtacctaaaggttaaacgttaagttacggaacgtaccgggttacccggttaccgggtttaccggtttaccgggtacccggtacgggggtaccacgggtacgtagggtaacggtaacgtaaccgaaacggtaacgtcggtacggtcgtaccggacctacccgtagttaccgtcgttacccg

SEQ ID NO: 231687 - DNA, 519 bp, Homo sapiens
  misc_feature: GYAE6OF02F6VHU.36.21.B10.1.454.CMB.1.raw
  modified_base (378)..(378): a, c, t, g, unknown or other
  misc_feature (378)..(378): n is a, c, g, or t
  modified_base (398)..(398): a, c, t, g, unknown or other
  misc_feature (398)..(398): n is a, c, g, or t
tcagtacgctgtctcacgaccggtgctcgatttagtgtcgtcgcaagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggttcccaggctcatcatctatggtgcatccaccagggccactggtactcccgagcccacctttaggtcggcaggtgggtctggggacaggagttcactctcaccatcancagcctgcagtctagaagtnttttgctagtttattacttgtacaactagtacaatgactggcctctctacgttcggcggaggaccgtaggtggagagtacgaaacgtaacgtcgtggacgtgccaccgtatctcgtcttac

SEQ ID NO: 231688 - DNA, 586 bp, Homo sapiens
  misc_feature: GYAE6OF02H5A1J.36.21.B10.1.454.CMB.1.raw
  modified_base (335)..(335): a, c, t, g, unknown or other
  misc_feature (335)..(335): n is a, c, g, or t
tcagtacgctgtctcacgaccggtgctcgatttagtgtcgtcgcaaggggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggttcccaggctcatcatctatggtgcactccaccagggccactggtactcccagcctactttagnggcagtgggtctgggacaggagttcactctcaccatcagcagcctgctagtctagaagtattttgacttagtttatttactgtactaactagtaactaagtcgactcggtcccttctcctacgtttccgggacgggtaacgggaccgtaagggtcggacggtaacgtaacgtaaaaccggtacgttacgggttacggtccgttacggtacccgtaaccgtaccgtttccgttaccggtttactttaccccg

SEQ ID NO: 231689 - DNA, 522 bp, Homo sapiens
  misc_feature: GYAE6OF02GRLB2.36.21.B10.1.454.CMB.1.raw
  modified_base (333)..(333): a, c, t, g, unknown or other
  misc_feature (333)..(333): n is a, c, g, or t
tcagtacgctgtctcacgaccggtgctcgatttagtgtcgtcgcaagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggttcccaggctcatcatctatggtgcatccaccagggccactggtactcccagcctactttagnggcaggtgggtctgggacagtagttcactctcaccatcagcacgcctgcagtctgaagtatttgactagtttatactgtcaacagtacaatgactggcctctactacgtttcggcggtagggacctaagggtggagtacgtacgaaacgtacgtaggtcgtcgtcggacacctatcgttagtcttaccg

SEQ ID NO: 231690 - DNA, 627 bp, Homo sapiens
  misc_feature: GYAE6OF02IXEFV.36.21.B10.1.454.CMB.1.raw
  modified_base (196)..(196): a, c, t, g, unknown or other
  misc_feature (196)..(196): n is a, c, g, or t
tcagtacgctgtctcacgaccggtgctcgatttagtgtcgtcgcaagggggaggaactgctcagttaggacccagacggaaccatggaagccccagcgcagcttctcttcctcctgctactctggctcccagatatcactggagaaatagtgatgacgcagtctccagtcacctatctgtgtctccaggagaaagngcccacctctcctgtaggccagtcagagtgtagcagcaattagcctggtaccagcacgaactcgccgaggttcccacggctacatacgactactagtggtgcactccgacacgggccacgtcggtactcccacgtaccctaccgtttaggtcggtcacgggttcgggtacgttagggacaaggtcgttacactcttaccgacctactacgacgcacgtacctcgcgtacgtacttagtaagtacgttttacgtacttagttttattacgttcgtacaactaagtaacctaagttacgtacgtacggtaccctacgttaccgtaccgttttccggggacggtaacgggtaaccgtaaggggttacggagttaacgtaacgtaaaacgtaacgtgtacggcttacgacctacgacgttcgtacgttcgttacc

SEQ ID NO: 231691 - DNA, 803 bp, Homo sapiens
  misc_feature: GYAE6OF02IGRQ4.36.21.B10.1.454.CMB.1.raw
  modified_base (222)..(222): a, c, t, g, unknown or other
  misc_feature (222)..(222): n is a, c, g, or t
  modified_base (236)..(236): a, c, t, g, unknown or other
  misc_feature (236)..(236): n is a, c, g, or t
tcagtacgctgtctcacgaccggtgctcgatttagtgtcgtcgcaagaggaggaggggggaggaactgctcagttaggacccagacggaaccatggaacgccccagcgcagctttctcttcctcctcgctactctggcctcccagactaccactgggaagaaaacttagtgatggacgcagtcctccaggccacccgttgtctgtcgtctccgaaggggaancgccaccctctccngcgacgggccagtcaaggtacgttagttaacgtaaccgtagtttcgggccttaggtaccaggacaaacgtaaaccgtggaccgacggcccgtacccgacggtcccttacctaccgtaactccgttagtcggtacgacctaaccgtcccgaaccgtacgggccctaacggttaccggtaccttaccccggtacgggttcccggttagtaacggttcggaacgttcgggtcgggtacgtacgggtacgtacggtacggttaccaaccgtcctaaccgaacctacgtaccgaacggaccgtaccggtcgtcgaacgggtacgtaaggttacggaaagttacgttttcggtaagttttaacggtttttaatttacggttacgttacccggtaagtactaaagtttaaactaaacggttaacggtccgtaccgttccggttaacgtttaccgggtttacggggaaacggacgggttaaacccgggtagggtacgtacgtaacgtaaccggaaagttcggttacggtagaccgtacgacccgttacgttaccgttacgtccgttcttaacccg

SEQ ID NO: 231692 - DNA, 659 bp, Homo sapiens
  misc_feature: GYAE6OF02ISYAB.36.21.B10.1.454.CMB.1.raw
  modified_base (300)..(300): a, c, t, g, unknown or other
  misc_feature (300)..(300): n is a, c, g, or t
tcagtacgctgtctcacgaccggtgctcgatttagtgtcgtcgcaagggggaggaactgctcagttaggacccagacggaaccatggaagccccagcgcagcttctcttcctcctgctactctggctcccagatatcactggagaaatagtgatgacgcagtctccagccacctatctgtgtctcaggagaaagcgcccaccctctcctggtacggccagtcagtagtgtacgcagctaacgttgcctggtaccagcaacgaacctggcctaggttcccaggctcgatcatctatggtcncactccgacgcggacctacgtaggtacctacccgacgtaccctaccgttttaggcggtacctagggttcgggtacgtacggggaacctaggtaccgttaccgaccttaccgtacgaccctagtaccgacgtccgtaacgtccgtacgccgtaacggtccgtaacgggtaaacgtttacgttttacgaccgtttaaggttttaactttacgtacgtacctaaacgtagtaactaagttacgcgttacgtcccttcgtacgttacgttccgggacggtacgggaccgtaaggtgaacgtaacgaaccggtaacgtcggtcggcggtactagaccgtactacgtccgttacggtcttaaccg

SEQ ID NO: 231693 - DNA, 594 bp, Homo sapiens
  misc_feature: GYAE6OF02IQ2A1.36.21.B10.1.454.CMB.1.raw
  modified_base (200)..(200): a, c, t, g, unknown or other
  misc_feature (200)..(200): n is a, c, g, or t
  modified_base (345)..(345): a, c, t, g, unknown or other
  misc_feature (345)..(345): n is a, c, g, or t
  modified_base (365)..(365): a, c, t, g, unknown or other
  misc_feature (365)..(365): n is a, c, g, or t
  modified_base (379)..(379): a, c, t, g, unknown or other
  misc_feature (379)..(379): n is a, c, g, or t
  modified_base (386)..(386): a, c, t, g, unknown or other
  misc_feature (386)..(386): n is a, c, g, or t
tcagtacgctgtctcacgaccggtgctcgatttagtgtcgtcgcaaggggggaggaactgctcagttaggacccagacggaaccatggaagccccagcgcagcttctcttcctcctgctactctggctcccagatatcactggagaaatagtgatggacgcagtctccagcccaccctatctgtgtctccaggagaaagngcccacctctcctgtagggccagtcagagtgttagcagcaacttagcctggtacagcaggaacctggccgaggttcccaggctcatcatctagtggtgcatcccaccgcgggcctacgtggtactccgacgtccctactttaggnggcagggtgggtctgggacnggtattcactcacncgatacngcagctgcagtctagagttagtttgtacttagtttacttagtagtacctaacgtactactaagttacgtacgtcggtccttcctacgttaccgtttcggggacggggtaacggtaccgtaaggggtcggaaggtaaccgtaacgtaaaacgtacggttcggtacggtacggttacgacgtaccgtattccgttaccgttccgttaccg

SEQ ID NO: 231694 - DNA, 726 bp, Homo sapiens
  misc_feature: GYAE6OF02F15T5.36.21.B10.1.454.CMB.1.raw
  modified_base (199)..(199): a, c, t, g, unknown or other
  misc_feature (199)..(199): n is a, c, g, or t
tcagtacgctgtctcacgaccggtgctcgatttagtgtcgtcgcaagggggaggaactgctcagttaggacccagacggaaccatggaagccccagcgcagcttctcttcctcctgctactctggctcccagatatcactggagaaatagtgatgacgcagtctccagcccaccctatctgtgtctccgaggagaaagngccaccctctcctgtacggccagtcagtagtgtagcagcaacttagcctaggtaccagacacgaacctggccgtacggttcccgaggctcatcatctagtggtcgactactcccgaaccgacgggtcccacgttacggtacctaccccgacgtaccctaaccgttttcggcggtccgtacggttcggggttccgtaggggaacctacggtacgttaccgtaccgtaccgtacctaaccctacgtaccgagtccgtaacgcccgttagacccgtacgttaccgttagggtaaacgttacgtttttacgaccgtttaaggtttttaccttacgttacgtaaccgttaacgtaacggttaactaacgttagtaccgttccgtacccgttacgttaccgtttaccgttacgggaccgggtacgggtaacccggtagggtaccggaaacggtaccgttaaaccgaaaccggtaacgtcgggtaacggtcgaccggtacgtaacccgtacgtccgttaccgttcttaacccgg

SEQ ID NO: 231695 - DNA, 681 bp, Homo sapiens
  misc_feature: GYAE6OF02GPQEO.36.21.B10.1.454.CMB.1.raw
tcagtacgctgtctcacgaccggtgctcgatttagtgtcgtcgcaagggggaggaactgctcagttaggacccagacggaaccatggaagccccagcgcagcttctcttcctcctgctactctggctcccagatactcactggagaaatagtgatgacgcagtctcagccacctatctgtgtctcaggacgaaagcgccaccctctcctggtacgggccagtcagagtgttagcagcaacttgcctggtaccagcagaacctggacctaggttcccaggctacgatcattctagttggtgccactcccgaccggacgggcctacgttcggtactacccagtacccgttacgttttaggcggacgtagggtcgggtcgtagggacaggtacgttcaccgttctaccgacctatcgaactccgacgtccgtgtaccgtacggttctaacggtaacgtttagttttaccgagttttaaacgttttacgttacgttacgtaaccgtaaacgtacgtaaacgtaaggtttcgaaaccgttcccggtacctttaccggttccgtttaaccggggtttcgggaccgggtaaaccgggtaccgaaggggttcggaactaacggtaaccggtaaacgtacgttcggacggtctaccgacccgtaacgttgttacgttcgttccctaaccg

SEQ ID NO: 231696 - DNA, 581 bp, Homo sapiens
  misc_feature: GYAE6OF02HLXAE.36.21.B10.1.454.CMB.1.raw
  modified_base (155)..(155): a, c, t, g, unknown or other
  misc_feature (155)..(155): n is a, c, g, or t
  modified_base (168)..(168): a, c, t, g, unknown or other
  misc_feature (168)..(168): n is a, c, g, or t
  modified_base (171)..(171): a, c, t, g, unknown or other
  misc_feature (171)..(171): n is a, c, g, or t
  modified_base (182)..(182): a, c, t, g, unknown or other
  misc_feature (182)..(182): n is a, c, g, or t
  modified_base (192)..(192): a, c, t, g, unknown or other
  misc_feature (192)..(192): n is a, c, g, or t
  modified_base (201)..(201): a, c, t, g, unknown or other
  misc_feature (201)..(201): n is a, c, g, or t
  modified_base (207)..(207): a, c, t, g, unknown or other
  misc_feature (207)..(207): n is a, c, g, or t
  modified_base (246)..(246): a, c, t, g, unknown or other
  misc_feature (246)..(246): n is a, c, g, or t
  modified_base (253)..(253): a, c, t, g, unknown or other
  misc_feature (253)..(253): n is a, c, g, or t
  modified_base (276)..(276): a, c, t, g, unknown or other
  misc_feature (276)..(276): n is a, c, g, or t
  modified_base (294)..(294): a, c, t, g, unknown or other
  misc_feature (294)..(294): n is a, c, g, or t
  modified_base (388)..(388): a, c, t, g, unknown or other
  misc_feature (388)..(388): n is a, c, g, or t
  modified_base (394)..(394): a, c, t, g, unknown or other
  misc_feature (394)..(394): n is a, c, g, or t
  modified_base (433)..(433): a, c, t, g, unknown or other
  misc_feature (433)..(433): n is a, c, g, or t
  modified_base (468)..(468): a, c, t, g, unknown or other
  misc_feature (468)..(468): n is a, c, g, or t
  modified_base (478)..(478): a, c, t, g, unknown or other
  misc_feature (478)..(478): n is a, c, g, or t
  modified_base (492)..(492): a, c, t, g, unknown or other
  misc_feature (492)..(492): n is a, c, g, or t
  modified_base (509)..(509): a, c, t, g, unknown or other
  misc_feature (509)..(509): n is a, c, g, or t
  modified_base (518)..(518): a, c, t, g, unknown or other
  misc_feature (518)..(518): n is a, c, g, or t
  modified_base (561)..(561): a, c, t, g, unknown or other
  misc_feature (561)..(561): n is a, c, g, or t
  modified_base (574)..(574): a, c, t, g, unknown or other
  misc_feature (574)..(574): n is a, c, g, or t
tcagtacgctgtctcacgaccggtgctcgatttagtgtcgtcgcaagagaggaggggggtagaggagcccagcactagaagtcggcggtgtttccattcggtgatcagcactgaacacagaggactcaccatggagtttggctgagcgtggttcncgtgctcttaagngtntcagtgtaagngacaagtggngacgttcgnggggangttcgatccgagtcctggggactccgtgagcctcgtccngtagacngtccacgtggaacttcgtactanaactcacgtagtcgcaancggaactcgcgggtccaaccgtgcctaaccgcggtaccgaagggtctgaggtgtacggttcctttaatccagtagtggatcgagtatcgtaaancgtaanactgctaacgctcgtacggacggtacctgttaccaacgnttaccaccggtagaacagtaccttaacgaagaacntacgtacgtnccgtacagtaaccngtaccgctaaaccggtnagttaacgngtaacgacgagccgtaatgtacgtacttcgcgcccgtacccgngggactaagggtntccggta

SEQ ID NO: 231697 - DNA, 825 bp, Homo sapiens
  misc_feature: GYAE6OF02H3F7P.36.21.B10.1.454.CMB.1.raw
tcagtacgctgtctcacgaccggtgctcgatttagtgtcgtcgcaagggggaggaactgctcagttaggacccagacggaaccatggaagccccagcgcagcttctcttcctcctgctactctggctccagatatcactggagaaatagtgatgacgcagtctccagcctacctatctgtgtctccgaggagaaagcgccaccctctcctggtacgggccagtcagtagtgttacgcagctaacttagccgttggtaaccaggcaacgaaaccgtggaccacggttccaggtctcgatcgactcttagtcggtcgacacgttcccaaccgacgggacctacgttacggtaacctacccgacgtacccttaacgttttacggtacggactaggggtcgggttacgtacggggaactaggtacgttactaaccgttccttacccgaaccgtacgtaccgtacgacgtaccggtaccgtaccggtactaacggttgtaaacggtaaacgtttacgggttttacgaaccgtttttaaggtttttaaacgtttaaccgttcggttaaacccgttaaaaccgtaaacggtttaaaaccttaacggtttccgggtaaaccgtttcccggggtccctttaaccgtacccggttttaaacccggtttccggggggaaacgggttaaacccgggggtaccggttaaacgggggttacgaaaccgggttaaccgtaaaccggtaaaaaccgggttaccgggttacgggtaccggtaaccgtttaccggaaccttacccggttagtttaccggttacggttttaccctttaacccgg

SEQ ID NO: 231698 - DNA, 714 bp, Homo sapiens
  misc_feature: GYAE6OF02H2M1B.36.21.B10.1.454.CMB.1.raw
  modified_base (197)..(197): a, c, t, g, unknown or other
  misc_feature (197)..(197): n is a, c, g, or t
  modified_base (206)..(206): a, c, t, g, unknown or other
  misc_feature (206)..(206): n is a, c, g, or t
tcagtacgctgtctcacgaccggtgctcgatttagtgtcgtcgcaagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagngccaccctntcctggtaggccagtcagagttgttagcagcaattacgctggtaccagcaagaaacctggccaggttcccaggctcatctatctagtggtgctactccaccgacgggcctacgtaggtacctccccgagtaccccgttacgtttaggtcggtaccgtaggggttcggggtcgttcggggaacgtacggtacgtttccaacccgttcgttaccaacccaagttccgaaccgccgtaacgtccctacggtacctaggttcgtaggtaagttacgttttcggtaaccgttttaggttttaaccttttacgtacgttaacctaaacgtacgtaacctaagtaccgtacggttccgtaccttaccgttccgtaaccgttttcggggaccgggttaacgggaaccgtaaggggtacgggtaacgtacgtaacgtaaaccggttaccgtaagggttccggtaacgttccgggtaaccctaccgttaacgtttaccggttacgttccctttaaccg

SEQ ID NO: 231699 - DNA, 767 bp, Homo sapiens
  misc_feature: GYAE6OF02F5ER2.36.21.B10.1.454.CMB.1.raw
tcagtacgctgtctcacgaccggtgctcgatttagtgtcgtcgcaagggggaggaactgctcagttaggacccagacggaaccatggaagccccagcgcagcttctcttcctcctgctactctggctcccagatatcactggagaaatagtgatgacgcagtctccagcccaccctatctgtgtctccgaggagaagacgcccaccctctcctggtacgggccagtcagtagtgtagcgagctaacgttgccgttaggtaccaggaccaacggtaaacctggaccgtacggttccccaggcctacatctatcgtagtggtcactactcccgaccgacgggacctacggttcggtacctacccgacgtacccttaaccgtttaggtcggacgtacgggttcggggtacgtacggggaacaggttacgtttaccaccgttcccgtaccaccctactaccggaacgtaccgtaccggtaccgttgaccgttacggttcgttaaacggtaacgttttacgttttacgtactttaacggtttttattaccgttacgtaactaaaccgttacgtacgtaaacgttcggaacccgtttacggtaccctttacctaccggttttaacccgttacgggggtaccgggtaaaaccgggtaccggttaaggggtaccgggtaagtaaccgttaaacccgggaaaccgttacggtccgggttaggaccggttaccggaaccgtaaccgttaacgtcccgtttacggtaccctttaaccg

SEQ ID NO: 231700 - DNA, 907 bp, Homo sapiens
  misc_feature: GYAE6OF02IN6Y2.36.21.B10.1.454.CMB.1.raw
  modified_base (696)..(696): a, c, t, g, unknown or other
  misc_feature (696)..(696): n is a, c, g, or t
tcagtacgctgtctcacgaccggtgctcgatttagtgtcgtcgcaaagagaggaggggggggagaggagcccagcactaagaagtcggcgtgtttccattcggtgatcagcactagaaacacaggacggactcacatggagtttgggctgagcgttggttttcctgttcgccttacgttttaaaggaggttcgtccagttggtacgtaggtgaccgtaacgttgggtggacggttacgggtaggggggagccgtagactccgaggtccgtggggaccgttcccgtaggacgtaccttccgtccgtggtcgaccacgtaccgttcgacggtaactaccctaaccctttaacaaacgttacgtacttacgtacggtaccgtagtccgtacccgtaccgggtccgggttacccgacggtaccggtccgtaccggaacgggacggtaacggggtcgtaagggtcgggtttaggggttcgttttaacttttcgttactaacggtattaggtacggtaagggtacttaagtttaacgtaggtaacttacgtacggtacgaacgttacggtaccggttacgggtaacgggtaaacccggtacgttaacctacctacccgtaacgttacccgaacgtaaacgtaaaccgtaacctttaaaacctaccggaaaacgtacccgtaccgttaggttactaaaccgtnttaaaccggaaacgtaacgttaacgacccgtttaaaccgtaaacgtacgggttaaaaggtcccggtttaacgggaacccgggttaagcccgggtttaacgtttacggtttaccggtttaaaccttccgggttcccccggggtaaccccggttttcccccggggtaacccggggttaggtaaccggggtttacccggtggggtttaccccgg

SEQ ID NO: 231701 - DNA, 716 bp, Homo sapiens
  misc_feature: GYAE6OF02FJEWW.36.21.B10.1.454.CMB.1.raw
tcagtacgctgtctcacgaccggtgctcgatttagtgtcgtcgcaagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtacgggccagtcagagtgttagcagcaacttagcctggtaccagcagaaacctggccaggttcccaggctcatcatctatggtgcatccacgagggccacgtggtactacccgacgtaccctaccgttttaggtcggcgtaggttcgggttcgtaggggactaaggtacggttccaacttccgtaccaaccctattaccgagtaccacgtcccgttaggcctaggttccgttaggtaaagttacgtttttagaccgttttaaggttttaactttactttcggtaacctaaacttaacggttaaaccaagtttacggaaccttcggtccctttacttaccgtttaacccgtttccggggacgggtaacggggtaacccgtaaggggtttacgggaagtaaccggttaaaccggtaaaaccggtaaccggtttagggtaccgggtaaccggttacgaacccggtaacccttaggttacccgtttaccggtttacccttttaacccgg

SEQ ID NO: 231702 - DNA, 775 bp, Homo sapiens
  misc_feature: GYAE6OF02H0QSN.36.21.B10.1.454.CMB.1.raw
tcagtacgctgtctcacgaccggtgctcgatttagtgtcgtcgcaaggggggaggaactgctcagttaggacccagacggaaccatggaagccccagcgcagcttctcttcctcctgctactctggctccagatatcactggaagaaatagtgatgacgcagtctccagccaccctatctgtcgtctaccgaggaagaaagcgccacccctctccgtggtacgggcctacggtcaggtagtgttacgcagactaacgttgcctaggtaaccagcaaacggtaaacctcggacctacggttacccaggtcctacgaactctaacgttcttaaggtcgggttcgacctaacgtcccgaaccggcgggacccctaaggttcggtaacctaccccgaacgtacccgttaaccggttttaggaccgggtacgtaacggggtttcgggtaccggttaggggaaccttaacgggttaccgttaccgtaaccttcccttaccgaaaccttacgttacccgaacgtaccgaaccgttccgtaccggtactacggttccgttaaaggtaaacgtttgtttacggtacttttaaagttttacgttaccgtttaacgtaaccctaaagtacgttaaactacgttaccggtaccgtcgtacccttcgttaaccgttacgggtttaccggggaacggaacgggtaccgtagggtacgggactaacgaccgtaaacgttacggtcggtacgtccgtaacgccgtaccttagttaccgttgtacccttacg

SEQ ID NO: 231703 - DNA, 876 bp, Homo sapiens
  misc_feature: GYAE6OF02I6V01.36.21.B10.1.454.CMB.1.raw
  modified_base (193)..(193): a, c, t, g, unknown or other
  misc_feature (193)..(193): n is a, c, g, or t
tcagtacgctgtctcacgaccggtgctcgatttagtgtcgtcgcaagggggaggaactgctcagttaggacccagacggaaccatggaagccccagcgcagcttctcttcctcctgctactctggctcccagatatcactggaagaaatagtgatgacgcagtctccagccaccctatctgtgtctccagganaaagcgcccaccctctcctggtacgggccagtcaagacgttgttacgcagctaaaccgttagcccgttaggtaacccagtaccgaacgtaaaaccccgtcgggaccccgtaacgggttccccgaagggtccttaccgaacttcctaacgttacccgttaagttagggttacgacctaccgttacccgaacccggacgggtaccctaacgttacgggttacctacccccggaacgtaccccttaaaccgttttacggtacgggtacgtacggggtttcggggttacccgttaggggaaccgttaacggttacgtttacccgaaccgtttccctacccgtaacccgtattacccgaacggacccgtaaccggtccctacggtaccgtaacgttaccgtacggtaaacggtttagtttttaccggaccgtttaagtttttaaccgttacgttacggtttaaccaaaccgttaaggtaacctaagttaccgtacccggttacgtacccctttacttaccggttaaccggttttaccggggaaccggtaacggggtaacccgtaacggggttaggtaaacccgtaacgttaaacccggtaaaaccggttaaccgttcgggtaaccgttaccggttaaccgacccgtaacccttaacggtttacccggtttacgttaaccctttaccgg

SEQ ID NO: 231704 - DNA, 710 bp, Homo sapiens
  misc_feature: GYAE6OF02FPYA4.36.21.B10.1.454.CMB.1.raw
  modified_base (197)..(197): a, c, t, g, unknown or other
  misc_feature (197)..(197): n is a, c, g, or t
tcagtacgctgtctcacgaccggtgctcgatttagtgtcgtcgcaagggggaggaactgctcagttaggacccagacggaaccatggaagccccagcgcagcttctcttcctcctgctactctggctcccagatatcactggagaaatagtgatgacgcagtctccagccaccctgtctttgtctcgaggggaaagngccacctctcctgcagggccagtcagagtgttagcagcttacttagcctggtaaccaacagaaacctggaccaggcctcccgaaggtcctcctaccagttcctagtagatacactccgtaacacgggcctagtggccactccccgagcccgtaagttccaggtcggactgggttgggtcgtggggaacctgggtaccttcgacgtccttaccaacctagtaccacgtccaacgtcccggttaaacgaaccgtaggtaaacgttacgttttacggacgtttaagttttaactttacgttagttacaacgtcgtaaggccggtaagggtaccggttccgtttccgggaaccccggtttacggggaaaccgtaaaggggttcgaaacgttacgtaaaccggtaaaaccgggttaccttagggccggttaacggtacgtaccgtaaccgtacgttaccttaccgggttaccttttacctacccggtttccctaccccggttaccgtattaaccccgg

SEQ ID NO: 231705 - DNA, 538 bp, Homo sapiens
  misc_feature: GYAE6OF01AJKRD.18.31.C09.1.454.CMB.1.raw
  modified_base (132)..(132): a, c, t, g, unknown or other
  misc_feature (132)..(132): n is a, c, g, or t
  modified_base (207)..(207): a, c, t, g, unknown or other
  misc_feature (207)..(207): n is a, c, g, or t
  modified_base (501)..(501): a, c, t, g, unknown or other
  misc_feature (501)..(501): n is a, c, g, or t
  modified_base (503)..(503): a, c, t, g, unknown or other
  misc_feature (503)..(503): n is a, c, g, or t
  modified_base (505)..(505): a, c, t, g, unknown or other
  misc_feature (505)..(505): n is a, c, g, or t
  modified_base (508)..(538): a, c, t, g, unknown or other
  misc_feature (508)..(538): n is a, c, g, or t
tcagtacgagtatgcacgaccggtgctcgatttagacgtctcatcaaggaaggaagggggctggagtggatttcatacattagtagtgctggcaataccatcctctacgcagactctgtgaagggccggttnagcgtctccagggacaacgccaaataactttctgtttctgcaaatgaacagcctgagagccgaggactcggccanatattactgtgcgagaggtaattttgactggttattcctacttactttgactacgtggggccaggcactccggtcaccgtctcctcacgcctccaccgaacggcccatccggtccttcccccgtggcccacccctcctaccgaagacgccaccgtccgagacgaccacgacggcccggtcccgtcggggcctcggcccgttgggtacccgaaagggtaacccttacccttaccccattaaccgtccgtacgtgggacggcggggaccttgggaccgtaagggccaacgtagtangntnacnnnnnnnnnnnnnnnnnnnnnnnnnnnnnnn

SEQ ID NO: 231706 - DNA, 431 bp, Homo sapiens
  misc_feature: GYAE6OF02G2KN9.18.31.C09.1.454.CMB.1.raw
  modified_base (426)..(431): a, c, t, g, unknown or other
  misc_feature (426)..(431): n is a, c, g, or t
tcagtacgagtatgcacgaccggtgctcgatttagacgtctcatcaaggaaggaaggggctggagtggatttcatacattagtagtgctggcaataccatcctctacgcagactctgtgaagggccggttcagcgtctccagggacaacgccaataactttctgtttctgcaaatgaacagcctgagagccgaggactcggccacatattactgtgcgagaggaattttgactggttattcctactactttgactactggggccagggcactccggtcaccgtctcctcagcctccaccaagggcccatcggtcttccccctggcaccctcctccaagagcacctctgggggcacagcggccctgggctgcctggtcaaggactacttcccatactcgtactgagcgggctggcaaggcgcatagnnnnnn

SEQ ID NO: 231707 - DNA, 430 bp, Homo sapiens
  misc_feature: GYAE6OF02G8HIA.18.31.C09.1.454.CMB.1.raw
  modified_base (339)..(339): a, c, t, g, unknown or other
  misc_feature (339)..(339): n is a, c, g, or t
  modified_base (425)..(430): a, c, t, g, unknown or other
  misc_feature (425)..(430): n is a, c, g, or t
tcagtacgagtatgcacgaccggtgctcgatttagacgtctcatcaaggaaggaaggggctggagtggatttcatacattagtagtgctggcaataccatcctctacgcagactctgtgaagggccggttcagcgtctccagggacaacgccaataactttctgtttctgcaaatgaacagcctgagagccgaggactcggccacatattactgtgcgagaggtaattttgactggttattcctactactttgactacgtggggccagggcactccggtcaccgtctcctcagcctccaccaagggcccatcggtcttcccctggcaccctcctccagngcacctctggggcacagcggccctggctgcctggtcaaggctacttcccatactcgtactgacgcgggctgggcaaggcgcatagnnnnnn

SEQ ID NO: 231708 - DNA, 519 bp, Homo sapiens
  misc_feature: GYAE6OF02GG2LS.18.31.C09.1.454.CMB.1.raw
  modified_base (230)..(230): a, c, t, g, unknown or other
  misc_feature (230)..(230): n is a, c, g, or t
  modified_base (245)..(245): a, c, t, g, unknown or other
  misc_feature (245)..(245): n is a, c, g, or t
  modified_base (358)..(358): a, c, t, g, unknown or other
  misc_feature (358)..(358): n is a, c, g, or t
  modified_base (486)..(486): a, c, t, g, unknown or other
  misc_feature (486)..(486): n is a, c, g, or t
  modified_base (488)..(519): a, c, t, g, unknown or other
  misc_feature (488)..(519): n is a, c, g, or t
tcagtacgagtatgcacgaccggtgctcgatttagacgtctcatcaaggaaggaaggggctggagtggatttcatacattagtagtgctggcaataccatcctctacgcagactctgtgaagggccggttcagcgtctccagggacaacgccaataactttctgtttctgcaaatgaacagcctgagagccgaggactcggccgtttactactgtgcgagagatcccggngatgctggcaccggntggtactacttgattcctggggccagggaaccctggtcacccgtctcctcacgccctccacccaagggccccagtccggtccttccccccgtggccgccctgcctccaggacnccacctcgagagcacgagccggccgtcgggctcggcctacgggtcaacgggtacctacccttcccaatacctacggttaacctggacggccggggcctagggacccgaaagggtccggactaagacgncnnnnnnnnnnnnnnnnnnnnnnnnnnnnnnnn

SEQ ID NO: 231709 - DNA, 450 bp, Homo sapiens
  misc_feature: GYAE6OF02FHZQL.18.31.C09.1.454.CMB.1.raw
  modified_base (439)..(450): a, c, t, g, unknown or other
  misc_feature (439)..(450): n is a, c, g, or t
tcagtacgagtatgcacgaccggtgctcgatttagacgtctcatcaaggaaggaaggggctggagtggatttcatacattagtagtgctggcaataccatcctctacgcagactctgtgaagggccggttcagcgtctccagggacaacgccaataactttctgtttctgcaaatgaacagcctgagagccgaggactcggccacatattactgtgcgagaggtaattttgactggttattcctactactttgactactgggccagggcactccggtcaccgtctcctcagcctccaccaagggcccatccggtccttcccccctggccacccctccctccaagacgccacctcgtcgggggcacagccggccctgggctgcctggtcaaggactacttcccatactcgtactgacgcgggctggcaaggcgcagtagnnnnnnnnnnnn

SEQ ID NO: 231710 - DNA, 452 bp, Homo sapiens
  misc_feature: GYAE6OF02I4OOS.18.31.C09.1.454.CMB.1.raw
  modified_base (213)..(213): a, c, t, g, unknown or other
  misc_feature (213)..(213): n is a, c, g, or t
  modified_base (435)..(435): a, c, t, g, unknown or other
  misc_feature (435)..(435): n is a, c, g, or t
  modified_base (440)..(452): a, c, t, g, unknown or other
  misc_feature (440)..(452): n is a, c, g, or t
tcagtacgagtatgcacgaccggtgctcgatttagacgtctcatcaaggaaggaaggggctggagtggatttcatacattagtagtgctggcaataccatcctctacgcagactctgtgaagggccggttcagcgtctccagggacaacgccaataactttctgtttctgcaaatgaacagcctgagagccgaggactcggccacatattacngtgcgagaggaattttgactggttattcctactactttgactacgtggggccagggcactccggtcaccgtctccctcacgcctccaccaagggccccatcggtccttccccctcggccacccctcctccaacgagcacctcgtgggggccacagccgcccgtgggctgccgtggtacaaggacctacttcccatactcgtactgagcgggctggcaaggcncatgnnnnnnnnnnnnn

SEQ ID NO: 231711 - DNA, 420 bp, Homo sapiens
  misc_feature: GYAE6OF01CNYLM.31.68.G02.1.454.CMB.1.raw
  modified_base (416)..(420): a, c, t, g, unknown or other
  misc_feature (416)..(420): n is a, c, g, or t
tcagcagtagacgtcacgaccggtgctcgatttagtcgatagtgaagggaaagggctggagtgggttgcccgtattaaagtaaactgatggtgagacaacagactacgctgcacccgtgaaaggcagattcgccatctcaagagatgattcagagaacacgctgtatctacaaatgaacagcctcaaaccgaggacacagccatctatttctgtaccacacacatgagtgggagtactacttctactactggggccagggaaccctggtctccgtctcctcggcctccaccaagggcccatcggtcttcccctggcgccctgctccaggagcacctccgagagcacagcggccctgggctgcctggtcaaggctacttccacgtctactgctgagcgggctggcaaggcgcatagnnnnn

SEQ ID NO: 231712 - DNA, 423 bp, Homo sapiens
  misc_feature: GYAE6OF01CIYV7.31.68.G02.1.454.CMB.1.raw
  modified_base (421)..(423): a, c, t, g, unknown or other
  misc_feature (421)..(423): n is a, c, g, or t
tcagcagtagacgtcacgaccggtgctcgatttagtcgatagtgaagggaaagggctggagtgggttgcccgtattaaagtaaactgatggtgagacaacagactacgctgcacccgtgaaaggcagattcgccatctcaagagatgattcagagaacacgctgtatctacaaatgaacagcctccaaaccgaggacacagccgtctatttctgtaccacacacatgagtgggagtactacttctactactggggccagggaaccctggtctccgtctcctcggcctccaccaagggcccatccggtcttccccctggcgccctgctccaggagcacctccgagagcacacgcggccctgggctgcctggtcaaggactacttccacgtctactgctgagcgggctggcaaggcgcatagnnn

SEQ ID NO: 231713 - DNA, 448 bp, Homo sapiens
  misc_feature: GYAE6OF01AT180.31.68.G02.1.454.CMB.1.raw
  modified_base (420)..(420): a, c, t, g, unknown or other
  misc_feature (420)..(420): n is a, c, g, or t
  modified_base (425)..(448): a, c, t, g, unknown or other
  misc_feature (425)..(448): n is a, c, g, or t
tcagcagtagacgtcacgaccggtgctcgatttagtcgatagtgaagggaaagggctggagtgggttgcccgtattaaagtaaactgatggtgagacaacagactaccgctgcacccgtgaaaggcagattcgccatctcaagagatgattcaagagaacacgctgtatctacaaatgaacagcctcaaaccgaggacacagccgtctatttcctgtacccacacacatgagtgggaggtactacttctactactggggccagggaaccctggtactccgtctcctcggcctccaccaagggcccatcggtcttccccctggcgccctgcctccaggacgcacctccgagagcacagcggccctgggctggcctggtcaaggctacttccacgtctactgctgagcgggctggcaaggcnatagnnnnnnnnnnnnnnnnnnnnnnnn

SEQ ID NO: 231714 - DNA, 427 bp, Homo sapiens
  misc_feature: GYAE6OF01BMJZG.31.68.G02.1.454.CMB.1.raw
  modified_base (422)..(427): a, c, t, g, unknown or other
  misc_feature (422)..(427): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctccaaaccgaggacacagccgtctatttctgtaccacacacatgagtgggaggtactacttctactactggggccagggaaccctggtctccgtctcctcggcctccaccaagggcccatcggtcttccccctggcgccctgctccaggagcacctccgagagcacagccggccctgggctgcctggtcaaggctacttccacgtcactgctgagcgggctggcaaggcgcatagnnnnnn

SEQ ID NO: 231715 - DNA, 421 bp, Homo sapiens
  misc_feature: GYAE6OF01CYMDQ.31.68.G02.1.454.CMB.1.raw
  modified_base (419)..(421): a, c, t, g, unknown or other
  misc_feature (419)..(421): n is a, c, g, or t
tcagcagtagacgtcacgaccggtgctcgatttagtcgatagtgaagggaagggctggagtgggttgcccgtattaaagtaaactgatggtgagacaacagactacgctgcacccgtgaaaggcagattcgccatctcaagagatgattcagagaacacgctgtatctacaaatgaacagcctccaaaccgaggacacagccgtctatttctgtaccacacacatgagtgggaggtactacttctactactggggccagggaacccctggtctccgtctcctcggcctccaccaagggcccatcggtcttccccctggcgccctgctccaggagcacctccgagagcacagcggccctgggctgcctggtcaaggctacttccacgtctactgctgagcgggctggcaaggcgcatagnnn

SEQ ID NO: 231716 - DNA, 433 bp, Homo sapiens
  misc_feature: GYAE6OF01BUO80.31.68.G02.1.454.CMB.1.raw
  modified_base (421)..(433): a, c, t, g, unknown or other
  misc_feature (421)..(433): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctccaaaccgaggacacagccgtctatttctgtaccacacacatgagtgggaggtactacttctactactggggccagggaaccctggtctccgtctcctcggcctccaccaagggcccatcggtctccccctggccgccctgctccaggagcacctccgagagcacagcggccctgggctgcctggtcaaggctactccacgtctactgctgagcgggctggcaaggcgcatagnnnnnnnnnnnnn

SEQ ID NO: 231717 - DNA, 420 bp, Homo sapiens
  misc_feature: GYAE6OF01A9SLD.31.68.G02.1.454.CMB.1.raw
  modified_base (418)..(420): a, c, t, g, unknown or other
  misc_feature (418)..(420): n is a, c, g, or t
tcagcagtagacgtcacgaccggtgctcgatttagtcgatagtgaagggaaagggctggagtgggttgcccgtattaaaagtaaactgatggtgagacaacagactacgctgcacccgtgaaaggcagattcgccatctcaagagatgattcagagaacacgctgtatctacaaatgaacagcctccaaaccgaggacacagccgtctatttctgtaccacacacatgagtgggaggtactacttctactactggggccagggaaccctggtctccgtctcctcggcctccaccaagggcccatcggtcttcccctggcgccctgctccaggagcacctccgagagcacagcggccctgggctgcctggtcaaggctacttccacgtctactgctgagcggctggcaaggcgcatagnnn

SEQ ID NO: 231718 - DNA, 428 bp, Homo sapiens
  misc_feature: GYAE6OF01CPUXY.31.68.G02.1.454.CMB.1.raw
  modified_base (424)..(428): a, c, t, g, unknown or other
  misc_feature (424)..(428): n is a, c, g, or t
tcagcagtagacgtcacgaccggtgctcgatttagtcgatagtgaagggaaaggggctggagtgggttgcccgtattaaaagtaaactgatggtgagacaacagactacgctgcacccgtgaaaggcagattcgccatctcaagagatgattcagagaacacgctgtatctacaaatgaacagcctccaaaccgaggacacagccgtctatttctgtaccacacacatgagtgggaggtactacttctactactggggccagggaacccctggtctccgtctcctcggcctccaccaagggccccatcggtcttccccctggcgccctgctccaggagcacctccgagagcacagcggccctgggctgcctggtcaaggactacttccacgtctactgctgagcgggctggcaaggcgcatagnnnnn

SEQ ID NO: 231719 - DNA, 429 bp, Homo sapiens
  misc_feature: GYAE6OF01C0K56.31.68.G02.1.454.CMB.1.raw
  modified_base (339)..(339): a, c, t, g, unknown or other
  misc_feature (339)..(339): n is a, c, g, or t
  modified_base (424)..(429): a, c, t, g, unknown or other
  misc_feature (424)..(429): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctccaaaccgaggacacagccgtctatttctgtaccacacacatgagtgggaggtactacttctactactggggccagggaaccctggtctccgtctcctcggcctccaccaagggcccatcggtccttccccctggccgccctgctccagganccacctccgagagcacagcggccctgggctgcctggtcaaggactacttccacgtctactgctgagcggctggcaaggcgcatgnnnnnn

SEQ ID NO: 231720 - DNA, 425 bp, Homo sapiens
  misc_feature: GYAE6OF01BKVOI.31.68.G02.1.454.CMB.1.raw
  modified_base (420)..(425): a, c, t, g, unknown or other
  misc_feature (420)..(425): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctccaaaccgaggacacagccgtctatttctgtaccacacacatgagtgggaggtactacttctactactggggccagggaaccctggtctccgtctcctcggcctccaccaagggcccatcggtcttccccctggcgccctgctccaggagcacctccgagagcacagcggccctgggctgcctggtcaaggctactccacgtctactgctgagcggctggcaaggcgcatagnnnnnn

SEQ ID NO: 231721 - DNA, 428 bp, Homo sapiens
  misc_feature: GYAE6OF01AO2T0.31.68.G02.1.454.CMB.1.raw
  modified_base (422)..(428): a, c, t, g, unknown or other
  misc_feature (422)..(428): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctccaaaccgaggacacagccgtctatttctgtaccacacacatgagtgggaggtactacttctactactggggccagggaaccctggtctccgtctcctcggcctccaccaagggcccatcggtcttccccctggcgccctgctccaggagcacctccgagagcacagcggccctgggctgcctggtcaaggctacttccacgtctactgctgagcgggctggcaaggcgcatagnnnnnnn

SEQ ID NO: 231722 - DNA, 429 bp, Homo sapiens
  misc_feature: GYAE6OF01C7Y9D.31.68.G02.1.454.CMB.1.raw
  modified_base (336)..(336): a, c, t, g, unknown or other
  misc_feature (336)..(336): n is a, c, g, or t
  modified_base (422)..(429): a, c, t, g, unknown or other
  misc_feature (422)..(429): n is a, c, g, or t
tcagcagtagacgtcacgaccggtgctcgatttagtcgatagtgaagggaaggggctggagtgggttgcccgtattaaaagtaaaactgatggtgagacaacagactacgctgcacccgtgaaaggcagattcgccatctcaagagatgattcagagaacacgctgtatctacaaatgaacagcctccaaaccgaggacacagccgtctatttctgtaccacacacatgagtgggaggtactacttctactactggggccagggaaccctggtctccgtctcctcggcctccaccaagggcccatcggtcttccccctggccgccctgctccaggngcacctcgagagcacagcggccctgggctgcctggtcaaggactacttccacgtctactgctgagcgggctggcaaggcgcatagnnnnnnnn

SEQ ID NO: 231723 - DNA, 422 bp, Homo sapiens
  misc_feature: GYAE6OF01EQGFD.31.68.G02.1.454.CMB.1.raw
  modified_base (418)..(422): a, c, t, g, unknown or other
  misc_feature (418)..(422): n is a, c, g, or t
tcagcagtagacgtcacgaccggtgctcgatttagtcgatagtgaagggaaaggggctggagtgggttgcccgtattaaaagtaaactgatggtgagacaacagactacgctgcacccgtgaaaggcagattcgccatctcaagagatgattcagagaacacgctgtatctacaaatgaacagcctccaaaccgaggacacagccgtctatttctgtaccacacacatgagtgggagtactacttctactactggggccagggaaccctggtctccgtctcctcggcctccaccaaggcccatcggtctcccctggcgccctgctccaggacgcacctccgagacgcacagcggccctgggctgcctggtcaaggctactccacgtctactgctgagcgggctggcaaggcgcatagnnnnn

SEQ ID NO: 231724 - DNA, 420 bp, Homo sapiens
  misc_feature: GYAE6OF01C7ZQ7.31.68.G02.1.454.CMB.1.raw
  modified_base (213)..(213): a, c, t, g, unknown or other
  misc_feature (213)..(213): n is a, c, g, or t
  modified_base (389)..(389): a, c, t, g, unknown or other
  misc_feature (389)..(389): n is a, c, g, or t
  modified_base (416)..(420): a, c, t, g, unknown or other
  misc_feature (416)..(420): n is a, c, g, or t
tcagcagtagacgtcacgaccggtgctcgatttagtcgatagtgaagggaaagggctggagtgggttgcccgtattaaagtaaactgatggtgagacaacagactacgctgcacccgtgaaaggcagattcgccatctcaagagatgattcagagaacacgctgtatctacaaatgaacagcctccaaaccgaggacacagccgtctatttcngtaccacacacatgagtgggaggtactacttctactactggggccagggaaccctggtctccgtctcctcggcctccacaaggcccatcggtctcccctggcgccctgctccaggagcacctccgagagcacagccggccctgggctgcctggtcaaggactactccacgtctacngctgagcgggctggcaaggcgcatagnnnnn

SEQ ID NO: 231725 - DNA, 424 bp, Homo sapiens
  misc_feature: GYAE6OF01DS086.31.68.G02.1.454.CMB.1.raw
  modified_base (330)..(330): a, c, t, g, unknown or other
  misc_feature (330)..(330): n is a, c, g, or t
  modified_base (418)..(424): a, c, t, g, unknown or other
  misc_feature (418)..(424): n is a, c, g, or t
tcagcagtagacgtcacgaccggtgctcgatttagtcgatagtgaagggaaaggggctggagtgggttgcccgtattaaaagtaaactgatggtgagacaacagactacgctgcacccgtgaaaggcagattcgccatctcaagagatgattcagagaacacgctgtatctacaaatgaacagcctccaaaccgaggacacagccgtctatttctgtaccacacacatgagtgggagtactacttctactactggggccagggaaccctggtctccgtctcctcggcctccaccaagggcccatcggtctcccctggcgcctgctcaggncacctcgagagcacagcggccctggggctgcctggtcaacggactacttccacgtctactgctgagcgggctggcaaggcgacatagnnnnnnn

SEQ ID NO: 231726 - DNA, 428 bp, Homo sapiens
  misc_feature: GYAE6OF01CZGSF.31.68.G02.1.454.CMB.1.raw
  modified_base (423)..(428): a, c, t, g, unknown or other
  misc_feature (423)..(428): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctccaaaccgaggacacagccgtctattctgtaccacacacatgagtgggaggtactacttctactactggggccagggaaccctggtctccgtctcctcggcctccaccaaggcccatcggtcttccccctggccgccctgctccaggacgcacctccgagacgcacagcggccctgggctgcctggtcaaggactacttccacgtctactgctgagcggctggcaaggcgcatagnnnnnn

SEQ ID NO: 231727 - DNA, 424 bp, Homo sapiens
  misc_feature: GYAE6OF01CZR83.31.68.G02.1.454.CMB.1.raw
  modified_base (332)..(332): a, c, t, g, unknown or other
  misc_feature (332)..(332): n is a, c, g, or t
  modified_base (392)..(392): a, c, t, g, unknown or other
  misc_feature (392)..(392): n is a, c, g, or t
  modified_base (420)..(424): a, c, t, g, unknown or other
  misc_feature (420)..(424): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctccaaaccgaggacacagccgtctatttctgtaccacacacatgagtgggagtactacttctactactggggccagggaaccctggtctccgtctcctcggcctccaccaaggcccatcggtcttccccctgcgcctgctccaggngcacctccgagacgcacagcggccctgggctgcctggtcaaggactactccacgtctacngctgagtcgggctggcaaggcgcatagnnnnn

SEQ ID NO: 231728 - DNA, 428 bp, Homo sapiens
  misc_feature: GYAE6OF01B7M3N.31.68.G02.1.454.CMB.1.raw
  modified_base (338)..(338): a, c, t, g, unknown or other
  misc_feature (338)..(338): n is a, c, g, or t
  modified_base (424)..(428): a, c, t, g, unknown or other
  misc_feature (424)..(428): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctccaaaccgaggacacagccgtctatttctgtaccacacacatgagtgggaggtactacttctactactggggccagggaaccctggtctccgtctcctcggcctccaccaagggcccatcggtcttccccctggccgccctgctccaggancacctccgagagcacagcgccctgggctgcctggtcaaggactacttccacgtctactgctgagcgggctgggcaaggcgcatagnnnnn

SEQ ID NO: 231729 - DNA, 434 bp, Homo sapiens
  misc_feature: GYAE6OF01APFCP.31.68.G02.1.454.CMB.1.raw
  modified_base (422)..(422): a, c, t, g, unknown or other
  misc_feature (422)..(422): n is a, c, g, or t
  modified_base (424)..(434): a, c, t, g, unknown or other
  misc_feature (424)..(434): n is a, c, g, or t
tcagcagtagacgtcacgaccggtgctcgatttagtcgatagtgaagggaaagggctggagtgggttgcccgtattaaaagtaaaactgatggtgagacaacagactacgctgcacccgtgaaaggcagattcgccatctcaagagatgattcagagaacacgctgtatctacaaatgaacagcctccaaaccgaggacacagccgtctatttctgtaccacacacatgagtgggaggtactacttctactactggggccagggaacccctggtctccgtctcctcggcctccaccaagggcccatcgtcttccccctggcgccctgctccaggacgcacctccgagagcacagcggccctgggctgcctggtcaaggctacttccacgtctactgctgagcgggctggcaaggcgcatagngnnnnnnnnnnn

SEQ ID NO: 231730 - DNA, 421 bp, Homo sapiens
  misc_feature: GYAE6OF01D7QYM.31.68.G02.1.454.CMB.1.raw
  modified_base (414)..(421): a, c, t, g, unknown or other
  misc_feature (414)..(421): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctccaaaccgaggacacagccgtctattctgtaccacacacatgagtgggagtactacttctactactggggccagggaaccctggtctccgtctcctcggcctccaccaaggcccatcggtctcccctggcgccctgctccaggagcacctcgagagcacagcggccctgggctgcctggcaaggctactccacgtctactgctgagcgggctggcaaggcgcatagnnnnnnnn

SEQ ID NO: 231731 - DNA, 428 bp, Homo sapiens
  misc_feature: GYAE6OF01CTMY7.31.68.G02.1.454.CMB.1.raw
  modified_base (424)..(428): a, c, t, g, unknown or other
  misc_feature (424)..(428): n is a, c, g, or t
tcagcagtagacgtcacgaccggtgctcgatttagtcgatagtgaagggaaaggggctggagtgggttgcccgtattaaaagtaaactgatggtgagacaacagactacgctgcacccgtgaaaggcagattcgccatctcaagagatgattcagagaacacgctgtatctacaaatgaacagcctccaaaccgaggacacagccgtctatttctgtaccacacacatgagtgggaggtactacttctactactggggccagggaacccctggtctccgtctcctcggcctccaccaagggcccatcggtcttccccctggcgccctgctccaggagcacctccgagagcacagcggccctgggctgccctggtcaaggactacttccacgtctactgctgagcgggctggcaaggcgcatagnnnnn

SEQ ID NO: 231732 - DNA, 432 bp, Homo sapiens
  misc_feature: GYAE6OF01CMAS8.31.68.G02.1.454.CMB.1.raw
  modified_base (424)..(432): a, c, t, g, unknown or other
  misc_feature (424)..(432): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctccaaaccgaggacacagccgtctatttctgtaccacacacatgagtgggaggtactacttctactactggggccaggggaaccctggtctccgtctcctcggcctccaccaagggcccatcggtcttccccctggcgccctgctccaggagcacctccgagagcacagcggccctgggctgcctggtcaaggactacttccacgtctactgctgagcgggctggcaaggcgcatagnnnnnnnnn

SEQ ID NO: 231733 - DNA, 435 bp, Homo sapiens
  misc_feature: GYAE6OF01ERO6O.31.68.G02.1.454.CMB.1.raw
  modified_base (217)..(217): a, c, t, g, unknown or other
  misc_feature (217)..(217): n is a, c, g, or t
  modified_base (312)..(312): a, c, t, g, unknown or other
  misc_feature (312)..(312): n is a, c, g, or t
  modified_base (326)..(326): a, c, t, g, unknown or other
  misc_feature (326)..(326): n is a, c, g, or t
  modified_base (335)..(335): a, c, t, g, unknown or other
  misc_feature (335)..(335): n is a, c, g, or t
  modified_base (412)..(435): a, c, t, g, unknown or other
  misc_feature (412)..(435): n is a, c, g, or t
tcagcagtagacgtcacgaccggtgctcgatttagtcgatagtgaagggaaaggggctggagtgggttgcccgtattaaaagtaaaactgatggtagagacaacagactacgctgcacccgtgaaaggcagattcgccatctcaagagatgattcagagaacacgctgtatctacaaatgaacagcctccaaaccgaggacacagccgtctatttcngtaccacacacatgagtgggagtactacttctactacgtggggccagggaaccctggtctccgtctcctcggcctcacaggccatcggtctcccngcgcctgctcaggncacctcganagcacagcgcctggctgcctggtcaaggactactccacgtctactgctgacgtcgggctggacaaggcgacagtagnnnnnnnnnnnnnnnnnnnnnnnn

SEQ ID NO: 231734 - DNA, 426 bp, Homo sapiens
  misc_feature: GYAE6OF01ESU3D.31.68.G02.1.454.CMB.1.raw
  modified_base (338)..(338): a, c, t, g, unknown or other
  misc_feature (338)..(338): n is a, c, g, or t
  modified_base (422)..(426): a, c, t, g, unknown or other
  misc_feature (422)..(426): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctccaaaccgaggacacagccgtctatttctgtaccacacacatgagtgggagtactacttctactactggggccagggaaccctggtctccgtctcctcggcctccaccaagggccccatcggtctccccctggccgccctgctccaggacncacctccgagagcacagcggccctgggctgcctggtcaaggctactccacgtctactgctgagcgggctggcaaggcgcatagnnnnn

SEQ ID NO: 231735 - DNA, 438 bp, Homo sapiens
  misc_feature: GYAE6OF01D7707.31.68.G02.1.454.CMB.1.raw
  modified_base (428)..(438): a, c, t, g, unknown or other
  misc_feature (428)..(438): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctccaaaccgaggacacagccgtctatttctgtaccacacacatgagtgggaggtactacttctactactggggccagggaaccctggtctccgtctcctcggcctccaccaagggcccatccggtcttccccctggccgccctgcctccaggagccaccctccgagacgcacagcggccctgggctgcctggtcaaggactactccacgtctactgctgagcgggctggcaaggcgcatagnnnnnnnnnnn

SEQ ID NO: 231736 - DNA, 453 bp, Homo sapiens
  misc_feature: GYAE6OF01CIO27.31.68.G02.1.454.CMB.1.raw
  modified_base (447)..(453): a, c, t, g, unknown or other
  misc_feature (447)..(453): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctccaaaccgaggacacagccgtctatttctgtaccacacacatgagtgggagtactacttctactactggggccagggaaccctggtctccgtctcctcggcctccaccaagggccccatccggtccttccccctggccgccctgcctccgaggacgccaccctccgagacgccacacggccggccccgtggggcctggccctggtacaaggtactactttcccacgttctactgctggagcgggctggcaaggcgcatgnnnnnnn

SEQ ID NO: 231737 - DNA, 429 bp, Homo sapiens
  misc_feature: GYAE6OF01AWZQR.31.68.G02.1.454.CMB.1.raw
  modified_base (423)..(429): a, c, t, g, unknown or other
  misc_feature (423)..(429): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagccctccaaaccgaggacacagccgtctatttctgtaccacacacatgagtgggagtactacttctactactggggccagggaaccctggtctccgtctcctcggcctccaccaagggccccatcggtcttccccctggcgccctgctccaggacgcacctccgagagcacagcggccctgggcctgcctggtcaaggctactcacgtctactgctgagcggctggcaaggcgcagtagnnnnnnn

SEQ ID NO: 231738 - DNA, 475 bp, Homo sapiens
  misc_feature: GYAE6OF01DPM75.31.68.G02.1.454.CMB.1.raw
  modified_base (464)..(475): a, c, t, g, unknown or other
  misc_feature (464)..(475): n is a, c, g, or t
tcagcagtagacgtcacgaccggtgctcgatttagtcgatagtgaagggaaggggctggagtgggttgcccgtattaaaagtaaaactgatggtgagacaacagactacgctgcacccgtgaaaggcagattcgccatctcaagagatgattcagagaacacgctgtatctacaaatgaacagcctaccaaaccgaggacacagccgtctatttctgtaccacacacatgagtgggagtactacttctactagtcggggccacgggaaccctggtcctccgtctccgtcggcctccgaccacgggcccagttccggtcctttcccccgcggccgtcccctgcctccgaggacgccaccctccgagacgccacgacggccggcccgtgggctcgcctggacaaggaccttactcccgacgtctaccgtgcctggacggcgggcgtggacaacgggcacaagtcgnnnnnnnnnnnn

SEQ ID NO: 231739 - DNA, 436 bp, Homo sapiens
  misc_feature: GYAE6OF01CBD6D.31.68.G02.1.454.CMB.1.raw
  modified_base (196)..(196): a, c, t, g, unknown or other
  misc_feature (196)..(196): n is a, c, g, or t
  modified_base (423)..(436): a, c, t, g, unknown or other
  misc_feature (423)..(436): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctccaaaccgnggacacagccgtctatttctgtaccacacacatgagtgggagtactacttctactactgggggccagggaaccctggtctccgtctcctcggcctccaccaagggccccatcggtcttccccctggccgccctgctccaggacgcaccctcgagagcacagcggccgtgggctgcctggtcaaggactacttccagtctatgctgagcggctggcaaggcgcatagnnnnnnnnnnnnnn

SEQ ID NO: 231740 - DNA, 449 bp, Homo sapiens
  misc_feature: GYAE6OF01CWTDN.31.68.G02.1.454.CMB.1.raw
  modified_base (425)..(428): a, c, t, g, unknown or other
  misc_feature (425)..(428): n is a, c, g, or t
  modified_base (430)..(449): a, c, t, g, unknown or other
  misc_feature (430)..(449): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctccaaaaccgaggacacagccgtctatttctgtaccacacacatgagtgggaggtactacttctactactggggccagggaaccctggtctccgtctcctcggcctccaccaagggcccatcggtcttccccctggcgccctgctccaggagcacctccgagagcacagcggccctgggctgcctggtcaaggactacttccacgtctactgctgagcgggctgggcaaggcgcatagnnnngnnnnnnnnnnnnnnnnnnnn

SEQ ID NO: 231741 - DNA, 460 bp, Homo sapiens
  misc_feature: GYAE6OF01C5BQW.31.68.G02.1.454.CMB.1.raw
  modified_base (454)..(460): a, c, t, g, unknown or other
  misc_feature (454)..(460): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaaacacgctgtatctaacaaaatgaacagcctaccaaaccgaggacacagccgtctattctgtaaccacacacatgagtgggagtactacttctactactggggccagggaccctggtcctccgtctcctcggcctccaaccaaggcccatccggtccttcccccctgggcccgtccctcgcctcccagggacgccaaccctccgagaacgcacacgccggcccgtgggctcgccctggtacaaaggacctacttccacgtcctatcgctggagcgggctggacaaggcgcaatgnnnnnnn

SEQ ID NO: 231742 - DNA, 433 bp, Homo sapiens
  misc_feature: GYAE6OF01BPHPM.31.68.G02.1.454.CMB.1.raw
  modified_base (318)..(318): a, c, t, g, unknown or other
  misc_feature (318)..(318): n is a, c, g, or t
  modified_base (337)..(337): a, c, t, g, unknown or other
  misc_feature (337)..(337): n is a, c, g, or t
  modified_base (422)..(422): a, c, t, g, unknown or other
  misc_feature (422)..(422): n is a, c, g, or t
  modified_base (427)..(433): a, c, t, g, unknown or other
  misc_feature (427)..(433): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctccaaaccgaggacacagccgtctatttctgtaccacacacatgagtgggagtactacttctactactggggccagggaaccctggtctccgtctcctcggcctccaccaagggcccatcggtccttccccnggcgccctgcctccaggancacctccgagacgcacacgccggccctggggctcgcctggtcaaggacctacttccactctactgctgagcgggctggcaaggcncatgnnnnnnn

SEQ ID NO: 231743 - DNA, 459 bp, Homo sapiens
  misc_feature: GYAE6OF01BR6W1.31.68.G02.1.454.CMB.1.raw
  modified_base (216)..(216): a, c, t, g, unknown or other
  misc_feature (216)..(216): n is a, c, g, or t
  modified_base (450)..(459): a, c, t, g, unknown or other
  misc_feature (450)..(459): n is a, c, g, or t
tcagcagtagacgtcacgaccggtgctcgatttagtcgatagtgaagggaaagggctggagtgggttgcccgtattaaaagtaaaactgatggtgagacaacagactacgctgcacccgtgaaaggcagattcgccatctcaagagatgattcagagaacacgctgtatctacaaatgaacagcctaccaaaccgaggacacagccgtctatttcngtaccacacacatgagtgggagtactacttctactacgtggggccagggaaccctggtctccgtctcctcggcctccaccacgggcccatccggtccttccccctggccgcccctgcctccaggacgccaccgtccgagacgcacacggccgcccgtgggctcgccgtggtacaacggtactaccttccgacgtctacgtgacctggacgcgggtctgggacaaggcacatagnnnnnnnnnn

SEQ ID NO: 231744 - DNA, 428 bp, Homo sapiens
  misc_feature: GYAE6OF01BFNL4.31.68.G02.1.454.CMB.1.raw
  modified_base (320)..(320): a, c, t, g, unknown or other
  misc_feature (320)..(320): n is a, c, g, or t
  modified_base (421)..(428): a, c, t, g, unknown or other
  misc_feature (421)..(428): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctccaaaccgaggacacagccgtctatttctgtaccacacacatgagtgggaggtactacttctactactggggccagggaaccctggtctccgtctcctcggcctccaccaaggccatcggtctcccctggccnccctgctccaggacgcacctccgagagcacagccggccctgggctgcctggtcaaggctactccacgtctactgctgagcgggctggcaaggcgcactagnnnnnnnn

SEQ ID NO: 231745 - DNA, 430 bp, Homo sapiens
  misc_feature: GYAE6OF01APSU8.31.68.G02.1.454.CMB.1.raw
  modified_base (338)..(338): a, c, t, g, unknown or other
  misc_feature (338)..(338): n is a, c, g, or t
  modified_base (425)..(430): a, c, t, g, unknown or other
  misc_feature (425)..(430): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctccaaaccgaggacacagccgtctatttctgtaccacacacatgagtgggaggtactacttctactactggggccagggaaccctggtctccgtctcctcggcctccaccaagggcccatcggtcttccccctggccgccctgctccaggancacctccgagagcacagcggccctgggctgcctggtcaaggactacttccacgtctactgctgacgcgggctggcaaggcgcatagnnnnnn

SEQ ID NO: 231746 - DNA, 493 bp, Homo sapiens
  misc_feature: GYAE6OF01EP4WQ.31.68.G02.1.454.CMB.1.raw
  modified_base (326)..(326): a, c, t, g, unknown or other
  misc_feature (326)..(326): n is a, c, g, or t
  modified_base (347)..(347): a, c, t, g, unknown or other
  misc_feature (347)..(347): n is a, c, g, or t
  modified_base (361)..(361): a, c, t, g, unknown or other
  misc_feature (361)..(361): n is a, c, g, or t
  modified_base (474)..(493): a, c, t, g, unknown or other
  misc_feature (474)..(493): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagccctaccaaaccgaggacacagccgtctatttctgtaccacacacatgagtgggagtactacttctactacgtggggccagggaaccctggtctccgtctcctcggcctccaccgaacggcccattccggtccttcccccgnggccgccctgcctccaggacnccacctccgagacncacaggccggcccgtgggcctgcccgtggtaccaaggtaccttaccgttcccaacgttcctacgtgccttaggacggtcggggcgttcgggacaacggggccactacgtaggnnnnnnnnnnnnnnnnnnnn

SEQ ID NO: 231747 - DNA, 483 bp, Homo sapiens
  misc_feature: GYAE6OF01AX1CW.31.68.G02.1.454.CMB.1.raw
  modified_base (453)..(454): a, c, t, g, unknown or other
  misc_feature (453)..(454): n is a, c, g, or t
  modified_base (456)..(483): a, c, t, g, unknown or other
  misc_feature (456)..(483): n is a, c, g, or t
tcagcagtagacgtcacgaccggtgctcgatttagtcgatagtgaagggaaagggggctggagtgggttgcccggtattaaaagtaaaactgatggtgagacaacagactacgctgcacccgtgaaaggccagattcgccatctcaaggagatgattcagagaacacggctgtatctaacaaaatgaacagccttaccaaaccggaggacacagccgtactatttcagtacccaacacacatgagtgggagtactacttctactactggggccagggaccctggtctccgtctcctcggcctcacaaggcccatcggtcttcccctggcgccctgctccaggagcacctccgagacgcacacgccggtcctggggcctcgcctgggtaccaaaggtactacgttcccaacgttctactgcttggacggcgggctgggcaaggcgacaagtagnngnnnnnnnnnnnnnnnnnnnnnnnnnnnn

SEQ ID NO: 231748 - DNA, 511 bp, Homo sapiens
  misc_feature: GYAE6OF01DR700.31.68.G02.1.454.CMB.1.raw
  modified_base (494)..(511): a, c, t, g, unknown or other
  misc_feature (494)..(511): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctaccaaaccgaggacacagccgtctattctgtaccacacacatgagtgggagtactacttctactacgtggggccagggaaccctggtcctccgtctcctcggcctccaccaagggcccagtccggtccttcccccgtggccgcccctgcctccaggacgccaccctccgagacgccacgacgccggccccgtggggcctcggcccttgggtaccaaagggtacccttaccttacccgaaccgttccttaacctggccgttggacgggtccggggcctgggaccgaaagggccgaccgaagtaacggnnnnnnnnnnnnnnnnnn

SEQ ID NO: 231749 - DNA, 425 bp, Homo sapiens
  misc_feature: GYAE6OF01CDYY1.31.68.G02.1.454.CMB.1.raw
  modified_base (331)..(331): a, c, t, g, unknown or other
  misc_feature (331)..(331): n is a, c, g, or t
  modified_base (341)..(341): a, c, t, g, unknown or other
  misc_feature (341)..(341): n is a, c, g, or t
  modified_base (417)..(425): a, c, t, g, unknown or other
  misc_feature (417)..(425): n is a, c, g, or t
tcagcagtagacgtcacgaccggtgctcgatttagtcgatagtgaagggaaagggctggagtgggttgcccgtattaaaagtaaaactgatggtgagacaacagactacgctgcacccgtgaaaggcagattcgccatctcaagagatgattcagagaacacgctgtatctacaaatgaacagcctaccaaaccgaggacacagccgtctatttctgtaccacacacatgagtgggagtactacttctactactggggccagggaaccctggtctccgtctcctcggcctccacacggcccatccggtctcccctgcgccctgctcaggcncacctcgagngcacagccggcctgggctgcctggtcaaggactaccttcacgtcactgctgagcgggctggcgaaggcgacatagnnnnnnnnn

SEQ ID NO: 231750 - DNA, 417 bp, Homo sapiens
  misc_feature: GYAE6OF01EE7DA.31.68.G02.1.454.CMB.1.raw
  modified_base (313)..(313): a, c, t, g, unknown or other
  misc_feature (313)..(313): n is a, c, g, or t
  modified_base (319)..(319): a, c, t, g, unknown or other
  misc_feature (319)..(319): n is a, c, g, or t
  modified_base (324)..(324): a, c, t, g, unknown or other
  misc_feature (324)..(324): n is a, c, g, or t
  modified_base (326)..(326): a, c, t, g, unknown or other
  misc_feature (326)..(326): n is a, c, g, or t
  modified_base (403)..(403): a, c, t, g, unknown or other
  misc_feature (403)..(403): n is a, c, g, or t
  modified_base (410)..(417): a, c, t, g, unknown or other
  misc_feature (410)..(417): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctccaaaccgaggacacagccgtctatttctgtaccacacacatgagtgggagtactacttctactactggggccagggaaccctggtctccgtctcctcggcctccaccaggcccatcgtctccccngcgccngctcngncactcgagagcacagcggcctgggctgcctggacaaggacctacttccacgtctactgctgagcggctggcaaggcncgatagnnnnnnnn

SEQ ID NO: 231751 - DNA, 485 bp, Homo sapiens
  misc_feature: GYAE6OF01BN5X4.31.68.G02.1.454.CMB.1.raw
  modified_base (465)..(485): a, c, t, g, unknown or other
  misc_feature (465)..(485): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctccaaaccgaggacacagccgtctatttctgtaccacacacatgagtgggaggtactacttctactactggggccagggaaccctggtctccgtctcctcggcctccaccaacgggccccatccggtcctttccccctggcccgcccctcgcctccgaggacgccaccctccgacgacgcacacgccggcccgtcgggcctgccgtggtaccaacggaccttaccgtccaacgtctactcgcgtcgacggcgggctcgggacaacgggcgacactaggnnnnnnnnnnnnnnnnnnnnn

SEQ ID NO: 231752 - DNA, 449 bp, Homo sapiens
  misc_feature: GYAE6OF01CMV7Z.31.68.G02.1.454.CMB.1.raw
  modified_base (217)..(217): a, c, t, g, unknown or other
  misc_feature (217)..(217): n is a, c, g, or t
  modified_base (319)..(319): a, c, t, g, unknown or other
  misc_feature (319)..(319): n is a, c, g, or t
  modified_base (338)..(338): a, c, t, g, unknown or other
  misc_feature (338)..(338): n is a, c, g, or t
  modified_base (430)..(430): a, c, t, g, unknown or other
  misc_feature (430)..(430): n is a, c, g, or t
  modified_base (435)..(449): a, c, t, g, unknown or other
  misc_feature (435)..(449): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagccctccaaaccgaggacacagccgtctatttcngtaccacacacatgagtgggagtactacttctactactggggccagggaaccctggtcctccgtctcctcggcctccaccaaggcccatcggtcctcccccnggccgccctgctccaggcncaccctcgagacgcacagccggccctgggctgcctggtcaacggtacctaccttccacgtcctactgctggacggcgggctggcaagggccnaatgnnnnnnnnnnnnnnn

SEQ ID NO: 231753 - DNA, 450 bp, Homo sapiens
  misc_feature: GYAE6OF01BRMMM.31.68.G02.1.454.CMB.1.raw
  modified_base (342)..(342): a, c, t, g, unknown or other
  misc_feature (342)..(342): n is a, c, g, or t
  modified_base (430)..(450): a, c, t, g, unknown or other
  misc_feature (430)..(450): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctccaaaccgaggacacagccgtctatttctgtaccacacacatgagtgggaggtactacttctactactggggccagggaaccctggtctccgtctcctcggcctccaccaagggcccatccggtcttccccctggccgccctgcctccgaggacnccaccctccgagacgcacacgccggccctgggctcgcctggcaaggctactccacgtctactgctgagcggctggcaaggcacatagnnnnnnnnnnnnnnnnnnnnn

SEQ ID NO: 231754 - DNA, 518 bp, Homo sapiens
  misc_feature: GYAE6OF01ANBTZ.31.68.G02.1.454.CMB.1.raw
  modified_base (210)..(210): a, c, t, g, unknown or other
  misc_feature (210)..(210): n is a, c, g, or t
  modified_base (217)..(217): a, c, t, g, unknown or other
  misc_feature (217)..(217): n is a, c, g, or t
  modified_base (496)..(518): a, c, t, g, unknown or other
  misc_feature (496)..(518): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagccctccaaaccgaggacacagccgtntatttcngtaccacacacatgagtgggagtactacttctactactggggccaggaaccctggtctccgtctcctcggcctccaccaacgggccccatccggtcctttccccccgtggccgcccctgcctcccgaggacgccaccctccggagacgccacgacggcccggccccgtggggctcggcccttgggtaccaagggtacccttaacctttcccgaacgttcctaacctcggaccgttcggacgggccggggctgggaccgaaacgggcgaccgtataaggnnnnnnnnnnnnnnnnnnnnnnn

SEQ ID NO: 231755 - DNA, 532 bp, Homo sapiens
  misc_feature: GYAE6OF01BFD25.31.68.G02.1.454.CMB.1.raw
  modified_base (212)..(212): a, c, t, g, unknown or other
  misc_feature (212)..(212): n is a, c, g, or t
  modified_base (220)..(220): a, c, t, g, unknown or other
  misc_feature (220)..(220): n is a, c, g, or t
  modified_base (510)..(532): a, c, t, g, unknown or other
  misc_feature (510)..(532): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctaacaaatgaacacgcctaccaaaccgaggacacagccgtnttatttcngtaccacacacatgagtgggagtactacttctactacgtcggggaccgacggtaacccgtggtcctcccgtcctcccgtccggtccctaccgaaccgaacgggccccaacgttcccggtcctttccccccgtggcccgtccctcgcctcccggaggacgccaccctccgagacgcaccgacgcccggccgtcgggctcggccgtacggacgaacggtaccttacttcccgtaacgttcctacgtgccgtggacggtcgggtacgtcgggaacgacggccggataagacgnnnnnnnnnnnnnnnnnnnnnnn

SEQ ID NO: 231756 - DNA, 453 bp, Homo sapiens
  misc_feature: GYAE6OF01CTZAW.31.68.G02.1.454.CMB.1.raw
  modified_base (440)..(453): a, c, t, g, unknown or other
  misc_feature (440)..(453): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctccaaaccgaggacacagccgtctatttctgtaccacacacatgagtgggagtactacttctactactggggccagggaaccctggtctccgtctcctcggcctccaccagggcccatcggtccttccccctggccgccctgcctccaggacgccaccctccgagacgcacacgccggccctggggctcggcctggtcaacggacctacttccacgtctactgctgagcgggctcggacaaggcgactagtagnnnnnnnnnnnnnn

SEQ ID NO: 231757 - DNA, 432 bp, Homo sapiens
  misc_feature: GYAE6OF01B2JH4.31.68.G02.1.454.CMB.1.raw
  modified_base (426)..(432): a, c, t, g, unknown or other
  misc_feature (426)..(432): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctctaagagatgattcagagaacacgctgtatctacaaatgaacagcctccaaaccgaggacacagccgtctatttctgtaccacacacatgagtgggaggtactacttctactactggggccagggaaccctggtctccgtctcctcggcctccaccaagggccccatcggtcttccccctggccgccctgctccaggacgcaccctccgagagcacagcggccctgggctgcctggtcaggactacttccacgtctactgctgagcgggctggcaggcgcatagnnnnnnn

SEQ ID NO: 231758 - DNA, 477 bp, Homo sapiens
  misc_feature: GYAE6OF01CODKE.31.68.G02.1.454.CMB.1.raw
  modified_base (324)..(324): a, c, t, g, unknown or other
  misc_feature (324)..(324): n is a, c, g, or t
  modified_base (357)..(357): a, c, t, g, unknown or other
  misc_feature (357)..(357): n is a, c, g, or t
  modified_base (450)..(450): a, c, t, g, unknown or other
  misc_feature (450)..(450): n is a, c, g, or t
  modified_base (456)..(456): a, c, t, g, unknown or other
  misc_feature (456)..(456): n is a, c, g, or t
  modified_base (460)..(477): a, c, t, g, unknown or other
  misc_feature (460)..(477): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaaatgaacagcctaccaaaccgaggacacagccgtctatttctgtaccacacacatgagtgggaggtactacttcactacgtggggccagggaaccctggtcctccgtctcctcggcctccaccaagggccccatccgtccttcccccnggccgccctgctccaggacgccacctccgagcnccacacgccggcccctggggctcgccgtggtacaacggactaccttccaacgccttactgacgtggacgccggggtctgggcgaagggccganagtagnatcnnnnnnnnnnnnnnnnnn

SEQ ID NO: 231759 - DNA, 550 bp, Homo sapiens
  misc_feature: GYAE6OF01BIQAH.31.68.G02.1.454.CMB.1.raw
  modified_base (222)..(222): a, c, t, g, unknown or other
  misc_feature (222)..(222): n is a, c, g, or t
  modified_base (228)..(228): a, c, t, g, unknown or other
  misc_feature (228)..(228): n is a, c, g, or t
  modified_base (513)..(513): a, c, t, g, unknown or other
  misc_feature (513)..(513): n is a, c, g, or t
  modified_base (515)..(550): a, c, t, g, unknown or other
  misc_feature (515)..(550): n is a, c, g, or t
tcagcagtagacgtcacgaccggtgctcgatttagtcgatagtgaagggaaaggggctggagtgggttgcccgtattaaaaagtaaaactgatggtgagacaacagactacgctgcacccgtgaaaggcagattcgccatctcaagagatgattcagagaacacgctgtaatctaacaaaatgaaactacgccctaccaaaaccggaggacacgagtccgtntattcngtaccacacacatgaggtggacgtactacttctactacggtcggggaccgaacggtaacccttcggtcctccgtctccgtccggacctccgaaccgaacgggcccctaagtcccggttcctcccccgaggtcccgccccttgaccgtaccgagggacggaccaccgtaccgagacggacaacgcgccggcccgtgggctcgccgtaggtaccgaacggtcctaccgttccacgttactacgtgacctggaacggtccggacgtaggaccgaaggtccgagtaacngnnnnnnnnnnnnnnnnnnnnnnnnnnnnnnnnnnnn

SEQ ID NO: 231760 - DNA, 686 bp, Homo sapiens
  misc_feature: GYAE6OF01AQAX5.31.68.G02.1.454.CMB.1.raw
  modified_base (183)..(183): a, c, t, g, unknown or other
  misc_feature (183)..(183): n is a, c, g, or t
  modified_base (195)..(195): a, c, t, g, unknown or other
  misc_feature (195)..(195): n is a, c, g, or t
  modified_base (208)..(208): a, c, t, g, unknown or other
  misc_feature (208)..(208): n is a, c, g, or t
  modified_base (216)..(216): a, c, t, g, unknown or other
  misc_feature (216)..(216): n is a, c, g, or t
  modified_base (223)..(223): a, c, t, g, unknown or other
  misc_feature (223)..(223): n is a, c, g, or t
tcagcagtagacgtcacgaccggtgctcgatttagtcgatagtgaagggaaagggctggagtgggttgcccgtattaaaagtaaaactgatggtgagacaacagactacgctgcacccgtgaaaggcagattcgccatctcaagagatgattcaagagaacacgctgtatctacaaatgaacngcctccaaacgnggacacagccgtntatttccngtaccanacacatgagtgggagtactacttctacgtacgtggggaccagggaaccctggtacctccgtactccgtccggcctacctaccgaacgggccccaagttcccggtcctttcccccgtggcccgccccgttcgccttacccggaggtaaccgcccgtaaccctccggagacgcctaccgacggtccggcccgtgggacctcggaccgttcggaccaacgggtaccttaccgtttccgaaccgttcgtaaccgtcggaccttagggaccggtccgggtacgttacgggaccgtaaacgggtccgtacgtaagttacgcgttacgcgtactaggtcaacgttcgacgtacgtccgtaagtcccggtagtacccgtgtccgttacgaccgtagttccggacgttaccggaattccgagtgttaaacgcgtaccgtagccggtataacccgataacgtgttaacggtcg

SEQ ID NO: 231761 - DNA, 561 bp, Homo sapiens
  misc_feature: GYAE6OF01B3ECE.31.68.G02.1.454.CMB.1.raw
  modified_base (512)..(512): a, c, t, g, unknown or other
  misc_feature (512)..(512): n is a, c, g, or t
  modified_base (517)..(517): a, c, t, g, unknown or other
  misc_feature (517)..(517): n is a, c, g, or t
  modified_base (524)..(524): a, c, t, g, unknown or other
  misc_feature (524)..(524): n is a, c, g, or t
  modified_base (526)..(530): a, c, t, g, unknown or other
  misc_feature (526)..(530): n is a, c, g, or t
  modified_base (532)..(532): a, c, t, g, unknown or other
  misc_feature (532)..(532): n is a, c, g, or t
  modified_base (534)..(544): a, c, t, g, unknown or other
  misc_feature (534)..(544): n is a, c, g, or t
  modified_base (546)..(557): a, c, t, g, unknown or other
  misc_feature (546)..(557): n is a, c, g, or t
  modified_base (559)..(559): a, c, t, g, unknown or other
  misc_feature (559)..(559): n is a, c, g, or t
  modified_base (561)..(561): a, c, t, g, unknown or other
  misc_feature (561)..(561): n is a, c, g, or t
tcagcagtagacgtcacgaccggtgctcgatttagtcgatagtgaagggaaaggggctggagtgggttgcccgtattaaaagtaaaactgatggtagagacaacagactacgctgcacccgtgaaaggcagattcgccatctcaagagatgattcagagaacacgctgtatctacaaatgaacagcctccaaaccgaggacacgagccgtctatttctgtaccacgacacatgaggtgggaggtactacttctactactggggccagggaaccctggtcctccgtctcctcggcctccgaccaacggccccagtccggtcctttcccccgtggccgcccctgcctccgaggacgcacccgtccgacgacgccacgacggccggccccgtggggcctcggcccttgggtaccgaaacggtcccttaacccgtttcccaaccggttccttaacctcggaccgttacggaccggtcccgggcttacgggacctaaacgggccgacctaagtaagntcgancgagcgngnnnnncngnnnnnnnnnnngnnnnnnnnnnnngngn

SEQ ID NO: 231762 - DNA, 543 bp, Homo sapiens
  misc_feature: GYAE6OF01DX6LV.31.68.G02.1.454.CMB.1.raw
  modified_base (348)..(348): a, c, t, g, unknown or other
  misc_feature (348)..(348): n is a, c, g, or t
  modified_base (504)..(504): a, c, t, g, unknown or other
  misc_feature (504)..(504): n is a, c, g, or t
  modified_base (509)..(509): a, c, t, g, unknown or other
  misc_feature (509)..(509): n is a, c, g, or t
  modified_base (511)..(543): a, c, t, g, unknown or other
  misc_feature (511)..(543): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctccaaaccgaggacacagccgtctatttctgtaccacacacatgaggtgggagtactacttctactacgtggggccaggaccctggtcctccgtctccgtcgcctccaccaacgggccccagtccggtccttcccccgtggcccgccctgcctccgaggacncaccctcgagacgcacgacgccggcccgtgggcctcggtccgtggtaccaacggtaccttacctttcccgacgttccttaaccgtcggcgttacgggacgggtccggggccgttacggggaacccgtaaccggggccgaacgtaacgtaaggcgtncgacnannnnnnnnnnnnnnnnnnnnnnnnnnnnnnnnn

SEQ ID NO: 231763 - DNA, 481 bp, Homo sapiens
  misc_feature: GYAE6OF01EXNQQ.31.68.G02.1.454.CMB.1.raw
  modified_base (339)..(339): a, c, t, g, unknown or other
  misc_feature (339)..(339): n is a, c, g, or t
  modified_base (344)..(344): a, c, t, g, unknown or other
  misc_feature (344)..(344): n is a, c, g, or t
  modified_base (465)..(481): a, c, t, g, unknown or other
  misc_feature (465)..(481): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagccctaccaaaccgaggacacagccgtctatttctgtaccacacacatgagtgggagtactacttctactacgtggggccaggaccctggtctccgtctcctcggcctccaccgaacggcccatccggtcctcccccgtggccgccctgcctccgnggacnccaccctccgagagccacgcgccggcccgtgggctcgccgtggtaccaaggaccttacctcccacgttcctacgtcgcgtacgaggaccgggtcgtcgggaccgaaagggccgacagtagnnnnnnnnnnnnnnnnn

SEQ ID NO: 231764 - DNA, 552 bp, Homo sapiens
  misc_feature: GYAE6OF01C5VVO.31.68.G02.1.454.CMB.1.raw
  modified_base (213)..(213): a, c, t, g, unknown or other
  misc_feature (213)..(213): n is a, c, g, or t
  modified_base (220)..(220): a, c, t, g, unknown or other
  misc_feature (220)..(220): n is a, c, g, or t
  modified_base (231)..(231): a, c, t, g, unknown or other
  misc_feature (231)..(231): n is a, c, g, or t
  modified_base (520)..(525): a, c, t, g, unknown or other
  misc_feature (520)..(525): n is a, c, g, or t
  modified_base (527)..(552): a, c, t, g, unknown or other
  misc_feature (527)..(552): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctaacaaatgaacagccctaccaaaaccgaggacacagccgtntatttcngtaccacacanatgagtgggagtactacttctactacgtggggccacgggaccctggtcctccgtctcccgtcggcctccgaccgaacggcccctagtccggttcccttcccccgtggccctcccctggccctaccgaggacgccacccgtccgagacgccaacgcggcccggcccgtggggcctcggcccgtagggtaccaaacgggtacccttaaccgttccccgaacggttcctaacgtcgccgttaggacgggtccggggtcctagggacccgaaaggggccgcgtaaggtacgcnnnnnngnnnnnnnnnnnnnnnnnnnnnnnnnn

SEQ ID NO: 231765 - DNA, 426 bp, Homo sapiens
  misc_feature: GYAE6OF01E41FD.31.68.G02.1.454.CMB.1.raw
  modified_base (336)..(336): a, c, t, g, unknown or other
  misc_feature (336)..(336): n is a, c, g, or t
  modified_base (401)..(401): a, c, t, g, unknown or other
  misc_feature (401)..(401): n is a, c, g, or t
  modified_base (417)..(417): a, c, t, g, unknown or other
  misc_feature (417)..(417): n is a, c, g, or t
  modified_base (423)..(426): a, c, t, g, unknown or other
  misc_feature (423)..(426): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctccaaaccgaggacacagccgtctatttctgtaccacacacatgagtgggagtactacttctactactggggccagggaaccctggtctccgtctcctcggcctccaccaggcccatcggtcttccccctgccgccctgcctccaggacncacctccgagacgcacagccggccctgggctgcctggtcaaggactacttccacgtcactgctgngcgggctggcgaggcncatagnnnn

SEQ ID NO: 231766 - DNA, 710 bp, Homo sapiens
  misc_feature: GYAE6OF01DK6JU.31.68.G02.1.454.CMB.1.raw
  modified_base (455)..(455): a, c, t, g, unknown or other
  misc_feature (455)..(455): n is a, c, g, or t
  modified_base (673)..(673): a, c, t, g, unknown or other
  misc_feature (673)..(673): n is a, c, g, or t
  modified_base (677)..(710): a, c, t, g, unknown or other
  misc_feature (677)..(710): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatactaacaaatcgaaacacgccctaccgaaaaccgaggaaccacagtcccgttcttagttttcctacgtaacccacaaccgactagtggtacggttagggggaacggttaaccttaccttttaccgtaaccgttaccggggtcggggggacccgtaaaccgggggtaaccccttcgggttccccgttcccgttcccgttacccggtcccggtacccctaccccgaaaccccggtaaaccgggtccccctaacggtttccccgggtttcccccttttcccccccggngggggcccctccccgtcggccccgttacccggaagggtaccaccccgtacccgtaccggaacggacgacccaacggaccgggcccgggtccccgtggggtcctccggtacccgggttacggtaaccgaaacggttacccttaacccttcccgtaccggttacctcgtcgtcgtagggtaccggcgggtctaggggaacgaacgggtcaacgtagtagnagcnnnnnnnnnnnnnnnnnnnnnnnnnnnnnnnnnn

SEQ ID NO: 231767 - DNA, 572 bp, Homo sapiens
  misc_feature: GYAE6OF01ERBJ5.31.68.G02.1.454.CMB.1.raw
  modified_base (201)..(201): a, c, t, g, unknown or other
  misc_feature (201)..(201): n is a, c, g, or t
  modified_base (404)..(404): a, c, t, g, unknown or other
  misc_feature (404)..(404): n is a, c, g, or t
  modified_base (491)..(491): a, c, t, g, unknown or other
  misc_feature (491)..(491): n is a, c, g, or t
  modified_base (534)..(534): a, c, t, g, unknown or other
  misc_feature (534)..(534): n is a, c, g, or t
  modified_base (539)..(539): a, c, t, g, unknown or other
  misc_feature (539)..(539): n is a, c, g, or t
  modified_base (541)..(572): a, c, t, g, unknown or other
  misc_feature (541)..(572): n is a, c, g, or t
tcagcagtagacgtcacgaccggtgctcgatttagtcgatagtgaagggaaaggggctggagtgggttgcccgtattaaaaagtaaaactgatggtgagacaacagactacgctgcacccgtgaaaggcagattcgccatctcaagagatgattcagagaacacgctgtatctaacaaatgaacagccctaccaaaaccgnggacacagtccgtcttatttctgtaccaacacacatgaggtggtaacggtacttacttctaacgtacgtggggaccgtacgggaacccttcggtccttcccgtccttcccgtccggtcccttacccgacccgaaccggggcccctaccgttccggttccccgttccccccgtaccggcccgccccgtcgccctccgacggacncctacccgtcgacgacgccaacgacggtcccggcccgtgggcgtacgccgtggacaacggtactaccttccgacgttcctacttcgngtcggacggccgggtcgtacggcgaacgggtccgactagtagntagcngnnnnnnnnnnnnnnnnnnnnnnnnnnnnnnnn

SEQ ID NO: 231768 - DNA, 636 bp, Homo sapiens
  misc_feature: GYAE6OF01CR0L5.31.68.G02.1.454.CMB.1.raw
  modified_base (192)..(192): a, c, t, g, unknown or other
  misc_feature (192)..(192): n is a, c, g, or t
  modified_base (602)..(602): a, c, t, g, unknown or other
  misc_feature (602)..(602): n is a, c, g, or t
  modified_base (608)..(610): a, c, t, g, unknown or other
  misc_feature (608)..(610): n is a, c, g, or t
  modified_base (612)..(628): a, c, t, g, unknown or other
  misc_feature (612)..(628): n is a, c, g, or t
  modified_base (630)..(636): a, c, t, g, unknown or other
  misc_feature (630)..(636): n is a, c, g, or t
tcagcagtagacgtcacgaccggtgctcgatttagtcgatagtgaagggaaggggctggagtgggttgcccgtattaaaagtaaactgatggtgagacaacagactacgctgcacccgtgaaaggcagattcgccatctacaagagatgtattcgagacgaacacgctagtactactaacaaagtcgaaacncgacccaccgaaaaacggcggaactaccgagtccccgttattaagtttccgtacgaacccaacaacactagtacggaagggttgggaacgttaccttacttacgtaaccttacgggacggggaccgtaaccggggtaaccctcggtaccttccggtaccgtccgtcccgggtaccctaccggaaccgaccggggtccccaaggtttcccggttcccctttcccccggtgccccgttccccgatcccgttacggacggacgtccgacccgtcggagtacgaccaacgcggtccgccggtacggccttcggaccgtacggtacaacgtaccgttaccctaccgacttcgtacctgtacgtggacggtacgcgtaggaccgaggtccgaagtactagctgactgacatgctgnaaacgnnncnnnnnnnnnnnnnnnnncnnnnnnn

SEQ ID NO: 231769 - DNA, 535 bp, Homo sapiens
  misc_feature: GYAE6OF01D64RF.31.68.G02.1.454.CMB.1.raw
  modified_base (356)..(356): a, c, t, g, unknown or other
  misc_feature (356)..(356): n is a, c, g, or t
  modified_base (389)..(389): a, c, t, g, unknown or other
  misc_feature (389)..(389): n is a, c, g, or t
  modified_base (440)..(440): a, c, t, g, unknown or other
  misc_feature (440)..(440): n is a, c, g, or t
  modified_base (493)..(493): a, c, t, g, unknown or other
  misc_feature (493)..(493): n is a, c, g, or t
  modified_base (495)..(495): a, c, t, g, unknown or other
  misc_feature (495)..(495): n is a, c, g, or t
  modified_base (505)..(535): a, c, t, g, unknown or other
  misc_feature (505)..(535): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatcgtcaagagatgattcagagaacacgctgtatctaacaaatgaacagccctaccaaaacgagacacagcccgtatatttctgtaccacacacatgagtgggagtactacttctactagtcggggccacgggtaccctggtcctaccgtctccgtcggcctccaaccaacgggccccaagtccggtcccttccccgcggccgccctgcctccgaggcnccaccgtacgagacgcaaccgtacgccggccgngggtcctcgtccgtaggtaccgaagtactaccttccgtacggtcttaccgngtccgtggacggccgggtactcgggtaacgaaacgggccgacgtaaagtcggnangtcagactgnnnnnnnnnnnnnnnnnnnnnnnnnnnnnnn

SEQ ID NO: 231770 - DNA, 562 bp, Homo sapiens
  misc_feature: GYAE6OF01ARATR.31.68.G02.1.454.CMB.1.raw
  modified_base (146)..(146): a, c, t, g, unknown or other
  misc_feature (146)..(146): n is a, c, g, or t
  modified_base (196)..(196): a, c, t, g, unknown or other
  misc_feature (196)..(196): n is a, c, g, or t
  modified_base (526)..(526): a, c, t, g, unknown or other
  misc_feature (526)..(526): n is a, c, g, or t
  modified_base (531)..(534): a, c, t, g, unknown or other
  misc_feature (531)..(534): n is a, c, g, or t
  modified_base (538)..(562): a, c, t, g, unknown or other
  misc_feature (538)..(562): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagngatgattcagagaacacgctgtatctacaaatgaacagcctacaaaccgngacacacgccgtctatttctgtaccacacacatgagtgggagtactacttctactacgtcgggccacggaaccctggtcctccgtctccgtccggcctccaccgacgggcccagtccggttccctttccccccgtggcccgtcccctcgcccttaccgacgggaccgcccaccccgtccggacgacggccacgcggcccggcccgtcggggactcgcccgttaggtccgtaaaggtccttacccgtttcccgacgttacgtaccgtcgtaccgtggacggccgggtcgtacgggacgaacggtcgaacgacgtaggctagcagtgcctanctcgnnnncgtnnnnnnnnnnnnnnnnnnnnnnnnn

SEQ ID NO: 231771 - DNA, 573 bp, Homo sapiens
  misc_feature: GYAE6OF01E11OD.31.68.G02.1.454.CMB.1.raw
  modified_base (540)..(540): a, c, t, g, unknown or other
  misc_feature (540)..(540): n is a, c, g, or t
  modified_base (545)..(545): a, c, t, g, unknown or other
  misc_feature (545)..(545): n is a, c, g, or t
  modified_base (548)..(573): a, c, t, g, unknown or other
  misc_feature (548)..(573): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctaacaaatgaacacgccctaccaaaccggaggaccacagtccgtcttactttctacgtaacccacacacagtgaggtgggagtactacttctacgtcgcgggccacggaaccctggtccgtccgtctcccgtcggcctaccaccgaacggtcccacgttccgtccttcccccgtggcccgtccctcgcctaccgaggacacccgtacccgtaccgacgacgaccaccgacggcccggtcccgtggggtccctcggtacccggtcggtaccgaacggtaacctttacccgttacccgtaccggttaccttaaccgttcggtaccgtcggaacggggtcccgggtcggtacgggacgtaacgggccaacgnttagncgnnnnnnnnnnnnnnnnnnnnnnnnnn

SEQ ID NO: 231772 - DNA, 442 bp, Homo sapiens
  misc_feature: GYAE6OF01D0672.31.68.G02.1.454.CMB.1.raw
  modified_base (210)..(210): a, c, t, g, unknown or other
  misc_feature (210)..(210): n is a, c, g, or t
  modified_base (224)..(224): a, c, t, g, unknown or other
  misc_feature (224)..(224): n is a, c, g, or t
  modified_base (325)..(325): a, c, t, g, unknown or other
  misc_feature (325)..(325): n is a, c, g, or t
  modified_base (348)..(348): a, c, t, g, unknown or other
  misc_feature (348)..(348): n is a, c, g, or t
  modified_base (354)..(354): a, c, t, g, unknown or other
  misc_feature (354)..(354): n is a, c, g, or t
  modified_base (432)..(442): a, c, t, g, unknown or other
  misc_feature (432)..(442): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctaccaaaccgaggacacagccgtntatttctgtaccanacacatgagtgggagtactacttctactacgtgggaccaagggtaaccctggtctccgtctcctcggcctccaccaaggcccagtccggtctcccctggcnccctgctccgagcgcacctcganagcacngcgccctgggctgcctggtacaaggacctacttccacgtctacgtcgctagagcgggctgggacaaggcgacagtagnnnnnnnnnnn

SEQ ID NO: 231773 - DNA, 483 bp, Homo sapiens
  misc_feature: GYAE6OF01CGK7M.31.68.G02.1.454.CMB.1.raw
  modified_base (417)..(417): a, c, t, g, unknown or other
  misc_feature (417)..(417): n is a, c, g, or t
  modified_base (455)..(483): a, c, t, g, unknown or other
  misc_feature (455)..(483): n is a, c, g, or t
tcagcagtagacgtcacgaccggtgctcgatttagtcgatagtgaagggaaaggggctggagtgggttgcccgtattaaaaagtaaaactgatggtgagacaacagactagctgcacccgtgaaaggcagattcgccatctcaagagatgattcagagaacacgctgtactctacaaatgaacagcctaccaaaccgaggacacacgccgtctatttctcgtaccacacacatgaggtgggagtactacttctactacgtggggccacggaccctggtcctccgtctccgcgcctacccaccgaacggcccctatcccggtccttcccccgtggccctcccgtgccctccgacggacgcccacccgtcgagacgcacgcgccgccgtgcgtcgcgtggacaacgctcctccactctntacgcgtgcgggtcggcgtacgacgaggtcacgtgagnnnnnnnnnnnnnnnnnnnnnnnnnnnnn

SEQ ID NO: 231774 - DNA, 664 bp, Homo sapiens
  misc_feature: GYAE6OF01D4ELA.31.68.G02.1.454.CMB.1.raw
  modified_base (114)..(114): a, c, t, g, unknown or other
  misc_feature (114)..(114): n is a, c, g, or t
  modified_base (596)..(596): a, c, t, g, unknown or other
  misc_feature (596)..(596): n is a, c, g, or t
  modified_base (605)..(605): a, c, t, g, unknown or other
  misc_feature (605)..(605): n is a, c, g, or t
  modified_base (627)..(627): a, c, t, g, unknown or other
  misc_feature (627)..(627): n is a, c, g, or t
  modified_base (630)..(630): a, c, t, g, unknown or other
  misc_feature (630)..(630): n is a, c, g, or t
  modified_base (632)..(632): a, c, t, g, unknown or other
  misc_feature (632)..(632): n is a, c, g, or t
  modified_base (635)..(646): a, c, t, g, unknown or other
  misc_feature (635)..(646): n is a, c, g, or t
  modified_base (648)..(659): a, c, t, g, unknown or other
  misc_feature (648)..(659): n is a, c, g, or t
  modified_base (661)..(664): a, c, t, g, unknown or other
  misc_feature (661)..(664): n is a, c, g, or t
tcagcagtagacgtcacgaccggtgctcgatttagtcgatagtgaagggaaaggggctggagtgggttgcccgtaattaaaaagtaaaactgatggtgagacaacagactacgntcgcacccggtagaaaggcagattcgcctaatctacaaagagatgtattacgaagaagaacacgtcgtagtaactactaaacaaatacgaacacgtaccctaaccgaaaacgacggtaacacgtaacgtccgttacttaagtttccgacgaacccaacaacctaagtagtaggaagggttacgggaaactttaccgtacttacgtaacgtacggtcgggaccgaacggtacccgttgtcctaccgtccgtaccgccgtacctccgtaaccggaccggcccctaaggttcccggttccttcccccggtggcccgtcctacgcccgtacgacggacctaccgaccgtacggacgtacgacaccgtacggccgaccggtcggtacgtccgtaccgtagggtaaaccaacggtacctttaaccctccggttaacgtactacgtagtccggtacgggccgacgggttaccggagggaaacccggtanaccgggtanaaagtcggtcagatgaatccgngangntannnnnnnnnnnnannnnnnnnnnnnannnn

SEQ ID NO: 231775 - DNA, 577 bp, Homo sapiens
  misc_feature: GYAE6OF01EMLK3.31.68.G02.1.454.CMB.1.raw
  modified_base (220)..(220): a, c, t, g, unknown or other
  misc_feature (220)..(220): n is a, c, g, or t
  modified_base (262)..(262): a, c, t, g, unknown or other
  misc_feature (262)..(262): n is a, c, g, or t
  modified_base (367)..(367): a, c, t, g, unknown or other
  misc_feature (367)..(367): n is a, c, g, or t
  modified_base (533)..(533): a, c, t, g, unknown or other
  misc_feature (533)..(533): n is a, c, g, or t
  modified_base (538)..(538): a, c, t, g, unknown or other
  misc_feature (538)..(538): n is a, c, g, or t
  modified_base (543)..(543): a, c, t, g, unknown or other
  misc_feature (543)..(543): n is a, c, g, or t
  modified_base (546)..(577): a, c, t, g, unknown or other
  misc_feature (546)..(577): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgcgtgtatctaacaaatgaacacgcctaccaaacgaggacaccagccgtctatttcngtaaccacacacatgacgtgggacgtactacttctactacgnggggaccacgggacccttggtcctccgtctccctccggcctaccaccgaacggcccctagttccggtccctcccccgtgggccctccctgccctaccgaggaccnccacccgtcgaggacgccaacgcggcccggccctggggtccctcgaccgttaggaaacctaacgggtacctttacccgtaccccgtacggtttccttaaccgcggtcgtacgggtaccgggccgggttcgtacggggaaccgtaaacggggcctacgaacgtaggntgacntcgangtnnnnnnnnnnnnnnnnnnnnnnnnnnnnnnnn

SEQ ID NO: 231776 - DNA, 543 bp, Homo sapiens
  misc_feature: GYAE6OF01ARF15.31.68.G02.1.454.CMB.1.raw
  modified_base (69)..(69): a, c, t, g, unknown or other
  misc_feature (69)..(69): n is a, c, g, or t
  modified_base (142)..(142): a, c, t, g, unknown or other
  misc_feature (142)..(142): n is a, c, g, or t
  modified_base (194)..(194): a, c, t, g, unknown or other
  misc_feature (194)..(194): n is a, c, g, or t
  modified_base (389)..(389): a, c, t, g, unknown or other
  misc_feature (389)..(389): n is a, c, g, or t
  modified_base (486)..(486): a, c, t, g, unknown or other
  misc_feature (486)..(486): n is a, c, g, or t
  modified_base (503)..(503): a, c, t, g, unknown or other
  misc_feature (503)..(503): n is a, c, g, or t
  modified_base (517)..(517): a, c, t, g, unknown or other
  misc_feature (517)..(517): n is a, c, g, or t
  modified_base (519)..(519): a, c, t, g, unknown or other
  misc_feature (519)..(519): n is a, c, g, or t
  modified_base (521)..(543): a, c, t, g, unknown or other
  misc_feature (521)..(543): n is a, c, g, or t
tcagcagtagacgtcacgaccggtgctcgatttagtcgatagtgaagggaaaggggctggagtgggttncccgtattaaaagtaaaactgatggtgagacaacagactacgctgcacccgtagaaaggcagattcgccatcncaagagatggattcagaagaacacgcttgtaatacctaacaaatcgaaaccncgccctaccgaaaaccggaggaccacgtacggtccttacttattttcctagtaaccccaacaccacattggagggtgggacgttaccttacttctaccgtaggtcgggaccgacgggtaacccttggtcctccgtctccgtccggcctccaccgtacggcccacgttccggtcccttccccgcggcccgtccctnccgtccgacggacgcctaacccgcggaacgcgcacggtaccgccggtccgtcggctcgcgtacggtaccgagtaccctaccgtccgtaacgtctacncgtcgtgacggtcgcgnggacgacggcagangncnnnnnnnnnnnnnnnnnnnnnnn

SEQ ID NO: 231777 - DNA, 474 bp, Homo sapiens
  misc_feature: GYAE6OF01BMJDF.31.68.G02.1.454.CMB.1.raw
  modified_base (350)..(350): a, c, t, g, unknown or other
  misc_feature (350)..(350): n is a, c, g, or t
  modified_base (356)..(356): a, c, t, g, unknown or other
  misc_feature (356)..(356): n is a, c, g, or t
  modified_base (362)..(362): a, c, t, g, unknown or other
  misc_feature (362)..(362): n is a, c, g, or t
  modified_base (453)..(453): a, c, t, g, unknown or other
  misc_feature (453)..(453): n is a, c, g, or t
  modified_base (455)..(474): a, c, t, g, unknown or other
  misc_feature (455)..(474): n is a, c, g, or t
tcagcagtagacgtcacgaccggtgctcgatttagtcgatagtgaagggaaaggggctggagtgggttgcccgtattaaaaagtaaaactgatggtgagacaacagactacgctgcacccgtgaaaggcagattcgccatctcaagagatgattcagagaacacgctgtatctacaaatcgaacagccctaccaaaccgaggacacacgccgtcttatttctgtaccacacacagtgagtgggagttactacttctactacgtggggaccacggtacctggtctccgtcctcctcgcctccaccgacggcccacgtccgtcctccccgtggccgccctgctaccgaggcnccaccncgagcncacacgccgccgtggcgtcgcgtcggcaacgtacttaccttccacgttcgtacgtcgcgtggcggtcggtcgtggacgaacggcagacgtngnnnnnnnnnnnnnnnnnnnn

SEQ ID NO: 231778 - DNA, 538 bp, Homo sapiens
  misc_feature: GYAE6OF01A8M5K.31.68.G02.1.454.CMB.1.raw
  modified_base (184)..(184): a, c, t, g, unknown or other
  misc_feature (184)..(184): n is a, c, g, or t
  modified_base (197)..(197): a, c, t, g, unknown or other
  misc_feature (197)..(197): n is a, c, g, or t
  modified_base (212)..(212): a, c, t, g, unknown or other
  misc_feature (212)..(212): n is a, c, g, or t
  modified_base (466)..(466): a, c, t, g, unknown or other
  misc_feature (466)..(466): n is a, c, g, or t
  modified_base (505)..(505): a, c, t, g, unknown or other
  misc_feature (505)..(505): n is a, c, g, or t
  modified_base (508)..(538): a, c, t, g, unknown or other
  misc_feature (508)..(538): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctaacaaatgaacngcctaccaaacgnggacacgagcccgtnttatttccgtataccacacgactagtgaggtgggtagttaaccttacttcacgttacgtaggggccgtaagggaaccccttggtccttcccgtctcccgtccggcctaccgaccgaacgggccccagttcccgttcccttcccccgtggcccgtccctgcctccgaggcctcccgaacctcggagaccagtaccgacggcccgtcccgagggcctccgcgtcggttacaacggtaccttacctcacgtactcgngtcgtaggcggccggtgtcggaacgaacggccgtatagngcnnnnnnnnnnnnnnnnnnnnnnnnnnnnnnn

SEQ ID NO: 231779 - DNA, 534 bp, Homo sapiens
  misc_feature: GYAE6OF01AL0RZ.31.68.G02.1.454.CMB.1.raw
  modified_base (198)..(198): a, c, t, g, unknown or other
  misc_feature (198)..(198): n is a, c, g, or t
  modified_base (218)..(218): a, c, t, g, unknown or other
  misc_feature (218)..(218): n is a, c, g, or t
  modified_base (228)..(228): a, c, t, g, unknown or other
  misc_feature (228)..(228): n is a, c, g, or t
  modified_base (341)..(341): a, c, t, g, unknown or other
  misc_feature (341)..(341): n is a, c, g, or t
  modified_base (498)..(500): a, c, t, g, unknown or other
  misc_feature (498)..(500): n is a, c, g, or t
  modified_base (502)..(502): a, c, t, g, unknown or other
  misc_feature (502)..(502): n is a, c, g, or t
  modified_base (504)..(534): a, c, t, g, unknown or other
  misc_feature (504)..(534): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctaacaaatgaacagcctaccaaaccgnggacacagccgtctatttcngtaccacacncatgagtgggagtactacttctacgtacgtcggggccacgggaaccctggttcctcccgtctcccgtcggccctaccaccgaacgggcccctagtcccggtcccttcccccgnggccctccctgcctccgaggcaccaccgtccgacgcgaccacgacgcccggaccgtgggcctccggccgtcggacaacggtaccttacctcccgaacgtcctacgtcgccgtaggacggccgggtctcgggaactacgggctacgagtacgcatcgnnncngnnnnnnnnnnnnnnnnnnnnnnnnnnnnnnn

SEQ ID NO: 231780 - DNA, 609 bp, Homo sapiens
  misc_feature: GYAE6OF01AO2L1.31.68.G02.1.454.CMB.1.raw
  modified_base (146)..(146): a, c, t, g, unknown or other
  misc_feature (146)..(146): n is a, c, g, or t
  modified_base (558)..(558): a, c, t, g, unknown or other
  misc_feature (558)..(558): n is a, c, g, or t
  modified_base (562)..(562): a, c, t, g, unknown or other
  misc_feature (562)..(562): n is a, c, g, or t
  modified_base (571)..(571): a, c, t, g, unknown or other
  misc_feature (571)..(571): n is a, c, g, or t
  modified_base (576)..(576): a, c, t, g, unknown or other
  misc_feature (576)..(576): n is a, c, g, or t
  modified_base (579)..(579): a, c, t, g, unknown or other
  misc_feature (579)..(579): n is a, c, g, or t
  modified_base (582)..(583): a, c, t, g, unknown or other
  misc_feature (582)..(583): n is a, c, g, or t
  modified_base (586)..(587): a, c, t, g, unknown or other
  misc_feature (586)..(587): n is a, c, g, or t
  modified_base (589)..(590): a, c, t, g, unknown or other
  misc_feature (589)..(590): n is a, c, g, or t
  modified_base (592)..(594): a, c, t, g, unknown or other
  misc_feature (592)..(594): n is a, c, g, or t
  modified_base (596)..(598): a, c, t, g, unknown or other
  misc_feature (596)..(598): n is a, c, g, or t
  modified_base (600)..(609): a, c, t, g, unknown or other
  misc_feature (600)..(609): n is a, c, g, or t
tcagcagtagacgtcacgaccggtgctcgattttagtcgatagtgaagggaaggggctggagtgggttgcccgtattaaaagtaaaactgatggtgagacaacagactacgctgcaccgtgaaaggcagattcgcatctcaagagntgattcagacacacgctgtatcgtaacaagtgaacgcgcctaccgaaacggacggacacgtacggtcccgttattaagtttcctacgtaaccaaccacgactagtcggagggtacgggtacgtttactaccttctacgtccggtcggggaccaacggtaccctggttcctaccggtcctcccgtcgcctaccaccggacgggtccccaggttcccggttcccctcccggtaggcccgtccgttacgccctacggagggcctccgacccgtacggagacgaccgtacggaccggcccggccgtgggcctcggtcggtacggtacggaacgtacccttccgtacgtaccggtccttaacgcggtacggtaggacggttccgggacgtacggacgaacggtcaacgtaagctcgngacngcatcgcgntcgangcngcnngcnncnngnnngnnncnnnnnnnnnn

SEQ ID NO: 231781 - DNA, 598 bp, Homo sapiens
  misc_feature: GYAE6OF01EZ1N2.31.68.G02.1.454.CMB.1.raw
  modified_base (164)..(164): a, c, t, g, unknown or other
  misc_feature (164)..(164): n is a, c, g, or t
  modified_base (200)..(200): a, c, t, g, unknown or other
  misc_feature (200)..(200): n is a, c, g, or t
  modified_base (227)..(227): a, c, t, g, unknown or other
  misc_feature (227)..(227): n is a, c, g, or t
  modified_base (363)..(363): a, c, t, g, unknown or other
  misc_feature (363)..(363): n is a, c, g, or t
  modified_base (491)..(492): a, c, t, g, unknown or other
  misc_feature (491)..(492): n is a, c, g, or t
  modified_base (499)..(499): a, c, t, g, unknown or other
  misc_feature (499)..(499): n is a, c, g, or t
  modified_base (504)..(504): a, c, t, g, unknown or other
  misc_feature (504)..(504): n is a, c, g, or t
  modified_base (524)..(524): a, c, t, g, unknown or other
  misc_feature (524)..(524): n is a, c, g, or t
  modified_base (582)..(582): a, c, t, g, unknown or other
  misc_feature (582)..(582): n is a, c, g, or t
  modified_base (593)..(593): a, c, t, g, unknown or other
  misc_feature (593)..(593): n is a, c, g, or t
tcagcagtagacgtcacgaccggtgctcgatttagtcgatagtgaagggaaaggggctgggagtgggttgcccgtattaaaagtaaaactgatggtgagacaacagactacgctgcacccgtgaaacggcagattcgccatctcaagagatgattcagagaacncgctgtatctacaaatgaacagccctacaaaccggnggactacacggccgttactactttccncgtacccacaccacagtgagtgggtaacgtactacttctacgtacgtcggggccacgggaacctggtcctccgtctccgtcgcctccacgaacggcctagtcgtcctccccgtggccgtccctgcctccgaggacnccgtacctcggacgagccgaacgcggccggtcccgtgggcctcggtccgtagggtaccgaacggtactaccttccgacgtcttacgtcgacgtgacggcggtctacgggcgaacggcacgtagtacgnnacagtcncgtanctagcgtctacgcgtaccgngtaacctggcctacgctacgtcacgcctacgcgttacgacgttcgaagtccgacgtanacgactcgcgngtacg

SEQ ID NO: 231782 - DNA, 426 bp, Homo sapiens
  misc_feature: GYAE6OF02JA549.31.68.G02.1.454.CMB.1.raw
  modified_base (416)..(416): a, c, t, g, unknown or other
  misc_feature (416)..(416): n is a, c, g, or t
  modified_base (422)..(426): a, c, t, g, unknown or other
  misc_feature (422)..(426): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatcttaagagatgattcagagaacacgctgtatctacaaatgaacagcctccaaaccgaggacacagccgtctatttctgtaccacacacatgagtgggaggtactacttctactactggggccagggaaccctggtctccgtctcctcggcctccaccaagggcccatcggtcttcccctggcgccctgctccaggagcacctccgagagcacagcggccctgggctgcctggtcaaggactacttccacgtctactgctgagcgggctggcaaggcncatagnnnnn

SEQ ID NO: 231783 - DNA, 499 bp, Homo sapiens
  misc_feature: GYAE6OF02GYS0K.31.68.G02.1.454.CMB.1.raw
  modified_base (477)..(499): a, c, t, g, unknown or other
  misc_feature (477)..(499): n is a, c, g, or t
tcagcagtagacgtcacgaccggtgctcgatttagtcgatagtgaagggaaagggctggagtgggttgcccgtattaaaagtaaactgatggtgagacaacagactacgctgcacccgtgaaaggcagattcgccatctcaagagatgattcagagaacacgctgtatctacaaatgaacagcctccaaaccgaggacacagccgtctatttctgtaccacacacatgagtgggaggtactacttctactactggggccagggaaccctggtctccgtctcctcggcctccaccaagggcccatcggtcttccccctggcgccctgcctccaggacgccaccccgtcgagacgaccacgcggcccgtccggcggtcgtccgtcggtcgaacggaacgtaccttaccctaccgtaccgttacctacgtcgtcgtaggaccggggccggtcggtcggaacggacgggccgactagtagnnnnnnnnnnnnnnnnnnnnnnn

SEQ ID NO: 231784 - DNA, 424 bp, Homo sapiens
  misc_feature: GYAE6OF02G3RRZ.31.68.G02.1.454.CMB.1.raw
  modified_base (420)..(424): a, c, t, g, unknown or other
  misc_feature (420)..(424): n is a, c, g, or t
tcagcagtagacgtcacgaccggtgctcgatttagtcgatagtgaagggaaagggctggagtgggttgcccgtattaaagtaaactgatggtgagacaacagactacgctgcacccgtgaaaggcagattcgccatctcaagagatgattcagagaacacgctgtatctacaaatgaacagcctccaaaccgaggacacagccgtctatttctgtaccacacacatgagtgggaggtactacttctactactggggccagggaaccctggtctccgtctcctcggcctccaccaagggcccatcggtcttccccctggcgccctgctccaggacgcacctccgagagcacagcggccctgggctgcctggtcaaggactactccacgtctactgctgagcgggctggcaaggcgcatagnnnnn

SEQ ID NO: 231785 - DNA, 445 bp, Homo sapiens
  misc_feature: GYAE6OF02HUN6A.31.68.G02.1.454.CMB.1.raw
  modified_base (425)..(445): a, c, t, g, unknown or other
  misc_feature (425)..(445): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctccaaaaccgaggacacagccgtctatttctgtaccacacacatgagtgggaggtactacttctactactggggccagggaaccctggtctccgtctcctcggcctccaccaagggcccatcggtcttccccctggccgccctgctccaggagcaccctccgagagcacagcggccctgggctgcctggtcaaggctacttccacgtctactgctgagcgggctggcaaggcgcatagnnnnnnnnnnnnnnnnnnnnn

SEQ ID NO: 231786 - DNA, 429 bp, Homo sapiens
  misc_feature: GYAE6OF02FXMCX.31.68.G02.1.454.CMB.1.raw
  modified_base (337)..(337): a, c, t, g, unknown or other
  misc_feature (337)..(337): n is a, c, g, or t
  modified_base (424)..(429): a, c, t, g, unknown or other
  misc_feature (424)..(429): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctccaaaccgaggacacagccgtctatttctgtaccacacacatgagtgggaggtactacttctactactgggggccagggaaccctggtctccgtctcctcggcctccaccaagggcccatcggtcttccccctggcgccctgctccaggngcacctccgagagcacagcggccctgggctgcctggtcaaggactacttccacgtctactgctgagcgggctggcaaggcgcatagnnnnnn

SEQ ID NO: 231787 - DNA, 429 bp, Homo sapiens
  misc_feature: GYAE6OF02F0WYY.31.68.G02.1.454.CMB.1.raw
  modified_base (424)..(429): a, c, t, g, unknown or other
  misc_feature (424)..(429): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctccaaaaccgaggacacagccgtctatttctgtaccacacacatgagtgggaggtactacttctactactggggccagggaaccctggtctccgtctcctcggcctccaccaagggcccatcggtcttccccctggcgccctgctccaggagcacctccgagagcacagcggccctgggctgcctggtcaaggactacttccacgtctactgctgagcgggctggcaaggcgcatagnnnnnn

SEQ ID NO: 231788 - DNA, 426 bp, Homo sapiens
  misc_feature: GYAE6OF02GE3XK.31.68.G02.1.454.CMB.1.raw
  modified_base (422)..(426): a, c, t, g, unknown or other
  misc_feature (422)..(426): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctccaaaccgaggacacagccgtctatttctgtaccacacacatgagtgggagtactacttctactactggggccagggaaccctggtctccgtctcctcggcctccaccaagggcccatcggtcttccccctggcgccctgctccaggagcacctccgagagcacagcggccctgggctgcctggtcaaggactacttccacgtctactgctgagcgggctggcaaggcgcatagnnnnn

SEQ ID NO: 231789 - DNA, 426 bp, Homo sapiens
  misc_feature: GYAE6OF02F6JL6.31.68.G02.1.454.CMB.1.raw
  modified_base (418)..(418): a, c, t, g, unknown or other
  misc_feature (418)..(418): n is a, c, g, or t
  modified_base (424)..(426): a, c, t, g, unknown or other
  misc_feature (424)..(426): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctccaaaaccgaggacacagccgtctatttctgtaccacacacatgagtgggaggtactacttctactactggggccagggaaccctggtctccgtctcctcggcctccaccaagggcccatcggtcttccccctggcgccctgctccaggagcacctccgagagcacagcggccctgggctgcctggtcaaggactacttccacgtctactgctgagcgggctggcaaggcncatagnnn

SEQ ID NO: 231790 - DNA, 428 bp, Homo sapiens
  misc_feature: GYAE6OF02G6JKM.31.68.G02.1.454.CMB.1.raw
  modified_base (422)..(428): a, c, t, g, unknown or other
  misc_feature (422)..(428): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctccaaaccgaggacacagccgtctatttctgtaccacacacatgagtgggagtactacttctactactggggccagggaaccctggtctccgtctcctcggcctccaccaagggcccatcggtcttccccctggcgccctgctccaggagcacctccgagagcacagcggccctgggctgcctggtcaaggactacttccacgtctactgctgagcgggctggcaaggcgcatagnnnnnnn

SEQ ID NO: 231791 - DNA, 487 bp, Homo sapiens
  misc_feature: GYAE6OF02II63W.31.68.G02.1.454.CMB.1.raw
  modified_base (472)..(487): a, c, t, g, unknown or other
  misc_feature (472)..(487): n is a, c, g, or t
tcagcagtagacgtcacgaccggtgctcgatttagtcgatagtgaagggaaagggcgtggagtgggttgcccgtattaaagtaaactagatggtgagacaacagactacgctgcacccgtgaaagcagattcgccatctcaagagatgattcagagaacacgctgtatctacaaatgaacagcctaccaaaccgaggacacagccgtctattcctgtaccacacacatgagtgggagtactacttctactactgggggcccagggaacccctggtacctccgtctcctcggccctccaacccaagggccccaacgtccggtccttcccccctggccgccccctgaccctccaggacgccacccgtccgagcgacacacggccgtccctgggcctgccctacgggtccaaagggacctaacctttccgaaccgttctaactcgcctgacgcgggctggcaaggcgcaatgacnnnnnnnnnnnnnnnn

SEQ ID NO: 231792 - DNA, 426 bp, Homo sapiens
  misc_feature: GYAE6OF02HLINZ.31.68.G02.1.454.CMB.1.raw
  modified_base (423)..(426): a, c, t, g, unknown or other
  misc_feature (423)..(426): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctccaaaccgaggacacagccgtctatttctgtaccacacacatgagtgggaggtactacttctactactggggccagggaaccctggtctccgtctcctcggcctccaccaagggcccatcggtcttccccctggccgccctgctccaggagcacctcgagagcacagcggccctgggctgcctggtcaaggactacttccacgtctactgctgagcgggctggcaaggcgcatagnnnn

SEQ ID NO: 231793 - DNA, 434 bp, Homo sapiens
  misc_feature: GYAE6OF02IKB9U.31.68.G02.1.454.CMB.1.raw
  modified_base (409)..(409): a, c, t, g, unknown or other
  misc_feature (409)..(409): n is a, c, g, or t
  modified_base (416)..(416): a, c, t, g, unknown or other
  misc_feature (416)..(416): n is a, c, g, or t
  modified_base (426)..(426): a, c, t, g, unknown or other
  misc_feature (426)..(426): n is a, c, g, or t
  modified_base (431)..(434): a, c, t, g, unknown or other
  misc_feature (431)..(434): n is a, c, g, or t
tcagcagtagacgtcacgaccggtgctcgatttagtcgatagtgaagggaaagggcgtggagtgggttgcccgtattaaagtaaactagatggtgagacaacagactacgctgcacccgtgaaaggcagattcgccatctcaagagatgattcagagaacacgctgtatctacaaatgaacagcctccaaaaccgaggacacagccgtctatttctgtaccacacacatggagtgggacgtactacttctactactggggccagggaaccctggtctccgtctcctcggacctccaccaagggcccatcggtcttccccctggcgccctgctaccaggagcacctccgagagcacagcggcccttgggctgccctaggtcaaaggctacttccacgtctactgctgganccggggntggcaaggcncatgnnnn

SEQ ID NO: 231794 - DNA, 451 bp, Homo sapiens
  misc_feature: GYAE6OF02H7QLK.31.68.G02.1.454.CMB.1.raw
  modified_base (223)..(223): a, c, t, g, unknown or other
  misc_feature (223)..(223): n is a, c, g, or t
  modified_base (432)..(451): a, c, t, g, unknown or other
  misc_feature (432)..(451): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctccaaaccgaggacacagccgtctatttctgtaccanacacatgagtgggaggtactattctactactggggccagggaaccctggtctccgtctcctcggcctccaccaagggcccatcggtccttccccctggccgcccctgcctccgagggacgccacctccgagacgcacagcggccctgggctgcctggtcaaggtcctacttccacgtctactgctgagcgggctggcaaggcgcatagnnnnnnnnnnnnnnnnnnnn

SEQ ID NO: 231795 - DNA, 434 bp, Homo sapiens
  misc_feature: GYAE6OF02JAI0X.31.68.G02.1.454.CMB.1.raw
  modified_base (419)..(419): a, c, t, g, unknown or other
  misc_feature (419)..(419): n is a, c, g, or t
  modified_base (425)..(434): a, c, t, g, unknown or other
  misc_feature (425)..(434): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctccaaaccgaggacacagccgtctatttctgtaccacacacatgagtgggagtactacttctactactggggccagggaaccctggtctccgtctcctcggcctccaccaagggcccatcggtcttccccctggccgcccctgctccaggacgccacctccgagagcacagcggccctggggctgcctggtcaaggactacttccacgtctactgctgagcggctggcaggcncatagnnnnnnnnnn

SEQ ID NO: 231796 - DNA, 491 bp, Homo sapiens
  misc_feature: GYAE6OF02HY04P.31.68.G02.1.454.CMB.1.raw
  modified_base (472)..(490): a, c, t, g, unknown or other
  misc_feature (472)..(490): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctaacaaatgaacagcctccaaaccgaggacacagccgtctatttctgtaccacacacatgagtgggaggtactacttctactactggggccagggaaccctggtctccgtctcctcggcctccaccaagggcccatcggtccttccccctgggccgcccctcggcctccagggacgccacctccggagacgcaacacgccggccccgtggggcctcggtccgtggtacaacggtccttaccttcccacgtttcctactcggctggacggtccgggcgtcgggccaagggccgacaatagcnnnnnnnnnnnnnnnnnnng

SEQ ID NO: 231797 - DNA, 429 bp, Homo sapiens
  misc_feature: GYAE6OF02F21IW.31.68.G02.1.454.CMB.1.raw
  modified_base (335)..(335): a, c, t, g, unknown or other
  misc_feature (335)..(335): n is a, c, g, or t
  modified_base (423)..(429): a, c, t, g, unknown or other
  misc_feature (423)..(429): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctccaaaccgaggacacagccgtctatttctgtaccacacacatgagtgggaggtactacttctactactggggccagggaaccctggtctccgtctcctcggcctccaccaagggcccatcggtctccccctggcgccctgctccaggngcacctccgagagcacagcggccctggggctgcctggtcaaggactacttccacgtctactgctgagcgggctggcaaggcgcatagnnnnnnn

SEQ ID NO: 231798 - DNA, 430 bp, Homo sapiens
  misc_feature: GYAE6OF02FKB56.31.68.G02.1.454.CMB.1.raw
  modified_base (338)..(338): a, c, t, g, unknown or other
  misc_feature (338)..(338): n is a, c, g, or t
  modified_base (403)..(403): a, c, t, g, unknown or other
  misc_feature (403)..(403): n is a, c, g, or t
  modified_base (418)..(418): a, c, t, g, unknown or other
  misc_feature (418)..(418): n is a, c, g, or t
  modified_base (424)..(430): a, c, t, g, unknown or other
  misc_feature (424)..(430): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctccaaaaccgaggacacagccgtctatttctgtaccacacacatgagtgggaggtactacttctactactgggggccagggaaccctggtctccgtctcctcggcctccaccaagggcccatcgttcttccccctggcgccctgctccaggngcacctccgagagcacagcggccctgggctgcctggtcaaggactacttccacgtctactgctgngcggctggcaaggcncatagnnnnnnn

SEQ ID NO: 231799 - DNA, 424 bp, Homo sapiens
  misc_feature: GYAE6OF02HZA5M.31.68.G02.1.454.CMB.1.raw
  modified_base (420)..(424): a, c, t, g, unknown or other
  misc_feature (420)..(424): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctccaaaccgaggacacagccgtctatttctgtaccacacacatgagtgggaggtactacttctactactgggccagggaaccctggtctccgtctcctcggcctccaccaagggcccatcggtcttcccctggcgccctgctccaggagcacctccgagagcacagcggccctgggctgcctggtcaaggactacttccacgtctactgctgagcgggctggcaggcgcatagnnnnn

SEQ ID NO: 231800 - DNA, 476 bp, Homo sapiens
  misc_feature: GYAE6OF02IUU8I.31.68.G02.1.454.CMB.1.raw
  modified_base (196)..(196): a, c, t, g, unknown or other
  misc_feature (196)..(196): n is a, c, g, or t
  modified_base (218)..(218): a, c, t, g, unknown or other
  misc_feature (218)..(218): n is a, c, g, or t
  modified_base (226)..(226): a, c, t, g, unknown or other
  misc_feature (226)..(226): n is a, c, g, or t
  modified_base (351)..(351): a, c, t, g, unknown or other
  misc_feature (351)..(351): n is a, c, g, or t
  modified_base (362)..(362): a, c, t, g, unknown or other
  misc_feature (362)..(362): n is a, c, g, or t
  modified_base (425)..(425): a, c, t, g, unknown or other
  misc_feature (425)..(425): n is a, c, g, or t
  modified_base (435)..(435): a, c, t, g, unknown or other
  misc_feature (435)..(435): n is a, c, g, or t
  modified_base (442)..(444): a, c, t, g, unknown or other
  misc_feature (442)..(444): n is a, c, g, or t
  modified_base (447)..(476): a, c, t, g, unknown or other
  misc_feature (447)..(476): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctccaaaccgnggacacagcccgtctatttccngtacccanacacattgagtggggacgtactacttcgtaactactgggggcccaggggaacccctgggtcctccggtctcctcggcctcccaccaagggcccatccggtctccccctgcgccctgctccaggancacctccggangcacagccggccctggggctcgcctggtcaaggacctacttccagtctactgcctgagcgggntggcaaggcncgatagnnncgnnnnnnnnnnnnnnnnnnnnnnnnnnnnnn

SEQ ID NO: 231801 - DNA, 441 bp, Homo sapiens
  misc_feature: GYAE6OF02JFM8W.31.68.G02.1.454.CMB.1.raw
  modified_base (348)..(348): a, c, t, g, unknown or other
  misc_feature (348)..(348): n is a, c, g, or t
  modified_base (424)..(441): a, c, t, g, unknown or other
  misc_feature (424)..(441): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctccaaaccgaggacacagccgtctattctgtaccacacacatgagtgggagtactacttctactactggggccagggaaccctggtctccgtctcctcggcctccaccaagggcccatcggtcttccccctggccgccctgcctccaggagcacctccgagngcacagccggccctgggctgccgtggtcaaggctacttccacgtctactgctgagcgggctggcaaggcgcatagnnnnnnnnnnnnnnnnnn

SEQ ID NO: 231802 - DNA, 509 bp, Homo sapiens
  misc_feature: GYAE6OF02IUX9Q.31.68.G02.1.454.CMB.1.raw
  modified_base (482)..(482): a, c, t, g, unknown or other
  misc_feature (482)..(482): n is a, c, g, or t
  modified_base (484)..(509): a, c, t, g, unknown or other
  misc_feature (484)..(509): n is a, c, g, or t
tcagcagtagacgtcacgaccggtgctcgatttagtcgatagtgaaggggaaaggggcgtggagtgggttgcccgtattaaaagtaaaactgatggtgagacaacagactacgctgcacccgtgaaaggcagattcgccatctcaagagatgattcagtagaacacgctgtatctacaaatgaacagcctccaaaccgaggacacagccgtctatttctgtaccacacacatgagtgggaggtactaccttctactacgtggggccacgggaaccctggtctcccgtcctcctcggcctcccaccaacgggcccctatccggttccttccccccgtcggcccgtcccctggcctcccgaacgggtgcccaccctccgagcgaccacgaggccggcccgtgggcctcgcctggtacaaggacttacctccgacgttctacctggtcctggcggcgggctcggggcaagggcgtctagtacgtntnnnnnnnnnnnnnnnnnnnnnnnnnn

SEQ ID NO: 231803 - DNA, 438 bp, Homo sapiens
  misc_feature: GYAE6OF02IRHGU.31.68.G02.1.454.CMB.1.raw
  modified_base (343)..(343): a, c, t, g, unknown or other
  misc_feature (343)..(343): n is a, c, g, or t
  modified_base (360)..(360): a, c, t, g, unknown or other
  misc_feature (360)..(360): n is a, c, g, or t
  modified_base (403)..(403): a, c, t, g, unknown or other
  misc_feature (403)..(403): n is a, c, g, or t
  modified_base (430)..(438): a, c, t, g, unknown or other
  misc_feature (430)..(438): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaaacagcctccaaaaccgaggacacagccgtctatttctgtaccacacacatgagtgggagtactacttctactactggggccagggaaccctggtctccgtctcctcggcctccaccaacgggcccatcggtccttccccctggccgccctgcctccaggacnccacctccgagagcacngccggccctgggctcgcctggtcaaggctactccacgtctacngctgagcgggctggacaggcgcatagnnnnnnnnn

SEQ ID NO: 231804 - DNA, 593 bp, Homo sapiens
  misc_feature: GYAE6OF02J0WSI.31.68.G02.1.454.CMB.1.raw
  modified_base (185)..(185): a, c, t, g, unknown or other
  misc_feature (185)..(185): n is a, c, g, or t
  modified_base (223)..(223): a, c, t, g, unknown or other
  misc_feature (223)..(223): n is a, c, g, or t
  modified_base (263)..(263): a, c, t, g, unknown or other
  misc_feature (263)..(263): n is a, c, g, or t
  modified_base (545)..(545): a, c, t, g, unknown or other
  misc_feature (545)..(545): n is a, c, g, or t
  modified_base (554)..(554): a, c, t, g, unknown or other
  misc_feature (554)..(554): n is a, c, g, or t
  modified_base (558)..(558): a, c, t, g, unknown or other
  misc_feature (558)..(558): n is a, c, g, or t
  modified_base (560)..(563): a, c, t, g, unknown or other
  misc_feature (560)..(563): n is a, c, g, or t
  modified_base (565)..(567): a, c, t, g, unknown or other
  misc_feature (565)..(567): n is a, c, g, or t
  modified_base (569)..(569): a, c, t, g, unknown or other
  misc_feature (569)..(569): n is a, c, g, or t
  modified_base (571)..(573): a, c, t, g, unknown or other
  misc_feature (571)..(573): n is a, c, g, or t
  modified_base (575)..(593): a, c, t, g, unknown or other
  misc_feature (575)..(593): n is a, c, g, or t
tcagcagtagacgtcacgaccggtgctcgatttagtcgatagtgaagggaaaggggacgtggagtgggttggcccgtattaaagtaaactagatggtgagacaacagactacgctgcacccgtgaaaggcagattcgccatctcaagagatgattcagagaacacgctgtatctacaaatgaacngcctaccaaaccgaggacacctagcccgtctatttccngtaccacacacatgagtgggacgtactacttcacgttacngggggtccagggtaaccctggtctaccgtctacctccggcccttcccaccgaacgggcccctacaacgggttttcccctcccccgtaggcccgtcccctcggccttacccgacgggcgccctacccgtccgacggacgcgccgacggcccggtcccgtacggggcctcggcccgtcggtaccaacgggtcctacccgttcccgtaacccgggttcctaaccggtttgaccgtacggtacggccgggttaccgtcggacgtaacggcccgtagtaccgtagtnacgtcgcanctgncnnnncnnncncnnncnnnnnnnnnnnnnnnnnnn

SEQ ID NO: 231805 - DNA, 477 bp, Homo sapiens
  misc_feature: GYAE6OF02GZT5F.31.68.G02.1.454.CMB.1.raw
  modified_base (313)..(313): a, c, t, g, unknown or other
  misc_feature (313)..(313): n is a, c, g, or t
  modified_base (333)..(333): a, c, t, g, unknown or other
  misc_feature (333)..(333): n is a, c, g, or t
  modified_base (462)..(477): a, c, t, g, unknown or other
  misc_feature (462)..(477): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctccaaaccgaggacacagccgtctatttctgtaccacacacatgagtgggagtactacttctactactgggccagggaaccctggtctccgtctcctcggcctccaccaggcccatcgtcctccccnggccgccctgcctccaggcnccaccctccgagacgccacgacgccggcccgtggggctcggccctggtccgaaacggtacctaccttcccgacgttcctaccgtcgtcctggacggccggggtcgtgggaccgaagggccgacagtagnnnnnnnnnnnnnnnn

SEQ ID NO: 231806 - DNA, 440 bp, Homo sapiens
  misc_feature: GYAE6OF02I6U70.31.68.G02.1.454.CMB.1.raw
  modified_base (428)..(428): a, c, t, g, unknown or other
  misc_feature (428)..(428): n is a, c, g, or t
  modified_base (433)..(440): a, c, t, g, unknown or other
  misc_feature (433)..(440): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctccaaaccgaggacacagccgtctatttctgtaccacacacatgagtgggaggtactacttctactactggggccagggaaccctggtctccgtctcctcggcctccaccaagggcccatcggtcttccccctggccgccctgcctccaggacgccaccctccgagagcacacgccggccctggggctcgcctggtcaaggacctacttccacgtctactgctgagcgggctggcaaggcgnatagnnnnnnnn

SEQ ID NO: 231807 - DNA, 435 bp, Homo sapiens
  misc_feature: GYAE6OF02IDYKF.31.68.G02.1.454.CMB.1.raw
  modified_base (424)..(424): a, c, t, g, unknown or other
  misc_feature (424)..(424): n is a, c, g, or t
  modified_base (430)..(435): a, c, t, g, unknown or other
  misc_feature (430)..(435): n is a, c, g, or t
tcagcagtagacgtcacgaccggtgctcgatttagtcgatagtgaagggaaaggggcgtggagtgggttgcccgtattaaaagtaaaactgatggtgagacaacagactacgctgcacccgtgaaaggcagattcgccatctcaagagatgattcagagaacacgctgtatctaacaaatgaacagccctaccaaaccgaggacacagccgtctatttctgtaccacacacatgagtgggagtactacttctactactggggccaggggaaccctggtctccgtctccctcggcctccaccaagggcccatcggtcttccccctggcgcccctgctccaggacgcacctccgagagcacgagccggccctgggcctgcctggtcaacggctactccacgtcactgctgacgcggctggcaggcncatagnnnnnn

SEQ ID NO: 231808 - DNA, 439 bp, Homo sapiens
  misc_feature: GYAE6OF02GR3MS.31.68.G02.1.454.CMB.1.raw
  modified_base (341)..(341): a, c, t, g, unknown or other
  misc_feature (341)..(341): n is a, c, g, or t
  modified_base (430)..(439): a, c, t, g, unknown or other
  misc_feature (430)..(439): n is a, c, g, or t
tcagcagtagacgtcacgaccggtgctcgatttagtcgatagtgaagggaaggggctggagtgggttgcccgtattaaaagtaaaactgatggtgagacaacagaaactacgctgcacccgtgaaaggcagattcgccatctcaagagatgattcagagaacacgctgtatctacaaatgaacagcctccaaaccgaggacacagccgtctatttctgtaccacacacatgagtgggagtactacttctactacgtggggccagggaaccctggtctccgtctcctcggcctccaccaagggcccatccggtcttccccctggccgccctgctccaggacncaccctccgagagccacagccggccctgggctgcctggtcaaggactacttccacgtctactgctgagcggcgtggcaaggcgcatagnnnnnnnnnn

SEQ ID NO: 231809 - DNA, 435 bp, Homo sapiens
  misc_feature: GYAE6OF02FTS0K.31.68.G02.1.454.CMB.1.raw
  modified_base (422)..(435): a, c, t, g, unknown or other
  misc_feature (422)..(435): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctccaaaaccgaggacacagccgtctatttctgtaccacacacatgagtgggaggtactacttctactactgggggccagggaaccctggtctccgtctcctcggcctccaccaagggcccatcggtctccccctggcgccctgctccaggacgcacctccgagacgcacagcggccctgggctgcctggtcaaggctacttccacgtctactgctgagcggctggcaggcgcatgnnnnnnnnnnnnnn

SEQ ID NO: 231810 - DNA, 458 bp, Homo sapiens
  misc_feature: GYAE6OF02HQ69L.31.68.G02.1.454.CMB.1.raw
  modified_base (321)..(321): a, c, t, g, unknown or other
  misc_feature (321)..(321): n is a, c, g, or t
  modified_base (407)..(407): a, c, t, g, unknown or other
  misc_feature (407)..(407): n is a, c, g, or t
  modified_base (442)..(458): a, c, t, g, unknown or other
  misc_feature (442)..(458): n is a, c, g, or t
tcagcagtagacgtcacgaccggtgctcgatttagtcgatagtgaagggaaggggctggagtgggttgcccgtattaaaagtaaaactgatggtgagacaacagactacgctgcacccgtgaaaggcagattcgccatctcaagagatgattcagagaacacgctgtatctacaaatgaaacagcctccaaaaccgaggacacagccgtctatttctgtaccacacacatgagtggggagtactacttctactacgtggggccagggaaccctggtcctccgtctcctcggcctccaccaagggccatcggtcttcccccnggccgccctgctccaggcgccacctccgagcgaccacaggcccgccgtcggggctcgccgtggcaaggcctacttccacgtctacncgctgacggcgggctgggcgaaggccgcagtacgnnnnnnnnnnnnnnnnn

SEQ ID NO: 231811 - DNA, 447 bp, Homo sapiens
  misc_feature: GYAE6OF02JKJ8T.31.68.G02.1.454.CMB.1.raw
  modified_base (415)..(415): a, c, t, g, unknown or other
  misc_feature (415)..(415): n is a, c, g, or t
  modified_base (430)..(433): a, c, t, g, unknown or other
  misc_feature (430)..(433): n is a, c, g, or t
  modified_base (435)..(447): a, c, t, g, unknown or other
  misc_feature (435)..(447): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctccaaaccgaggacacagccgtctattctgtaccacacacatgagtgggagtactacttctactactggggccagggaaccctggtctccgtctcctcggcctccaccaagggcccatccggtcttccccctggccgccctgcctccaggacgcaccctccgagagcacagccggccctgggcctgcctggtcaaggtactacttcccacgtcctactgctgagcgggntggcaggcgcatagnnnncnnnnnnnnnnnnn

SEQ ID NO: 231812 - DNA, 425 bp, Homo sapiens
  misc_feature: GYAE6OF02IM241.31.68.G02.1.454.CMB.1.raw
  modified_base (217)..(217): a, c, t, g, unknown or other
  misc_feature (217)..(217): n is a, c, g, or t
  modified_base (224)..(224): a, c, t, g, unknown or other
  misc_feature (224)..(224): n is a, c, g, or t
  modified_base (418)..(418): a, c, t, g, unknown or other
  misc_feature (418)..(418): n is a, c, g, or t
  modified_base (423)..(425): a, c, t, g, unknown or other
  misc_feature (423)..(425): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctccaaaaccgaggacacagccgtctatttcngtaccanacacatgagtgggagtactacttctactactgggccagggaaccctggtctccgtctcctcggcctccaccaagggcccatcggtcttccccctggcgccctgcctccaggagcacctccgagagcacagcggccctgggctgcctggtcaaggactacttccacgtctactgctgagcgggctggcaaggcgnatagnnn

SEQ ID NO: 231813 - DNA, 442 bp, Homo sapiens
  misc_feature: GYAE6OF02IYHQC.31.68.G02.1.454.CMB.1.raw
  modified_base (339)..(339): a, c, t, g, unknown or other
  misc_feature (339)..(339): n is a, c, g, or t
  modified_base (431)..(431): a, c, t, g, unknown or other
  misc_feature (431)..(431): n is a, c, g, or t
  modified_base (434)..(442): a, c, t, g, unknown or other
  misc_feature (434)..(442): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctccaaaccgaggacacagccgtctatttctgtaccacacacatgagtgggaggtactacttctactactggggccagggaaccctggtctccgtctcctcggcctccaccaagggcccatcggtcttccccctggccgccctgcctccaggcnccacctccgagagcacagcggcccctggggcctggcctcggtcaagggactacttccacgtctactgcgacgggtccgtggacgaggcgcanagnnnnnnnnn

SEQ ID NO: 231814 - DNA, 441 bp, Homo sapiens
  misc_feature: GYAE6OF02JIZIY.31.68.G02.1.454.CMB.1.raw
  modified_base (216)..(216): a, c, t, g, unknown or other
  misc_feature (216)..(216): n is a, c, g, or t
  modified_base (318)..(318): a, c, t, g, unknown or other
  misc_feature (318)..(318): n is a, c, g, or t
  modified_base (337)..(337): a, c, t, g, unknown or other
  misc_feature (337)..(337): n is a, c, g, or t
  modified_base (422)..(422): a, c, t, g, unknown or other
  misc_feature (422)..(422): n is a, c, g, or t
  modified_base (424)..(441): a, c, t, g, unknown or other
  misc_feature (424)..(441): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctccaaaccgaggacacagccgtctatttcngtaccacacacatgagtgggagtactacttctactactggggccagggaaccctggtctccgtctcctcggcctccaccaagggcccatcggtcttcccccnggccgccctgctccaggcnccacctccgagagcacagccggccctgggctgcctggtcaaggactctccacgtctactgctgagcgggctggcaggcgcatagnannnnnnnnnnnnnnnnnn

SEQ ID NO: 231815 - DNA, 425 bp, Homo sapiens
  misc_feature: GYAE6OF02GZRHG.31.68.G02.1.454.CMB.1.raw
  modified_base (335)..(335): a, c, t, g, unknown or other
  misc_feature (335)..(335): n is a, c, g, or t
  modified_base (346)..(346): a, c, t, g, unknown or other
  misc_feature (346)..(346): n is a, c, g, or t
  modified_base (350)..(350): a, c, t, g, unknown or other
  misc_feature (350)..(350): n is a, c, g, or t
  modified_base (414)..(414): a, c, t, g, unknown or other
  misc_feature (414)..(414): n is a, c, g, or t
  modified_base (417)..(425): a, c, t, g, unknown or other
  misc_feature (417)..(425): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctccaaaccgaggacacagccgtctatttctgtaccacacacatgagtgggaggtactacttctactactggggccaggaaccctggtctccgtctcctcggcctccaccaaggcccatcggtctccccctggcgccctcgctccaggcncacctcgagancacngccgcccgtggctgcctggtacaacgactactccactctactgctgagcggctggcaggcgcancgnnnnnnnnn

SEQ ID NO: 231816 - DNA, 510 bp, Homo sapiens
  misc_feature: GYAE6OF02I1BGA.31.68.G02.1.454.CMB.1.raw
  modified_base (320)..(320): a, c, t, g, unknown or other
  misc_feature (320)..(320): n is a, c, g, or t
  modified_base (341)..(341): a, c, t, g, unknown or other
  misc_feature (341)..(341): n is a, c, g, or t
  modified_base (343)..(343): a, c, t, g, unknown or other
  misc_feature (343)..(343): n is a, c, g, or t
  modified_base (352)..(352): a, c, t, g, unknown or other
  misc_feature (352)..(352): n is a, c, g, or t
  modified_base (358)..(358): a, c, t, g, unknown or other
  misc_feature (358)..(358): n is a, c, g, or t
  modified_base (470)..(470): a, c, t, g, unknown or other
  misc_feature (470)..(470): n is a, c, g, or t
  modified_base (475)..(510): a, c, t, g, unknown or other
  misc_feature (475)..(510): n is a, c, g, or t
tcagcagtagacgtcacgaccggtgctcgatttagtcgatagtgaagggaaaggggctggaggtgggttgcccgtattaaaagtaaaactgatggtgagacaacagactacgctgcacccgtgaaaggcagattcgccatctcaagagatgattcagagaacacgctgtatctacaaatgaacagcctccaaaccgaggacacagccgtctatttctgtaccacacacatgagtgggacgtactacttctactacgtggggccgagggaaccctgtctcgtctcctcggcctccaccacggccactcgtccttcccccgngccgccctcgcctccgaggcncnccgtcgagngcacgngccggccgtgggctcgccgtcggtacgaacggtactaccttaccgaccgtctaccgtcgaccgttggacgggccggggtctacggggccgaaacgggccgacgtaagtagcngtacnnnnnnnnnnnnnnnnnnnnnnnnnnnnnnnnnnnn

SEQ ID NO: 231817 - DNA, 448 bp, Homo sapiens
  misc_feature: GYAE6OF02HVF9J.31.68.G02.1.454.CMB.1.raw
  modified_base (224)..(224): a, c, t, g, unknown or other
  misc_feature (224)..(224): n is a, c, g, or t
  modified_base (315)..(315): a, c, t, g, unknown or other
  misc_feature (315)..(315): n is a, c, g, or t
  modified_base (331)..(331): a, c, t, g, unknown or other
  misc_feature (331)..(331): n is a, c, g, or t
  modified_base (343)..(343): a, c, t, g, unknown or other
  misc_feature (343)..(343): n is a, c, g, or t
  modified_base (419)..(448): a, c, t, g, unknown or other
  misc_feature (419)..(448): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaaagagatgattcagagaacacgctgtatctacaaatgaacagcctacaaaccgaggacacagccgtctatttctgtaccanacacatgagtgggagtactacttctactactggggccagggaaccctggtctccgtctcctcgcctccacaacggcccatcgtcttccccngccgcctgctccaganccacctcgagancacagcgccctgggctgcctggacaaaggctactccacgtctactgctgagcgggctggcaaggcgacgaagtagnnnnnnnnnnnnnnnnnnnnnnnnnnnnnn

SEQ ID NO: 231818 - DNA, 436 bp, Homo sapiens
  misc_feature: GYAE6OF02HTLZE.31.68.G02.1.454.CMB.1.raw
  modified_base (217)..(217): a, c, t, g, unknown or other
  misc_feature (217)..(217): n is a, c, g, or t
  modified_base (284)..(284): a, c, t, g, unknown or other
  misc_feature (284)..(284): n is a, c, g, or t
  modified_base (324)..(324): a, c, t, g, unknown or other
  misc_feature (324)..(324): n is a, c, g, or t
  modified_base (417)..(436): a, c, t, g, unknown or other
  misc_feature (417)..(436): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctaccaaaccgaggacacagccgtctatttcngtaccacacacatgagtgggagtactacttctactacgtgggccagggaccctggtctccgtctccncgcctccaccaggccatcgtctcccctgcgcctgctcagngccaccgtcgagagcacagccggccctggactcgccttggtacaaggtctactccacgtctactgctgacgcggctggcaagggcacatacgnnnnnnnnnnnnnnnnnnnn

SEQ ID NO: 231819 - DNA, 425 bp, Homo sapiens
  misc_feature: GYAE6OF02GTFVF.31.68.G02.1.454.CMB.1.raw
  modified_base (408)..(408): a, c, t, g, unknown or other
  misc_feature (408)..(408): n is a, c, g, or t
  modified_base (417)..(417): a, c, t, g, unknown or other
  misc_feature (417)..(417): n is a, c, g, or t
  modified_base (420)..(420): a, c, t, g, unknown or other
  misc_feature (420)..(420): n is a, c, g, or t
  modified_base (422)..(425): a, c, t, g, unknown or other
  misc_feature (422)..(425): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagccctaccaaaccgaggacacagccgtctatttctgtaccacacacatgagtgggaggtactacttctactactggggccagggaaccctggtctccgtctcctcggcctccaccaagggcccatccggtcttccccctggccgccctgctccaggcgcacctccgagagcacagcggcctgggctgccctgtcgaggctacttccacgtctactgctgagcggntggcaggcncangnnnn

SEQ ID NO: 231820 - DNA, 595 bp, Homo sapiens
  misc_feature: GYAE6OF02JS1UF.31.68.G02.1.454.CMB.1.raw
  modified_base (164)..(164): a, c, t, g, unknown or other
  misc_feature (164)..(164): n is a, c, g, or t
  modified_base (290)..(290): a, c, t, g, unknown or other
  misc_feature (290)..(290): n is a, c, g, or t
  modified_base (379)..(379): a, c, t, g, unknown or other
  misc_feature (379)..(379): n is a, c, g, or t
  modified_base (409)..(409): a, c, t, g, unknown or other
  misc_feature (409)..(409): n is a, c, g, or t
  modified_base (555)..(555): a, c, t, g, unknown or other
  misc_feature (555)..(555): n is a, c, g, or t
  modified_base (557)..(557): a, c, t, g, unknown or other
  misc_feature (557)..(557): n is a, c, g, or t
  modified_base (559)..(559): a, c, t, g, unknown or other
  misc_feature (559)..(559): n is a, c, g, or t
  modified_base (563)..(564): a, c, t, g, unknown or other
  misc_feature (563)..(564): n is a, c, g, or t
  modified_base (566)..(595): a, c, t, g, unknown or other
  misc_feature (566)..(595): n is a, c, g, or t
tcagcagtagacgtcacgaccggtgctcgatttagtcgatagtgaagggaaaggggcgtggagtgggttgcccgtattaaaagtaaaactagatggtgagacaacagactacgctgcacccgtgaaaggcagattcgccatctcaagagatgattcagagaacncgctgtatcaacaaatgaacagtaccctaccaaaaacccggaggaacactaacggaccgtcttaacttttctacgttaaccaacaaccactatagaggtgggaacgtacttaaccttcgtaatcgnggggtaccagggaaccctggtccacgtcctcgccggcctcccgaccgtaacggcctaacgtccggttcccttcccccgtgaccgtcccngtccgtccaaggcgccaccccgtcgaacgngtacccaccgacggtccccggcccgttcggggtctacccggtccgttaggggacctaaacgggccctttaaccctacccgtacggtaccttgtaccgggcctagggacggtcgggtccgtagggaccgtaacgcggctaagtacgncntncganncnnnnnnnnnnnnnnnnnnnnnnnnnnnnnn

SEQ ID NO: 231821 - DNA, 451 bp, Homo sapiens
  misc_feature: GYAE6OF02GH0O1.31.68.G02.1.454.CMB.1.raw
  modified_base (442)..(451): a, c, t, g, unknown or other
  misc_feature (442)..(451): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctccaaaccgaggacacagccgtctatttctgtaccacacacatgagtgggaggtactacttctactacgtggggccagggaaccctggtctccgtctcctcggcctccaccaagggcccatccggtctcccccgtcggcgccctgcctccaggcgccacctccgagagccacacgccggcccgtggggctcgccgtggtacaaggactaccttccacgtctacctgctgacggcggcgtggcaaggcgactatagnnnnnnnnnn

SEQ ID NO: 231822 - DNA, 643 bp, Homo sapiens
  misc_feature: GYAE6OF02JPSRU.31.68.G02.1.454.CMB.1.raw
  modified_base (162)..(162): a, c, t, g, unknown or other
  misc_feature (162)..(162): n is a, c, g, or t
  modified_base (200)..(200): a, c, t, g, unknown or other
  misc_feature (200)..(200): n is a, c, g, or t
  modified_base (603)..(603): a, c, t, g, unknown or other
  misc_feature (603)..(603): n is a, c, g, or t
  modified_base (606)..(607): a, c, t, g, unknown or other
  misc_feature (606)..(607): n is a, c, g, or t
  modified_base (609)..(620): a, c, t, g, unknown or other
  misc_feature (609)..(620): n is a, c, g, or t
  modified_base (622)..(630): a, c, t, g, unknown or other
  misc_feature (622)..(630): n is a, c, g, or t
  modified_base (632)..(643): a, c, t, g, unknown or other
  misc_feature (632)..(643): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacncgactgtatctaacaaatgaacagcctaccaaaaccgnggacacagccgtacttattctagtacccaacacacatgaggtggggagtaccttacttctactacgtcgggggaccaacgggtaacccctggtcctcccggtccttacccgtcccgggcctaccccgtaaccggaaaccggggtccccctacggttcccgggttcccccgtttacccccccggtcgggcccccggtcccccttcggtaccccgtaccggtaacggggaccgtacccgtacccccgtacccgggaaggtaccgacccgaaccgaccggcccgggtcccggtcgggacgttcggacccgttggaccgaaacgggtaccttaccgtttcccgaaccgttcctaaccgtcgtaccgtggacgggtccgggactcggggaccaaggtccgagacgtangcnncnnnnnnnnnnnncnnnnnnnnncnnnnnnnnnnnn

SEQ ID NO: 231823 - DNA, 177 bp, Homo sapiens
  misc_feature: GYAE6OF02HJQQV.31.68.G02.1.454.CMB.1.raw
  modified_base (128)..(128): a, c, t, g, unknown or other
  misc_feature (128)..(128): n is a, c, g, or t
  modified_base (141)..(141): a, c, t, g, unknown or other
  misc_feature (141)..(141): n is a, c, g, or t
  modified_base (146)..(146): a, c, t, g, unknown or other
  misc_feature (146)..(146): n is a, c, g, or t
  modified_base (151)..(151): a, c, t, g, unknown or other
  misc_feature (151)..(151): n is a, c, g, or t
  modified_base (155)..(155): a, c, t, g, unknown or other
  misc_feature (155)..(155): n is a, c, g, or t
  modified_base (162)..(162): a, c, t, g, unknown or other
  misc_feature (162)..(162): n is a, c, g, or t
  modified_base (166)..(177): a, c, t, g, unknown or other
  misc_feature (166)..(177): n is a, c, g, or t
tcagcagtagacgtcacgaccggtgctcgatttagtcgatagtgaagggaaaggggctggagtgggttgcccgtattaaaagtaaaactgatggtagagacaacagactacgctgcaccgtgaaaggnagattcgcatctnaagantgatnaganaacacgntgtnnnnnnnnnnnn

SEQ ID NO: 231824 - DNA, 553 bp, Homo sapiens
  misc_feature: GYAE6OF02HHHOP.31.68.G02.1.454.CMB.1.raw
  modified_base (517)..(517): a, c, t, g, unknown or other
  misc_feature (517)..(517): n is a, c, g, or t
  modified_base (520)..(553): a, c, t, g, unknown or other
  misc_feature (520)..(553): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctaccaaaccgaggacacagccgtctattctgtaccacacacatgagtgggagtactacttctactacgtggggccacgggaaccctggtcctccgtctcctcggcctccaccgaacgggccccagtccggttcccttccccccgtggcccgccccgtcggcctcccgacgggacgccgaccctccggagacgcacgacggcccggcccgtggggtcctcgtcccgtaggtaccgaaaggtacctttaacccgttcccgacgttaccttacgtcggtaccgtgggacggtcccggggtcgtcgggaccgaaaggggccaggtaacgtagacnagnnnnnnnnnnnnnnnnnnnnnnnnnnnnnnnnnn

SEQ ID NO: 231825 - DNA, 423 bp, Homo sapiens
  misc_feature: GYAE6OF02FMAJU.31.68.G02.1.454.CMB.1.raw
  modified_base (318)..(318): a, c, t, g, unknown or other
  misc_feature (318)..(318): n is a, c, g, or t
  modified_base (330)..(330): a, c, t, g, unknown or other
  misc_feature (330)..(330): n is a, c, g, or t
  modified_base (342)..(342): a, c, t, g, unknown or other
  misc_feature (342)..(342): n is a, c, g, or t
  modified_base (417)..(423): a, c, t, g, unknown or other
  misc_feature (417)..(423): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctccaaaccgaggacacagccgtctatttctgtaccacacacatgagtgggaggtactacttctactactggggccagggaaccctggtctccgtctcctcggcctccaccaggcccatcgtctcccctggcncctgctccaggncacctccgagancacagcggccctgggctgcctggtcaaggactacttccacgtctactgctgacgcgggctggcaaggcgcatagnnnnnnn

SEQ ID NO: 231826 - DNA, 503 bp, Homo sapiens
  misc_feature: GYAE6OF02IT3ZE.31.68.G02.1.454.CMB.1.raw
  modified_base (338)..(338): a, c, t, g, unknown or other
  misc_feature (338)..(338): n is a, c, g, or t
  modified_base (344)..(344): a, c, t, g, unknown or other
  misc_feature (344)..(344): n is a, c, g, or t
  modified_base (362)..(362): a, c, t, g, unknown or other
  misc_feature (362)..(362): n is a, c, g, or t
  modified_base (376)..(376): a, c, t, g, unknown or other
  misc_feature (376)..(376): n is a, c, g, or t
  modified_base (381)..(381): a, c, t, g, unknown or other
  misc_feature (381)..(381): n is a, c, g, or t
  modified_base (434)..(434): a, c, t, g, unknown or other
  misc_feature (434)..(434): n is a, c, g, or t
  modified_base (449)..(449): a, c, t, g, unknown or other
  misc_feature (449)..(449): n is a, c, g, or t
  modified_base (461)..(461): a, c, t, g, unknown or other
  misc_feature (461)..(461): n is a, c, g, or t
  modified_base (467)..(503): a, c, t, g, unknown or other
  misc_feature (467)..(503): n is a, c, g, or t
tcagcagtagacgtcacgaccggtgctcgatttagtcgatagtgaagggaaagggggctggagtgggttgcccgtattaaaaagtaaaactgatggtgagacaacagactacgctgcacccgtgaaagcagattcgccatctcaagagatgattcagagaacacgctgtatctaacaaatgaacagccctaccaaaaccgagacacacgcgtctatttcagtaccacacacatgagtgggagtactacttctactacgtgggaccacgggaaccctggtcctccgtctcccgtcggccctccaacccgaagggcccctagtccggtcccttcccccgnggtccncccctgcctccgaggacnccaacctcgagacncaacncggccgcccgtgggccacgccgtaggtacaaaggtcctactccgacgtctacngcctaggcgcggtcnggacaaggcganatagcnnnnnnnnnnnnnnnnnnnnnnnnnnnnnnnnnnnnn

SEQ ID NO: 231827 - DNA, 537 bp, Homo sapiens
  misc_feature: GYAE6OF02FFPJ1.31.68.G02.1.454.CMB.1.raw
  modified_base (158)..(158): a, c, t, g, unknown or other
  misc_feature (158)..(158): n is a, c, g, or t
  modified_base (201)..(201): a, c, t, g, unknown or other
  misc_feature (201)..(201): n is a, c, g, or t
  modified_base (214)..(214): a, c, t, g, unknown or other
  misc_feature (214)..(214): n is a, c, g, or t
  modified_base (463)..(463): a, c, t, g, unknown or other
  misc_feature (463)..(463): n is a, c, g, or t
  modified_base (491)..(491): a, c, t, g, unknown or other
  misc_feature (491)..(491): n is a, c, g, or t
  modified_base (495)..(499): a, c, t, g, unknown or other
  misc_feature (495)..(499): n is a, c, g, or t
  modified_base (503)..(503): a, c, t, g, unknown or other
  misc_feature (503)..(503): n is a, c, g, or t
  modified_base (506)..(507): a, c, t, g, unknown or other
  misc_feature (506)..(507): n is a, c, g, or t
  modified_base (510)..(511): a, c, t, g, unknown or other
  misc_feature (510)..(511): n is a, c, g, or t
  modified_base (513)..(514): a, c, t, g, unknown or other
  misc_feature (513)..(514): n is a, c, g, or t
  modified_base (516)..(516): a, c, t, g, unknown or other
  misc_feature (516)..(516): n is a, c, g, or t
  modified_base (518)..(537): a, c, t, g, unknown or other
  misc_feature (518)..(537): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcaganaacacgtctgtaatctaacaaatgaacagcctccaaaaaccgnggacacagccgtntatttcgagtaccacacacatgaggtggagtactacgttctactacgtggggacccagggaaccctggtctcccggtctccgttcggcctcccaaccgtaacgggccccagtccggtcccttacccccgtggcccgtccctgtcctccgaaggtacgccaccgttccgagtacgccaacgtacgccgggaccctgggggacctcggtcccgtagggtaccaacgggtactacccgttccgacgtctacngcgtagacgcggctggcaggccacgtanacgnnnnncacntgnntanngnntngnnnnnnnnnnnnnnnnnnnn

SEQ ID NO: 231828 - DNA, 442 bp, Homo sapiens
  misc_feature: GYAE6OF02FMF6F.31.68.G02.1.454.CMB.1.raw
  modified_base (434)..(442): a, c, t, g, unknown or other
  misc_feature (434)..(442): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctccaaaaccgaggacacagccgtctatttctgtaccacacacatgagtgggagtactacttctactactggggccagggaaccctggtctccgtctcctcggcctccaccaagggcccatccggtcctcccccgtggccgccctgcctccgaggcgccacctccgagagcacagccggccctggggctgccgtggtacaacggactacctcgacgtctactgctgagcgggctggcaaggcgcatagnnnnnnnnn

SEQ ID NO: 231829 - DNA, 468 bp, Homo sapiens
  misc_feature: GYAE6OF02GQ5LU.31.68.G02.1.454.CMB.1.raw
  modified_base (194)..(194): a, c, t, g, unknown or other
  misc_feature (194)..(194): n is a, c, g, or t
  modified_base (332)..(332): a, c, t, g, unknown or other
  misc_feature (332)..(332): n is a, c, g, or t
  modified_base (364)..(364): a, c, t, g, unknown or other
  misc_feature (364)..(364): n is a, c, g, or t
  modified_base (431)..(432): a, c, t, g, unknown or other
  misc_feature (431)..(432): n is a, c, g, or t
  modified_base (434)..(468): a, c, t, g, unknown or other
  misc_feature (434)..(468): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacagctgtatctacaaatgaacagcctcaaaccgnggacacagccgtctatttctgtaccacacacatgagtgggagtactacttctactactggggccagggaaccctggtctcgtctcctcggcctccaccagggcccatcggtctcccctggccgccctgcctccaggancacctcgagacgccacagccggccctggggcngcctggtcaaaggactaacgttccacggtctactgctgagtcgggctgggccaaaggcgcaagtagnngnnnnnnnnnnnnnnnnnnnnnnnnnnnnnnnnnnn

SEQ ID NO: 231830 - DNA, 681 bp, Homo sapiens
  misc_feature: GYAE6OF02G963H.31.68.G02.1.454.CMB.1.raw
  modified_base (583)..(583): a, c, t, g, unknown or other
  misc_feature (583)..(583): n is a, c, g, or t
  modified_base (592)..(592): a, c, t, g, unknown or other
  misc_feature (592)..(592): n is a, c, g, or t
  modified_base (636)..(636): a, c, t, g, unknown or other
  misc_feature (636)..(636): n is a, c, g, or t
  modified_base (639)..(643): a, c, t, g, unknown or other
  misc_feature (639)..(643): n is a, c, g, or t
  modified_base (645)..(646): a, c, t, g, unknown or other
  misc_feature (645)..(646): n is a, c, g, or t
  modified_base (652)..(654): a, c, t, g, unknown or other
  misc_feature (652)..(654): n is a, c, g, or t
  modified_base (656)..(656): a, c, t, g, unknown or other
  misc_feature (656)..(656): n is a, c, g, or t
  modified_base (658)..(658): a, c, t, g, unknown or other
  misc_feature (658)..(658): n is a, c, g, or t
  modified_base (660)..(662): a, c, t, g, unknown or other
  misc_feature (660)..(662): n is a, c, g, or t
  modified_base (664)..(664): a, c, t, g, unknown or other
  misc_feature (664)..(664): n is a, c, g, or t
  modified_base (666)..(676): a, c, t, g, unknown or other
  misc_feature (666)..(676): n is a, c, g, or t
  modified_base (678)..(681): a, c, t, g, unknown or other
  misc_feature (678)..(681): n is a, c, g, or t
tcagcagtagacgtcacgaccggtgctcgatttagtcgatagtgaagggaaagggggctggagtgggttgcccgtattaaaagtaaaactgatggtggagacaacagactacgctgccacccggtagaaacggcagtacttccgaccattctacaaaggagtatgtacttcggaagaacgaacacgtctgtactcctaaacaaatacgaaccactaccctaacccgaaaccgaacggaccacgacgtcccgttacttacttttcgtcgtaacccaacaacactagtggtacggtagggggaacgttaacttaccttacgttaactacgggtcggggaccggtaacgggtacccggttcgtccgttccgttcccttcccgtccggccctacccgaaccggaccggtcctacgttccggttcccctccccggtcggcccgtccctcgtcccgaccggtacggcgcccgtacccgtaccggaacggaccgaccaacgggtccggcccgggtacccgggtcgggcgtccggtaccgttacggaccgtaacgggttaccttacccttaccgtaaccgttctacggtcncggtacggnggtccggggcttcgggacggtaacgggcttacgacgttagcgtnctnnnnngnngcgcgnnngngncnnngngnnnnnnnnnnncnnnn

SEQ ID NO: 231831 - DNA, 528 bp, Homo sapiens
  misc_feature: GYAE6OF02GXX3A.31.68.G02.1.454.CMB.1.raw
  modified_base (329)..(329): a, c, t, g, unknown or other
  misc_feature (329)..(329): n is a, c, g, or t
  modified_base (349)..(349): a, c, t, g, unknown or other
  misc_feature (349)..(349): n is a, c, g, or t
  modified_base (485)..(486): a, c, t, g, unknown or other
  misc_feature (485)..(486): n is a, c, g, or t
  modified_base (489)..(490): a, c, t, g, unknown or other
  misc_feature (489)..(490): n is a, c, g, or t
  modified_base (498)..(498): a, c, t, g, unknown or other
  misc_feature (498)..(498): n is a, c, g, or t
  modified_base (500)..(508): a, c, t, g, unknown or other
  misc_feature (500)..(508): n is a, c, g, or t
  modified_base (510)..(528): a, c, t, g, unknown or other
  misc_feature (510)..(528): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacagcctacaaaccgaggacacagccgtctatttctgtaccacacacatgagtgggagtactactctactcgtgggccagggaaccctggtctccgtctccgtccggcctcccaccaacgggccccaagttcccggtccttccccccgnggccgccctgcctccaggcnccacccgtccgagacgaccacgacggccggtcccgtcggggctcggcccttggacgaacggtacctccgttacccacgttctacctcgtccgtggacggccgggacgtacgggaccgaagggccgacgagtacgcnncanntcgcagcncnnnnnnnnngnnnnnnnnnnnnnnnnnnn

SEQ ID NO: 231832 - DNA, 662 bp, Homo sapiens
  misc_feature: GYAE6OF02I3630.31.68.G02.1.454.CMB.1.raw
  modified_base (215)..(215): a, c, t, g, unknown or other
  misc_feature (215)..(215): n is a, c, g, or t
  modified_base (222)..(222): a, c, t, g, unknown or other
  misc_feature (222)..(222): n is a, c, g, or t
  modified_base (553)..(553): a, c, t, g, unknown or other
  misc_feature (553)..(553): n is a, c, g, or t
  modified_base (608)..(608): a, c, t, g, unknown or other
  misc_feature (608)..(608): n is a, c, g, or t
  modified_base (613)..(613): a, c, t, g, unknown or other
  misc_feature (613)..(613): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacagctagtatctaacaaatgaacagcctacaaacgaggacacagccgtctattcngtaccanacacatagagtcgggaagtactacttctactacgtcggggaccaagggtaccctaggtccgttccgtacgtccgttacggacccttcccaaccgaaagggccccaagtccggttaccttcccccgtggccgtacccctgaccttaccgacggtacgccaccgttaccggagacgtacaccgacgaccggtcccgtggggcctaggtcccgtaggttaccgaaacgggtaacctaccgtttacccgaaccgttacgtttaaacctcggtaccgtacgtacggtaccgggtaccgttacgggaccgtaaacgggcgtaacgtaactacggtanacgttgacacgtatagcgtagacgcgacacgtcgtatgcgtagacgatagtacgngtacngtgtacgcgtacgtacgtagtacgtactacgacgtacgtacgacgttcg

SEQ ID NO: 231833 - DNA, 505 bp, Homo sapiens
  misc_feature: GYAE6OF02H07VP.31.68.G02.1.454.CMB.1.raw
  modified_base (211)..(211): a, c, t, g, unknown or other
  misc_feature (211)..(211): n is a, c, g, or t
  modified_base (346)..(346): a, c, t, g, unknown or other
  misc_feature (346)..(346): n is a, c, g, or t
  modified_base (467)..(468): a, c, t, g, unknown or other
  misc_feature (467)..(468): n is a, c, g, or t
  modified_base (471)..(505): a, c, t, g, unknown or other
  misc_feature (471)..(505): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctaacaaatgaacagccctaccaaaccgagacacagccgtntatttctgtaccacacgacatgagtggggagtactacttctactacgtggggccagggaaccctggtctccgtctcctcggcctccaccgacggcccagtcgtcccttccccgtggccgcctgcctccgaggacnccacctccgagacgcactacggccggcccgtgggacctcgcctggacaacggtcctacttccacgttcctacgtcgctaggacggtcgggtaccgtggaccgaacgggcacgtatacgganngtnnnnnnnnnnnnnnnnnnnnnnnnnnnnnnnnnnn

SEQ ID NO: 231834 - DNA, 845 bp, Homo sapiens
  misc_feature: GYAE6OF02HUUWY.31.68.G02.1.454.CMB.1.raw
  modified_base (736)..(736): a, c, t, g, unknown or other
  misc_feature (736)..(736): n is a, c, g, or t
  modified_base (743)..(743): a, c, t, g, unknown or other
  misc_feature (743)..(743): n is a, c, g, or t
  modified_base (761)..(761): a, c, t, g, unknown or other
  misc_feature (761)..(761): n is a, c, g, or t
  modified_base (789)..(789): a, c, t, g, unknown or other
  misc_feature (789)..(789): n is a, c, g, or t
tcagcagtagacgtcacgaccggtgctcgatttagtcgatagtgaagggaaagggctggagtgggttgcccgtattaaaagtaaaactgatggtgagacaacagactacgctgccacccgtgaaaggcagattcgccatctcaagagatgattcagaagtaacacgctagtatacgtaacaaatcgaaactacgaccctaccaaaaccggaggaacacgacgaccgttcttaatttcctacgtaccaactacaacgtagtggtaggtacgggtaacgtaactacttccgtacgtacggcggggtaccacgggtaaccccttggtaccttaccggtccttcccgtaccggaccccgttacccgaaacccgtaaacgggtacccctaacgtaccccggtttaccccgttacccccccggtgggttaccccgtccccgttaaccgggtacccttaccccggaacgggtaaccggtacccgtaaaaccccgttacccggaacggtaaaccggaccgaaacccggtacgggtaccccggtacccggtacggggggaacccttaccggtacccgggtttaaacgggttaacccgaaaaccgggttaccgttaaccccgtttacccggttaaccccgtttaaccggttacgtaaccggttacggtaaccgggtaacggtaccggggtacgttaacggggaccgaaaacgggtaccgtacgttaaacgacgacccaattcgganacggtanccggaattgacctagtanacgtgacacggtacacgtacgacacgtntacgacgtacgagagacgacgtacgcgtacgtactacgtacgtactacgacgtacg

SEQ ID NO: 231835 - DNA, 525 bp, Homo sapiens
  misc_feature: GYAE6OF02JYNVI.31.68.G02.1.454.CMB.1.raw
  modified_base (202)..(202): a, c, t, g, unknown or other
  misc_feature (202)..(202): n is a, c, g, or t
  modified_base (338)..(338): a, c, t, g, unknown or other
  misc_feature (338)..(338): n is a, c, g, or t
  modified_base (448)..(448): a, c, t, g, unknown or other
  misc_feature (448)..(448): n is a, c, g, or t
  modified_base (481)..(481): a, c, t, g, unknown or other
  misc_feature (481)..(481): n is a, c, g, or t
  modified_base (486)..(486): a, c, t, g, unknown or other
  misc_feature (486)..(486): n is a, c, g, or t
  modified_base (488)..(488): a, c, t, g, unknown or other
  misc_feature (488)..(488): n is a, c, g, or t
  modified_base (490)..(525): a, c, t, g, unknown or other
  misc_feature (490)..(525): n is a, c, g, or t
tcagcagtagacgtcacgaccggtgctcgatttagtcgatagtgaagggaaggggctggagtgggttgcccgtattaaaagtaaactgatggtgagacaacagactacgctgcacccgtgaaaggcagattcgccatctcaagagatcgattcagagaacagctgtatctacaaatgaacagcctaccaaacgaggacacanccgtctatttctgtaccacacacatgagtgggagtactacttacactacgtgggacctacggaacctgtctccgtctcctcggtccctaccaccgtacggcccacgtccggttccctcccccgtcggccgtccccncgccgtaccacggacgccacccttaccggacgagccgaactcggccgccgtccggctccggcttcggcgaacggtacctacgtttacccaccgttccgtacgcgtcgagnggcccgggtaggccggacgacggccgtaggacnggacngngnnnnnnnnnnnnnnnnnnnnnnnnnnnnnnnnnnnn

SEQ ID NO: 231836 - DNA, 596 bp, Homo sapiens
  misc_feature: GYAE6OF02IJ9ZS.31.68.G02.1.454.CMB.1.raw
  modified_base (183)..(183): a, c, t, g, unknown or other
  misc_feature (183)..(183): n is a, c, g, or t
  modified_base (554)..(554): a, c, t, g, unknown or other
  misc_feature (554)..(554): n is a, c, g, or t
  modified_base (558)..(558): a, c, t, g, unknown or other
  misc_feature (558)..(558): n is a, c, g, or t
  modified_base (563)..(571): a, c, t, g, unknown or other
  misc_feature (563)..(571): n is a, c, g, or t
  modified_base (573)..(596): a, c, t, g, unknown or other
  misc_feature (573)..(596): n is a, c, g, or t
tcagcagtagacgtcacgaccggtgctcgatttagtcgatagtgaagggaaaggggctggagtgggttgcccgtattaaaagtaaaactgatggtgagacaacagactacgctgcacccgtgaaaggcagattcgccatctcaagagatgattcagagaacacgctgtatctacaaatgaacngcctccaaaccgaggacacagccgtctatttctgtaccacacacatgagtgggagtactacttctactcgtgggaccgagggaaccctggtcctccgtctcctccggcctccaccgaacgggccctagtccggtccttccccccgtggccgccccgtgcctccgacggacgccaacccgtccggaagaccgacaccgacggcccgggtccccggtggggaccttccggtcccgtttacgggtaccgtaaacggggtaccctttaacccgtttaccccgtaaacccggttcccttaacccgttggtacccgttacgggacggggtccggggaccgttcggggacccgtaagggacgtcccgaaagttcggcngtangagcnnnnnnnnncnnnnnnnnnnnnnnnnnnnnnnnn

SEQ ID NO: 231837 - DNA, 622 bp, Homo sapiens
  misc_feature: GYAE6OF02GYI7K.31.68.G02.1.454.CMB.1.raw
  modified_base (159)..(159): a, c, t, g, unknown or other
  misc_feature (159)..(159): n is a, c, g, or t
  modified_base (166)..(166): a, c, t, g, unknown or other
  misc_feature (166)..(166): n is a, c, g, or t
  modified_base (211)..(211): a, c, t, g, unknown or other
  misc_feature (211)..(211): n is a, c, g, or t
  modified_base (227)..(227): a, c, t, g, unknown or other
  misc_feature (227)..(227): n is a, c, g, or t
  modified_base (253)..(253): a, c, t, g, unknown or other
  misc_feature (253)..(253): n is a, c, g, or t
  modified_base (538)..(538): a, c, t, g, unknown or other
  misc_feature (538)..(538): n is a, c, g, or t
  modified_base (560)..(560): a, c, t, g, unknown or other
  misc_feature (560)..(560): n is a, c, g, or t
  modified_base (573)..(573): a, c, t, g, unknown or other
  misc_feature (573)..(573): n is a, c, g, or t
  modified_base (576)..(576): a, c, t, g, unknown or other
  misc_feature (576)..(576): n is a, c, g, or t
  modified_base (578)..(578): a, c, t, g, unknown or other
  misc_feature (578)..(578): n is a, c, g, or t
  modified_base (581)..(581): a, c, t, g, unknown or other
  misc_feature (581)..(581): n is a, c, g, or t
  modified_base (583)..(583): a, c, t, g, unknown or other
  misc_feature (583)..(583): n is a, c, g, or t
  modified_base (586)..(586): a, c, t, g, unknown or other
  misc_feature (586)..(586): n is a, c, g, or t
  modified_base (590)..(590): a, c, t, g, unknown or other
  misc_feature (590)..(590): n is a, c, g, or t
  modified_base (593)..(593): a, c, t, g, unknown or other
  misc_feature (593)..(593): n is a, c, g, or t
  modified_base (598)..(599): a, c, t, g, unknown or other
  misc_feature (598)..(599): n is a, c, g, or t
  modified_base (601)..(622): a, c, t, g, unknown or other
  misc_feature (601)..(622): n is a, c, g, or t
tcagcagtagacgtcacgaccggtgctcgatttagtcgatagtgaagggaaagggggcgtggagtgggttgcccgtattaaaagtaaaactgatggtgagacaacagactacgctgccacccgtgaaaggcagattcgcatctcaagagatgattcganagaaccncggtctgtactctaacaaatggaaaccgaccctacccaaaccggnggaccacaggcccttntactttcacgtacccaacacactagngaggtacgggtaacttaccgttacttccgtaaaccgtaggtccgggggaaccctaacggggtaacccttcggttacctcccgttccttccggtaccggtccctacccgaccggaaccggcccctacgttcccggttccccgttacccccgtgggtcccccgtccccgtacggcccgttaacccgagggtaccgtccccacccgtacggacgaaccggccaacgtcggggacccggtccgtggggtctcgtaccgggttcgaacgacggttacctaacccgttccngtcctactgcgacggagtcggngtagaccgaggcnganancantngcngcanctnacgtnncnnnnnnnnnnnnnnnnnnnnnn

SEQ ID NO: 231838 - DNA, 250 bp, Homo sapiens
  misc_feature: GYAE6OF01ATWMT.38.34.D01.1.454.CMB.1.raw
  modified_base (246)..(250): a, c, t, g, unknown or other
  misc_feature (246)..(250): n is a, c, g, or t
tcagtcgatcacgtcacgaccggtgctcgatttagatcgtctgtgttgggtttgggtgccgaagttgctggaggtcacggtcaccacgctgctgagggagtagagtcctgaggactgtaggacagcccatcggtcttcccctggcgcactgctccaggagcacctccgagagcacagcggccctgggctgcctggtcaaggactacttccacgtgatcgactgagcgggctggcaaggcgcatagnnnnn

SEQ ID NO: 231839 - DNA, 264 bp, Homo sapiens
  misc_feature: GYAE6OF01B81XS.38.34.D01.1.454.CMB.1.raw
  modified_base (241)..(241): a, c, t, g, unknown or other
  misc_feature (241)..(241): n is a, c, g, or t
  modified_base (247)..(264): a, c, t, g, unknown or other
  misc_feature (247)..(264): n is a, c, g, or t
tcagtcgatcacgtcacgaccggtgctcgatttagatcgtctgtgttggggtttgggtgccgaagttgctggaggtcacggtcaccacgctgctgagggagtagagtcctgaggactgtaggacagcccatcggtcttcccctggcgcactgctccaggagcacctcgagagcacagcggccctgggctgcctggtcaaggactacttcacgtgatcgactgagcgggctggacaagggcncatagnnnnnnnnnnnnnnnnnn

SEQ ID NO: 231840 - DNA, 250 bp, Homo sapiens
  misc_feature: GYAE6OF01CJZAW.38.34.D01.1.454.CMB.1.raw
  modified_base (239)..(239): a, c, t, g, unknown or other
  misc_feature (239)..(239): n is a, c, g, or t
  modified_base (245)..(250): a, c, t, g, unknown or other
  misc_feature (245)..(250): n is a, c, g, or t
tcagtcgatcacgtcacgaccggtgctcgatttagatcgtctgtgttgggtttgggagaggcgggtggcattttgactactggggccagggaaccctggtcaccgtctcctcagcctccaccaaggcccatcggtcttcccctggcgccctgctccaggagcacctccgagagcacagcggccctgggctgcctggtcaaggctacttccagtgatcgactgagcgggctggcaaggcncatagnnnnnn

SEQ ID NO: 231841 - DNA, 279 bp, Homo sapiens
  misc_feature: GYAE6OF01ETD3R.38.34.D01.1.454.CMB.1.raw
  modified_base (243)..(243): a, c, t, g, unknown or other
  misc_feature (243)..(243): n is a, c, g, or t
  modified_base (249)..(279): a, c, t, g, unknown or other
  misc_feature (249)..(279): n is a, c, g, or t
tcagtcgatcacgtcacgaccggtgctcgatttagatcgtctgtgttggggtttgggtgccgaagttgctgggaggtcacggtcaccacgctgctgagggagtagagtcctgaggactgtaggacagcccatcggtcttccccctggcgcactgctccaggagcacctccgagagcacagcggccctgggctgcctggtcaaggactacttccacgtgatcgactgagcgggctggcaaggcncatagnnnnnnnnnnnnnnnnnnnnnnnnnnnnnnn

SEQ ID NO: 231842 - DNA, 269 bp, Homo sapiens
  misc_feature: GYAE6OF01CI4NU.38.34.D01.1.454.CMB.1.raw
  modified_base (162)..(162): a, c, t, g, unknown or other
  misc_feature (162)..(162): n is a, c, g, or t
  modified_base (232)..(232): a, c, t, g, unknown or other
  misc_feature (232)..(232): n is a, c, g, or t
  modified_base (248)..(269): a, c, t, g, unknown or other
  misc_feature (248)..(269): n is a, c, g, or t
tcagtcgatcacgtcacgaccggtgctcgatttagatcgtctgtgttgggtttgggagaggcgggtggcattttgactactggggccagggaaccctggtcaccgtctcctcagcctccaccaaggcccatcggtcttcccctggccgccctgctccagganccacctccgagagcacagcggcccgtgggctgcctggtcaaggctacttccagtgatcgactgacgcggntggacgagcgcatagnnnnnnnnnnnnnnnnnnnnnn

SEQ ID NO: 231843 - DNA, 302 bp, Homo sapiens
  misc_feature: GYAE6OF01E3P6S.38.34.D01.1.454.CMB.1.raw
  modified_base (237)..(237): a, c, t, g, unknown or other
  misc_feature (237)..(237): n is a, c, g, or t
  modified_base (251)..(258): a, c, t, g, unknown or other
  misc_feature (251)..(258): n is a, c, g, or t
  modified_base (260)..(302): a, c, t, g, unknown or other
  misc_feature (260)..(302): n is a, c, g, or t
tcagtcgatcacgtcacgaccggtgctcgatttagatcgtctgtgttgggtttgggagaggcgggtggcattttgatactggggccagggaaccctggtcaccgtctcctcagcctccacctaagggcccatcggtctccccctggcgcccctgctccaggagcacctccgagagcacagcggccctgggctgcctggtcaaggactacttccgagtgatcgactgagcgggctggnaacggcgcagtagnnnnnnnntnnnnnnnnnnnnnnnnnnnnnnnnnnnnnnnnnnnnnnnnnnn

SEQ ID NO: 231844 - DNA, 334 bp, Homo sapiens
  misc_feature: GYAE6OF01AJYGT.38.34.D01.1.454.CMB.1.raw
  modified_base (176)..(176): a, c, t, g, unknown or other
  misc_feature (176)..(176): n is a, c, g, or t
  modified_base (286)..(286): a, c, t, g, unknown or other
  misc_feature (286)..(286): n is a, c, g, or t
  modified_base (290)..(290): a, c, t, g, unknown or other
  misc_feature (290)..(290): n is a, c, g, or t
  modified_base (292)..(292): a, c, t, g, unknown or other
  misc_feature (292)..(292): n is a, c, g, or t
  modified_base (295)..(334): a, c, t, g, unknown or other
  misc_feature (295)..(334): n is a, c, g, or t
tcagtcgatcacgtcacgaccggtgctcgatttagatcgtctgtgttgggtttgggagaggcgggtggctattttgactactggggccagggaaccctggtcaccgtctccctcacgcctccaccaagggcccatcggtccttccccctggccgaccccttcgcctaccgaaggcnccaccgtcggagcacgacgtcgcggccctggcctggacctgggtaactaacggtccttaacttccgtaagtcgtatccggagcgggagtcgggactaggaccgagactanagcngngcnnnnnnnnnnnnnnnnnnnnnnnnnnnnnnnnnnnnnnnn

SEQ ID NO: 231845 - DNA, 309 bp, Homo sapiens
  misc_feature: GYAE6OF02JY3F4.38.34.D01.1.454.CMB.1.raw
  modified_base (257)..(309): a, c, t, g, unknown or other
  misc_feature (257)..(309): n is a, c, g, or t
tcagtcgatcacgtcacgaccggtgctcgatttagatcgtctgtgttggggtttgggtgccgaagttcgctggaggtcacggtcaccacgctgctgacgggagtagagtccctgaggactgtaggacagcccatcgggtcttccccctggcgtcacgtgctccaggagccacctcgagacgcacagcggccctgggctgcctggtcaaggactacttccgagtgatcgactgacgcgggctggcaaggcgcatacgnnnnnnnnnnnnnnnnnnnnnnnnnnnnnnnnnnnnnnnnnnnnnnnnnnnnn

SEQ ID NO: 231846 - DNA, 249 bp, Homo sapiens
  misc_feature: GYAE6OF02FENFN.38.34.D01.1.454.CMB.1.raw
  modified_base (248)..(249): a, c, t, g, unknown or other
  misc_feature (248)..(249): n is a, c, g, or t
tcagtcgatcacgtcacgaccggtgctcgatttagatcgtctgtgttgggtttgggagaggcgggtggcatttgactactggggccagggaaccctggtcaccgtctcctcagcctccaccaagggcccatcggtcttccccctggcgccctgctccaggagcacctccgagagcacagcggccctgggctgcctggtcaaggactacttccacgtgatcgactgagcgggctggcaaggcgcatagnn

SEQ ID NO: 231847 - DNA, 523 bp, Homo sapiens
  misc_feature: GYAE6OF01BPC7S.14.68.G02.1.454.CMB.1.raw
  modified_base (516)..(523): a, c, t, g, unknown or other
  misc_feature (516)..(523): n is a, c, g, or t
tcagcgtctagtaccacgaccggtgctcgatttagtcgatagtgaagggaaagggtgtacacctgtggttctcactcaccgatggtcgattgggtgtgagctggatccgtcagtccccagggaaggccctggagtggcttgcacacatgtattggaatgacgaaaaatcgtacaggaaatctctgcagagcaggctcatcatctccagggacacatccaaaagccaggtggtccttaccatgaccaacatggaccctgtggacacagccacatattactgtgcacggatcgtttattattacggttcggggagctccaagcttgactactggggccagggaaccctggtcaccgtctcctcagcctccaccacggcccatcgtccttccccctggccaccctcctcccaacgagccaccctcgtcgggggcaccgagccggccctgggcctgcccgtggtcaaggacctacttcccgtacgtacgacgctgagcggctggacaagggccgcatagnnnnnnnn

SEQ ID NO: 231848 - DNA, 508 bp, Homo sapiens
  misc_feature: GYAE6OF01B1Y9H.14.68.G02.1.454.CMB.1.raw
  modified_base (499)..(508): a, c, t, g, unknown or other
  misc_feature (499)..(508): n is a, c, g, or t
tcagcgtctagtaccacgaccggtgctcgatttagtcgatagtgaagggaaagggtgtacacctgtggttctcactcaccgatggtcgattgggtgtgagctggatccgtcagtccccagggaaggccctggagtggcttgcacacatgtattggaatgacgaaaaatcgtacaggaaatctctgcagagcaggctcatcatctccagggacacatccaaaagccaggtggtccttaccatgaccaacatggaccctgtggacacagccacatattactgtgcacggatcgtttattattacggttcgggagctccaagcttgactactggggccagggaaccctggtcaccgtctcctcagcctccaccaagggcccatcggtccttccccctggccaccctcctcccaagacgcaccctctggggccacagcggccctggctgcctggtcagactactccgtactagacgctgacgcggctggcaaggcgcataggnnnnnnnnnn

SEQ ID NO: 231849 - DNA, 626 bp, Homo sapiens
  misc_feature: GYAE6OF01AN0E4.14.68.G02.1.454.CMB.1.raw
  modified_base (610)..(610): a, c, t, g, unknown or other
  misc_feature (610)..(610): n is a, c, g, or t
  modified_base (619)..(622): a, c, t, g, unknown or other
  misc_feature (619)..(622): n is a, c, g, or t
  modified_base (624)..(624): a, c, t, g, unknown or other
  misc_feature (624)..(624): n is a, c, g, or t
  modified_base (626)..(626): a, c, t, g, unknown or other
  misc_feature (626)..(626): n is a, c, g, or t
tcagcgtctagtaccacgaccggtgctcgatttagtcgatagtgaagggaaagggtgtacacctgtggttctcactcaccgatggtcgattgggtgtgagctggatccgtcagtccccagggaaggccctggagtggcttgcacacatgtattggaatgacgaaaaatcgtacaggaaatctctgcagagcaggctcatcatctccagggacacataccaaaagccaggtggtccttaccatcgaccaacatcggaccctgtggacacagccacatattactgtgcacggtattacgttttattagttaccgggttcggggagcctaccgaagtcttgacgtacgtcggggaccacgggtaaccctcgggtccacccgttctcctccgacgccctaccaaccgacgggccctaagttccggttcccttcccccgtggccctacccctccctacccaacgccgacctacccgtcggtcggggcctaccgaccggccggcccgtcgggccgtcgtccgtacggtacgaaccgtaccttaccgttccgtaaccgtacggccgtcgtaggccggtccgggcggtacggaccggaacggtccgacgtagtacggnactgatcgnnnngngn

SEQ ID NO: 231850 - DNA, 612 bp, Homo sapiens
  misc_feature: GYAE6OF01CP7TG.14.68.G02.1.454.CMB.1.raw
  modified_base (322)..(322): a, c, t, g, unknown or other
  misc_feature (322)..(322): n is a, c, g, or t
  modified_base (420)..(420): a, c, t, g, unknown or other
  misc_feature (420)..(420): n is a, c, g, or t
  modified_base (603)..(603): a, c, t, g, unknown or other
  misc_feature (603)..(603): n is a, c, g, or t
  modified_base (606)..(612): a, c, t, g, unknown or other
  misc_feature (606)..(612): n is a, c, g, or t
tcagcgtctagtaccacgaccggtgctcgatttagtcgatagtgaagggaaagggtgtacacctgtggttctcactcaccgatggtcgattgggtgtgagctggatccgtcagtccccagggaaggccctggagtggcttgcacacatgtattggaatgacgaaaaatcgtacaaggaaatctctgcagagcaggctcatcatctccagggacacataccaaaagccaggtcggtccttaccatcgaccaacatcggaccctgtggacacagccacatatactgtgcacggtattcgtttatttagttacgggttcgggganctccaacgcttgactacgtggggaccacgggaccctggtccaccgtcctcctcgacgcctccgaccgaacgggccctagtcccggtcctttcccccgnggcccacccctccctacccgaacgcgacccgtaccctccggtcgggggtaccaacgaccgggtcccgggccccgttagggcccgttcggtcccgtcgggtaccgaacggtaaccttacccgttaccgtaaccgtacgaccgtacgtgcgggtccgggcgtcggaccgacgggcgctagtacgncgnnnnnnn

SEQ ID NO: 231851 - DNA, 576 bp, Homo sapiens
  misc_feature: GYAE6OF02G0M9B.14.68.G02.1.454.CMB.1.raw
  modified_base (565)..(565): a, c, t, g, unknown or other
  misc_feature (565)..(565): n is a, c, g, or t
  modified_base (567)..(567): a, c, t, g, unknown or other
  misc_feature (567)..(567): n is a, c, g, or t
  modified_base (569)..(576): a, c, t, g, unknown or other
  misc_feature (569)..(576): n is a, c, g, or t
tcagcgtctagtaccacgaccggtgctcgatttagtcgatagtgaagggaaagggtgtacacctgtggttctcactcaccgatggtcgattgggtgtgagctggatccgtcagtccccagggaaggccctggagtggcttgcacacatgtattggaatgacgaaaaatcgtacaggaaatctctgcagagcaggctcatcatctccagggacacataccaaaagccaggtggtccttaccatgaccaacatcggaccctgtggacacagccacatattactgtgcacggatcgtttattattacgggttcgggagtctccaagttcttgacttacgtcggggccaggggaacccctggtccacccgtctcctcacgccctccaaccgaacgggccccaattccggtcctttcccccgtggcccaccctccctccgaacgacgccacccgtcgtcgggggccaccgacggccggtcccgtcgggcctcggtccgtcggtacgaacggaccgttaccttcccgtactacgaccgtctaggcgcggggctcggacgaggcgacatagncngnnnnnnnn

SEQ ID NO: 231852 - DNA, 721 bp, Homo sapiens
  misc_feature: GYAE6OF02INO3U.14.68.G02.1.454.CMB.1.raw
  modified_base (300)..(300): a, c, t, g, unknown or other
  misc_feature (300)..(300): n is a, c, g, or t
  modified_base (328)..(328): a, c, t, g, unknown or other
  misc_feature (328)..(328): n is a, c, g, or t
  modified_base (711)..(711): a, c, t, g, unknown or other
  misc_feature (711)..(711): n is a, c, g, or t
  modified_base (716)..(716): a, c, t, g, unknown or other
  misc_feature (716)..(716): n is a, c, g, or t
  modified_base (718)..(718): a, c, t, g, unknown or other
  misc_feature (718)..(718): n is a, c, g, or t
  modified_base (720)..(721): a, c, t, g, unknown or other
  misc_feature (720)..(721): n is a, c, g, or t
tcagcgtctagtaccacgaccggtgctcgatttagtcgatagtgaagggaaagggtgtacacctgtggttctcactcaccgatggtcgattgggtgtgagctggatccgtcagtccccagggaggccctggagtggcttgcacacatgtattggaatgaacgaaaaatcgtacaggaaatctctgcagagcaggctacatcatctccgaggacacgataccaaaacgccaggtggtaccttaccatacgaaccaacactcggacctgtcgacacagaccacaatattactgcacgacggntcgttttaattagtttacgggtcgggancctacagtcgttcgtaactacgtacgggaccaacgggtaaccctgggtccaacccggttcacctcgaacgccctaccgaaccgaaacggcccccgtaacgttcccggttacccgttaccccccgtgggtacccctaccccgtacccgtaccctaaacggaccgtaaccctacccgttacgggtaccggggggtacccaaccggaccgggtacccgggtacccccggtcggggtaccgtacggttaccggtacgggtaaccgaaacggggttaccccttaaccgttttaccccggtaaacgtaccggtaaccgggtaccgttacggaacggccggggtaaccgtcggaaccgggacgaccgaacgtaacgtaggctacgatcgncgacncncnn

SEQ ID NO: 231853 - DNA, 335 bp, Homo sapiens
  misc_feature: GYAE6OF01BYQKB.22.1.A01.1.454.CMB.1.raw
  modified_base (332)..(335): a, c, t, g, unknown or other
  misc_feature (332)..(335): n is a, c, g, or t
tcagacatacgcgtcacgaccggtgctcgatttagacgtctcatcaggggacacgtccaacaaccagatctccctcaggctgagctctgtgaccgctgcagacacggccatttattactgtgcgggcacacatttttataatagtggtgaacaactgggttactggggccagggaaccctggtcaccgtctccccagcctccaccaagggcccatcggtcttccccctggcgccctgctccaggagcacctccgagagcacagcggccctgggctgcctggtcaaggactacttccacgcgtatgtctgagcgggctggcaaggcgcatagnnnn

SEQ ID NO: 231854 - DNA, 606 bp, Homo sapiens
  misc_feature: GYAE6OF02HVT9J.22.1.A01.1.454.CMB.1.raw
  modified_base (81)..(81): a, c, t, g, unknown or other
  misc_feature (81)..(81): n is a, c, g, or t
  modified_base (103)..(103): a, c, t, g, unknown or other
  misc_feature (103)..(103): n is a, c, g, or t
  modified_base (123)..(123): a, c, t, g, unknown or other
  misc_feature (123)..(123): n is a, c, g, or t
  modified_base (292)..(292): a, c, t, g, unknown or other
  misc_feature (292)..(292): n is a, c, g, or t
  modified_base (331)..(331): a, c, t, g, unknown or other
  misc_feature (331)..(331): n is a, c, g, or t
  modified_base (449)..(449): a, c, t, g, unknown or other
  misc_feature (449)..(449): n is a, c, g, or t
  modified_base (457)..(458): a, c, t, g, unknown or other
  misc_feature (457)..(458): n is a, c, g, or t
  modified_base (473)..(475): a, c, t, g, unknown or other
  misc_feature (473)..(475): n is a, c, g, or t
  modified_base (479)..(480): a, c, t, g, unknown or other
  misc_feature (479)..(480): n is a, c, g, or t
  modified_base (486)..(486): a, c, t, g, unknown or other
  misc_feature (486)..(486): n is a, c, g, or t
  modified_base (488)..(488): a, c, t, g, unknown or other
  misc_feature (488)..(488): n is a, c, g, or t
  modified_base (494)..(494): a, c, t, g, unknown or other
  misc_feature (494)..(494): n is a, c, g, or t
  modified_base (496)..(496): a, c, t, g, unknown or other
  misc_feature (496)..(496): n is a, c, g, or t
  modified_base (499)..(500): a, c, t, g, unknown or other
  misc_feature (499)..(500): n is a, c, g, or t
  modified_base (504)..(504): a, c, t, g, unknown or other
  misc_feature (504)..(504): n is a, c, g, or t
  modified_base (506)..(506): a, c, t, g, unknown or other
  misc_feature (506)..(506): n is a, c, g, or t
  modified_base (513)..(513): a, c, t, g, unknown or other
  misc_feature (513)..(513): n is a, c, g, or t
  modified_base (517)..(517): a, c, t, g, unknown or other
  misc_feature (517)..(517): n is a, c, g, or t
  modified_base (523)..(523): a, c, t, g, unknown or other
  misc_feature (523)..(523): n is a, c, g, or t
  modified_base (527)..(528): a, c, t, g, unknown or other
  misc_feature (527)..(528): n is a, c, g, or t
  modified_base (532)..(532): a, c, t, g, unknown or other
  misc_feature (532)..(532): n is a, c, g, or t
  modified_base (534)..(534): a, c, t, g, unknown or other
  misc_feature (534)..(534): n is a, c, g, or t
  modified_base (539)..(539): a, c, t, g, unknown or other
  misc_feature (539)..(539): n is a, c, g, or t
  modified_base (542)..(542): a, c, t, g, unknown or other
  misc_feature (542)..(542): n is a, c, g, or t
  modified_base (545)..(545): a, c, t, g, unknown or other
  misc_feature (545)..(545): n is a, c, g, or t
  modified_base (559)..(559): a, c, t, g, unknown or other
  misc_feature (559)..(559): n is a, c, g, or t
  modified_base (563)..(563): a, c, t, g, unknown or other
  misc_feature (563)..(563): n is a, c, g, or t
  modified_base (570)..(570): a, c, t, g, unknown or other
  misc_feature (570)..(570): n is a, c, g, or t
  modified_base (578)..(578): a, c, t, g, unknown or other
  misc_feature (578)..(578): n is a, c, g, or t
  modified_base (601)..(601): a, c, t, g, unknown or other
  misc_feature (601)..(601): n is a, c, g, or t
tcagacatacgcgtcacgaccggtgctcgatttagacgtctcatcagggggacacgtccaacaaccagatctccctcaggntgagctctgtgaccgctgcagnacggcctatttatttaccgngtgcgggtcaccactagtttttaataatagtggttgaaactatgggttactgggcgagggaaccctggtcaccgtcctcccagccctacgaccaagggccccagtccggttccttccccctagggccgtccctcggcctccgagggtacgccaaccccgtcggaacggntccgaaacggacggtccggccccgtttggggaccgttanccccggtttggaacccgtaacgggtaacccttacgtaccccgcggtacgttactcgggttcctagggtaccggggcgggccgttaacgggacgtaaacggggccctaagagtccggtnaagtccgnngtagctcggtgaatnnngtcnnagtcgntnagcgcncncgnngcgngntgagacntatnttaganacgnngacncngcganganctntcgtatcgtacacntacncttacgngtgtacgngcctacggtagaactacgtacgngtacg

SEQ ID NO: 231855 - DNA, 575 bp, Homo sapiens
  misc_feature: GYAE6OF01EVBKA.35.43.D10.1.454.CMB.1.raw
  modified_base (321)..(321): a, c, t, g, unknown or other
  misc_feature (321)..(321): n is a, c, g, or t
tcagtacagatcgtcacgaccggtgctcgatttagactagcagtaagggggctctgagagaggagcccagccctgggattttcaggtgttttcatttggtgatcaggactgaacagagagaactcaccatggagtttgggctgagttggctttttcttgtggctactttaaaaggtgtccagtgtgaggtgcagctgctggagtcgggggaggcttggtacggcctggggggtccctaagactctcctgtgcagcctctggattcaccttttacaactttgccatgaactggtccgccagactccagggaaggtctggagngggtctcgcgtattcgtggcagtggcaggtggtcccgacacatattacgcagaccgccgtgcagggccgcttcatccgtctcccgagagacaaactcgaaacgaaccaccctactatttgaaggatgacccgactgagtgcccaacgcaccggtccctttattactgtgtgaaggtagttggtaagttttgggtcggggtatttacgtcccgtgggcgtcgtggggtcgaggtcgggggccgggaccgttccgg

SEQ ID NO: 231856 - DNA, 642 bp, Homo sapiens
  misc_feature: GYAE6OF01DD3NR.35.43.D10.1.454.CMB.1.raw
tcagtacagatcgtcacgaccggtgctcgatttagactagcagtaagggggctctgagagaggagcccagcccgggattttcaggtgtttcatttggtgatcaggactgaacagagagaactcaccatggagtttgggctgagttggctttttcttgtggctactttaaaaggtgtccagtgtgaggtgcagctgctggagtcgggggagctggtacggcctgggggccctaagctctcctgtgcagcctctggattcaccttttacaactttgccatgaactgggtccgccagactccaggggaagggtctggagtcgggtctcgcgtattcgtggcagtggcagtggtccgacacatattacgcagacgccgtgcagggccgcttcagtcgtctaccagagaacaactacgaaacgaaccaccctactactttgaggtactcggaacccgtacctacggacgtacggcccggaaccgacctaaccgggtaccccttttaattaccgttgttaggtagaaagggtacgttagggtaaagtttttggggtaccggggtaactttaaggttccccgtgggggtcccgtcgttacgggggtcctaagggtcggggggaccccggggtaacctttcgggtacccg

SEQ ID NO: 231857 - DNA, 746 bp, Homo sapiens
  misc_feature: GYAE6OF01ARAYL.35.43.D10.1.454.CMB.1.raw
  modified_base (193)..(193): a, c, t, g, unknown or other
  misc_feature (193)..(193): n is a, c, g, or t
  modified_base (254)..(254): a, c, t, g, unknown or other
  misc_feature (254)..(254): n is a, c, g, or t
  modified_base (363)..(363): a, c, t, g, unknown or other
  misc_feature (363)..(363): n is a, c, g, or t
tcagtacagatcgtcacgaccggtgctcgatttagactagcagtaagggggctctgagagaggagcccagccctgggattttcaggtgttttcatttggtgatcaggactgaacagagagaactcaccatggagtttgggctgagttggtctttttcttgtggctaactttaaaaggtgtccagtgtgaggtncagctgctggaggtcgggggagcgttggtacggcgtgggggtccctaagctctcctgtgcngcctcgtggtacttcctaccttttacaacttttcgcctatcgtaacgtcggggtcccaccaggtacctccgaacgggggtaagggtcgtgggtaggtcgggtcgtccgnggttactttcggtggccagggttcgggctacggtccgggtaccccgaactaccgtaattacgttaaccgcaacggtaccgggtccggttacgggaccggtaccgggggccccgtctttaccgtacgttccccggttcctacccgaagaaccgtaacctaacgtaaccgaaacggtaacccacccctttacgtacgtttagaacggtactacggacccgacgtggacgtcggacccgtaaccgaccgtaccgttaccctttataccgttgtacggtagaagggtgttaggtaggttttcgggtacgggtatttacccggtccggtaggggtccgttacgggtcgggtacggtacgggttccgggggtccggtacccggttccgg

SEQ ID NO: 231858 - DNA, 961 bp, Homo sapiens
  misc_feature: GYAE6OF01CLBHC.35.43.D10.1.454.CMB.1.raw
  modified_base (720)..(720): a, c, t, g, unknown or other
  misc_feature (720)..(720): n is a, c, g, or t
tcagtacagatcgtcacgaccggtgctcgatttagactagcagtaagggggctctgagagaggagcccagccctgggattttcaggttgttttcatttggtgatcaggactgaacagagagaactcaccagtggtagtttgggctgtagttggtctttttcgttgtggcttaacgtttaaaaggtgtccgagttgtggacggtgcagtctgtcgtgggaggtcgggggaggtcgttcgggtacgggccggttcggggggtaccctaaggtccttccgttccgtgtacgccagtcccgtcgtggtacttaccgttaaccctttttaacgtaactttcggaccctaagtacggtaaaccggtcgggtcccgaccgtacggtaccgtacccggtaagggtaagtcgggttacgtagggtacgggttcgggttacccttcgggtacgtttacgtttccgggcgggttcgtaacgggtcggtacccgtaagggttcccgggtaccccgtaagtaacccgtaacgttacgttaaccggaccgtaaccgggtaacccgtcccggtcggaccgggtaccgggtccccgttacccgtttcgaacgttcccggttaccctaccgaagggtaacctaaacccggtaaacccgtaccggaaaacccgtaacccttaaccccgtttagttaacggtttacggaaacggtacgttaccggaaacccgtttacgnggtaacggttcccggaaacccgtacggtaccccgttaaccgttacccgtttttaaacgtccggtttaggtaccgtaagggtaacgggttacgggtttaaggttttaaaccgggtttttcggggtaaccggggttacccgttttacggtcccccggggtagggttcccccggtttaggggttaccgggtaacccggggtttacgggggttacccccggggggtaccccggggttttaaaccg

SEQ ID NO: 231859 - DNA, 780 bp, Homo sapiens
  misc_feature: GYAE6OF01A9TP6.35.43.D10.1.454.CMB.1.raw
  modified_base (401)..(401): a, c, t, g, unknown or other
  misc_feature (401)..(401): n is a, c, g, or t
tcagtacagatcgtcacgaccggtgctcgatttagactagcagtaagggggctctgagagaggagcccagccctgggattttcaggtgttttcatttgggtgatcaggactagaacagagagaactcaccatcggagtttgggctgagttggtcttttcgttgtggtctaacgtttaaaaggtgtccgtagtggtgaggtgcagtcgtgtcgtgggaggtcgggggaggtcgttaggtacggccggtcgggggtaccctaagtacctctccgtgtcgcctacggcctgtacggtacttccttacctttactactttcgctagtacgtaccgtccggccgacgacgtaccgtaccggaagggtacggtcgtagggtaggtcggtcgtcggtcgttcgttcgnggtcgtaggtcgtcgtacggtccgtaccgaactacgtacgttacgtacgacggtacggccgtccggtacgaccgggtaccggtcccgttacttaccgtaccgttccgtaccgtaaccgaacggtaaccgtaacccgtaaaccgtaccgaaacccgtaacccgttacctttacgttaacgttacggaacgtaacgtaccggaccgtaccgtacgacggtacccggaccgtaccggtaccgtacccggttactttacgtcgttaggagttacgggtaaggttggttacggtttagggttttacgggtccggtttaccgtcggttcggtacggtcggttacgggtcgggtacggtaggggtcccgggtccggtccggttccg

SEQ ID NO: 231860 - DNA, 587 bp, Homo sapiens
  misc_feature: GYAE6OF02H1XS8.35.43.D10.1.454.CMB.1.raw
  modified_base (439)..(439): a, c, t, g, unknown or other
  misc_feature (439)..(439): n is a, c, g, or t
  modified_base (459)..(459): a, c, t, g, unknown or other
  misc_feature (459)..(459): n is a, c, g, or t
tcagtacagatcgtcacgaccggtgctcgatttagactagcagtaagggggctctgagagaggagcccagccctgggattttcaggtgttttcatttggtgatcaggactgaacagagagaactcaccatggagtttgggctgagttggctttttcttgtggctactttaaaaggtgtccagtgtgaggtgcagctgctggagtcggggggagcttgggtacggcctggggggtccctaaggactctcctgtgcagcctctggattcaccttttacaacttttgccatgaactgggtccgccagactccgagggaagggtctgggaggtgggtctcgcgtattcgtggcagtggcaggtcggtcccgacacatattacgcagacgccgtgcaggggccgcttcacttcgtctccagacgacaactcgaagaacaccctntattgaggatcggccgacgngagtcgaccaacgacaccggtacctttacgttactgtagtgaaggagttggtaagttttcgggtacggggtacttacgtcccgtgggcgtcggttcgggtcgagggtcggggcccgggtaccttccgg

SEQ ID NO: 231861 - DNA, 550 bp, Homo sapiens
  misc_feature: GYAE6OF02GTOTW.35.43.D10.1.454.CMB.1.raw
  modified_base (361)..(361): a, c, t, g, unknown or other
  misc_feature (361)..(361): n is a, c, g, or t
  modified_base (391)..(391): a, c, t, g, unknown or other
  misc_feature (391)..(391): n is a, c, g, or t
  modified_base (420)..(420): a, c, t, g, unknown or other
  misc_feature (420)..(420): n is a, c, g, or t
  modified_base (515)..(515): a, c, t, g, unknown or other
  misc_feature (515)..(515): n is a, c, g, or t
tcagtacagatcgtcacgaccggtgctcgatttagactagcagtaagggggctctgagagaggagcccagccctgggattttcaggtgttttcatttggtgatcaggactgaacagagagaactcaccatggagtttgggctgagttggctttttcttgtggctactttaaaaggtgtccagtgtgaggtgcagctgctggagtcggggggaggcttggtacggcctggggggtccctaagactctcctgtgcagcctctggattcaccttttacaactttgccatgaactgggtccgcagactccagggaagggtctggagtgggtctcggcgtattcgtggcagtggcagtgtcccganacatattacgcagacgccgtgcgagggccncttcatcgtctccagacgacaactcgaanaccacctctattgagatgaccgctgagtgccgacgcgacgtccttatctgtgagagagtggtatttgggtcgggtacttacgtcccgtgggtccncgttcgggtctagggtcggggccgggtacttccgg

SEQ ID NO: 231862 - DNA, 854 bp, Homo sapiens
  misc_feature: GYAE6OF02I67E6.35.43.D10.1.454.CMB.1.raw
  modified_base (255)..(255): a, c, t, g, unknown or other
  misc_feature (255)..(255): n is a, c, g, or t
  modified_base (318)..(318): a, c, t, g, unknown or other
  misc_feature (318)..(318): n is a, c, g, or t
  modified_base (815)..(815): a, c, t, g, unknown or other
  misc_feature (815)..(815): n is a, c, g, or t
tcagtacagatcgtcacgaccggtgctcgatttagactagcagtaagggggctctgagagaggagcccagccctgggattttcaggtgttttcatttggtgatcaggactgaacagagagaactcaccatggagtttgggctgagttggtctttttctgtggctactttaaaaggtgtcctagtgtgaggtgcagctgcgtgggagtcggggggagcgttgggtacggccgtggggggtacctaagactctctgngcacgctctggtacttcctaccttttacaactttcgacctattacggaacgttcggggtcccnccgaacgtaccgtaccgtaagggggtaacggggttccgtaggggtacgggtcggggttccgtacgggtacggttacggttcgggtacgggtccgtagggttcgggtaccgtaggggttccgggtacccccgaataccgtaatttaaccgttaccgggactaacggacccggtccggttagggacccgtaacggggcccgtacgtttacgaccgtccgtttacccgtcccgaaaggtaccgtaaacctaaccggtaaccgtaaaacgaaccctacgttacctttaggttacgggaaacggtaccttacgggaaccccgttagttcgggaacgttccgaacccgtaaacggtacccgtaccggtttacccttaaagtttccgagggttacgtaagggtaacgggtttaaggtacgggtttaacggtttttcgggggtaacccgggttaaactttcccgggtcccggttacggggaccggttccgtaggggttacccggngggggtttaccccgggggtaccgggttaccctttccggg

SEQ ID NO: 231863 - DNA, 813 bp, Homo sapiens
  misc_feature: GYAE6OF02IVBH6.35.43.D10.1.454.CMB.1.raw
tcagtacagatcgtcacgaccggtgctcgatttagactagcagtaagggggctctgagagaggagcccagccctgggattttcaggtgttttcatttggtgatcaggactgaacagagagaactcaccatggagtttgggctgagttggtctttttcttgtggctactttaaaaggtgtccagtgtgaggtgcagctgctaggaggtcgggggagtcgttgggtacggccgtggggggtccctaaggacctctcctgtcgcacgcctgtggtacttcctacctttttaaccaaacttttcggaccctaagtacggtaaccgttcggggtaccccgtacccgtaacggaacccttacccggaagggggtaacggggttccgtaggggtaacgggtttcggggttcctccgggtacggttaacggtttccgggtagggtccgtaagggtggaccgtagggttccgggtaccccgaagtacctaagttaacgttaccgctaacggtaccgccggttagaccggacgggacccgtcgttacgtacttccggtacctacgacggaagtaacccgacgtaacgaaacgaaccctacccgttattacgttagaacggtattaccggaccgtacgtaggaccggtacgtacccgacgtaccgtaaccggttccctttaagtcttcggtgtaaggacggtaaggttacggttaagtttttcgggtaaccggggttactttaccggttcccggtacggggtccttccgggttagggtaccggttaggggtacccgggggtaaccgggttaccgtttccccggg

SEQ ID NO: 231864 - DNA, 773 bp, Homo sapiens
  misc_feature: GYAE6OF02H5LAQ.35.43.D10.1.454.CMB.1.raw
  modified_base (219)..(219): a, c, t, g, unknown or other
  misc_feature (219)..(219): n is a, c, g, or t
  modified_base (400)..(400): a, c, t, g, unknown or other
  misc_feature (400)..(400): n is a, c, g, or t
  modified_base (624)..(624): a, c, t, g, unknown or other
  misc_feature (624)..(624): n is a, c, g, or t
tcagtacagatcgtcacgaccggtgctcgatttagactagcagtaagggggctctgagagaggagcccagccctgggattttcaggtgttttcatttggtgatcaggactgaacagagagaactcaccatggagtttgggctgagttggtctttttcgttgtggtcttacttaaaaggtgtccagtgtggaggtgcagctggcgtgggagggcgggggngtcggttagggtcggtcgggtacggggtaccgtaacgtcgtcctcgtgcgacgcgtcctgtggtacttccttaacctttaactacgttcactagtacgtacggtcggtcccacgacgtaccgtaccggaaggggtacggtcgtacggtggtcggtcctcggtacgttacgtcggtcggcgnggttcggacgtagggtcccggtaccgaaacacgttaagtacgtaaccgacaacgggtcctcggtcgcgcgggtctctacgtcgtcgtactacgaaggaaccaactaaccgtacgaaaactacccgtaccttgttaacgttaagggacgttagaccgtaaccggtactaggaccggtaccgaacccgggactaaacccggtacccggttttaacctttaacgttnttgggtaactaaggggacggtaggtttaacgggttagggttttttccggggaacggtttaccttccggtaccgggtccgggtagttcccggttacgggtacgggttacggggggtcccgggggtaaacccggggtttcccttcccgggg

SEQ ID NO: 231865 - DNA, 798 bp, Homo sapiens
  misc_feature: GYAE6OF02HNUZB.35.43.D10.1.454.CMB.1.raw
  modified_base (305)..(305): a, c, t, g, unknown or other
  misc_feature (305)..(305): n is a, c, g, or t
tcagtacagatcgtcacgaccggtgctcgatttagactagcagtaagggggctctgagagaggagcccagccctgggattttcaggtgttttcatttggtgatcaggactgaacagagagaactcaccatggagtttgggctgagttggtctttttcttgtggtcttaactttaaaaggtgtccagtgtgaggtgcagctgctggaggtcgggggagcgttggtacggccgtgggggtccctaagacctctctgtgcagccctgtcggattccgtacctttacactttcgccatgacgtggtccncagctcgagggaagtctaggagtggtactcgtacgttagtcggtggctaggtcggcgtagggtccggtcccacgacgtacttagttaccgcgaacgtaccgccggttcgacgtaacggggcccttcctacgtacgttccgtaccgtaccgagaaccggaactaaccgtaccggaaaacgaaccctcccttaacgttagtttacggaaggtactcggaaacccgtaccgtaggtacgtccgaacccgaaaccgtacccgaacccgtttcccgttttaaacgtttaccggttaccggtaggttaacgggaaacgggtttacggttaggggttttaaaacggttttttcggggggtaaaccccgggtttaacgttttaacccgggttccccgggttacggggttaccccgtacgggggtttaccgggtttaccggtaacccgggggggtttacggggggttaccccccgggggtaaacccggtttttcccccgggg

SEQ ID NO: 231866 - DNA, 687 bp, Homo sapiens
  misc_feature: GYAE6OF02G51OL.35.43.D10.1.454.CMB.1.raw
tcagtacagatcgtcacgaccggtgctcgatttagactagcagtaagggggctctgagagaggagcccagccctgggattttcaggtgttttcatttggtgatcaggactgaacagagagaactcaccatggagtttgggctgagttggctttttcttgtggctactttaaaaggtgtccagtgtgaggtgcagctgctgggaggtcggggggaggcttgggtacggccgtggggggtccctaagacctctcctgtgcagcctcgtggtacttcctaccttttacaactttcgccatgaacgtgggtcccgccagactccggaagggtaagggtcgtgggaggtggtcgtcggtcgttattcggtggctaggtggcgtaggtcggtacccgacacatactacgacgagaccgcgtgacgagggcctcttcattccgtctacgagacgaactaacgtacgaaacgaacctacccttatacgttaggagtacgtacgaaccgtactaggacgtcgaacccgaaccgtaccgaacccggttccctttaacgttacgttcggttagtacgggtaaggtaggttacgggttaaggtttttcgggtaacgggggtactttaaccggtcccggttgggtccgtcggttcggggtaccgtacgggggtacgggggtacccgggttacttcccggg

SEQ ID NO: 231867 - DNA, 630 bp, Homo sapiens
  misc_feature: GYAE6OF02FJPEF.35.43.D10.1.454.CMB.1.raw
  modified_base (255)..(255): a, c, t, g, unknown or other
  misc_feature (255)..(255): n is a, c, g, or t
  modified_base (368)..(368): a, c, t, g, unknown or other
  misc_feature (368)..(368): n is a, c, g, or t
  modified_base (400)..(400): a, c, t, g, unknown or other
  misc_feature (400)..(400): n is a, c, g, or t
  modified_base (448)..(448): a, c, t, g, unknown or other
  misc_feature (448)..(448): n is a, c, g, or t
tcagtacagatcgtcacgaccggtgctcgatttagactagcagtaagggggctctgagagaggagcccagccctgggattttcaggtgttttcatttggtgatcaggactgaacagagagaactcaccatggagtttgggctgagttggctttttcttgtggctactttaaaaggtgtccagtgtgaggtgcagctgctggaggtcggggggaggcttggtacggcctggggggtccctaagactctcctgtgcngcctctggattcaccttttacaactttgccatgaactgggtccgccagacctccgaggggaagggtctggagtgggtctcggcgtattcgtggcagtggcagtcggtcccganacatattacgcagacgcgtgcgacgggcccgnttcatccgtctccagagacaactcgaaagaaccaccctcatttgaggntgacccgctgacgtcgcccgacgacctacggtcccttttactatcgtagtaggaacggtaggttgggtaagtttttcggggttacggggtaccttttaaccggtcccggttggggtcccgtacgggtttcggggtaccgtagggggttccgggggtaccccgggggttaacctttcccgggg

SEQ ID NO: 231868 - DNA, 846 bp, Homo sapiens
  misc_feature: GYAE6OF02ICA7G.35.43.D10.1.454.CMB.1.raw
tcagtacagatcgtcacgaccggtgctcgatttagactagcagtaagggggctctgagagaggagcccagccctgggattttcaggtgttttcatttggtgatcaggactgaacagagagaactcaccatggagtttgggctgagttggtctttttcttgtggctactttaaaaggtgtccagtgtgaggtgcagctgcgtggaggtcggggggaggtcgttgggtacggccggttggggggtccctaagactcgtccgtgtcgctagccttcgtggtacttccttaccttttactaacgttttcgcctagtcgaaccgtcgggtaccgccgacgtaccgtaccggaagggtacgggtcgtagggtacggtcggggtacctcggtcgttagtttccggtgggctagggtcgggcgtaagggttcggtcccggaacactaagttaacttaccggactaacgaccggtaccggtcggccgtaacgggggtccctaccgtttctacggtttcccgttaccgtacccgtaacggaacgaaccgtaaacggttacggaaaaccgtaaccctaaccccgtttctttaaacggttttcggaacggttaattaccgggaacccgttacgtacgggaaccgttcgaaccccggtaacggtaccctaaccgggttaaccccttttaagtttcccgttagggtcggtaaacggtaacgggtagttacggggtttaaggtttttccgggggttaacggggttactttaacccggtcccggggttaggtacccggttcgggttacggggttaccggtaacgggggttccggggtaaccccggggttacggtttccccgg

SEQ ID NO: 231869 - DNA, 174 bp, Homo sapiens
  misc_feature: GYAE6OF01AHQBK.25.33.C11.1.454.CMB.1.raw
  modified_base (173)..(174): a, c, t, g, unknown or other
  misc_feature (173)..(174): n is a, c, g, or t
tcagactgtacagtcacgaccggtgctcgatttagagtgagctcgttgggtttgggggaagaggaagactgacggtcccccaggagttcaggtgctgggcacagcggccctgggctgcctggtcaaggactacttccactgtacagtctgagcgggctggcaaggcgcatagnn

SEQ ID NO: 231870 - DNA, 186 bp, Homo sapiens
  misc_feature: GYAE6OF01ANBAG.25.33.C11.1.454.CMB.1.raw
  modified_base (172)..(186): a, c, t, g, unknown or other
  misc_feature (172)..(186): n is a, c, g, or t
tcagactgtacagtcacgaccggtgctcgatttagagtgagctcgttgggtttgggggaagaggaagactgacggtcccccaggagttcaggtgctgggcacagcggcctgggctgcctggtcaaggactacttccactgtacagtctgagcgggctggcaaggcgcatagnnnnnnnnnnnnnnn

SEQ ID NO: 231871 - DNA, 173 bp, Homo sapiens
  misc_feature: GYAE6OF01EPUI8.25.33.C11.1.454.CMB.1.raw
  modified_base (173)..(173): a, c, t, g, unknown or other
  misc_feature (173)..(173): n is a, c, g, or t
tcagactgtacagtcacgaccggtgctcgatttagagtgagctcgttgggttgggggaagaggaagactgaccggtcccccaggagttcaggtgctgggcacagcggccctgggctgcctggtcaaggactacttccactgtacagtctgagcgggctggcaaggcgcatagn

SEQ ID NO: 231872 - DNA, 196 bp, Homo sapiens
  misc_feature: GYAE6OF01BAGV4.25.33.C11.1.454.CMB.1.raw
  modified_base (174)..(196): a, c, t, g, unknown or other
  misc_feature (174)..(196): n is a, c, g, or t
tcagactgtacagtcacgaccggtgctcgatttagagtgagctcgttgggtttgggggaagaggaagactgacggtccccaggagttcgaggtgctgggccacagcggccctgggctgcctggtcaaggactacttccactgtacagtctgagcgggctggcaaggcgcatagnnnnnnnnnnnnnnnnnnnnnnn

SEQ ID NO: 231873 - DNA, 617 bp, Homo sapiens
  misc_feature: GYAE6OF01B3771.25.33.C11.1.454.CMB.1.raw
  modified_base (246)..(246): a, c, t, g, unknown or other
  misc_feature (246)..(246): n is a, c, g, or t
  modified_base (255)..(255): a, c, t, g, unknown or other
  misc_feature (255)..(255): n is a, c, g, or t
  modified_base (310)..(310): a, c, t, g, unknown or other
  misc_feature (310)..(310): n is a, c, g, or t
tcagactgtacagtcacgaccggtgctcgatttagagtgagctcgttgggtttgggggagctacaacaggcaggcaggggcagcaagatggtgttgcagacccaggtcttcatttctctgttgctctggatctctggtgccgtacggggacatcgtgttcgacccacgtccccgtctccctgcctgtgtctcgtgggcgagacggccaccatcatctgacaagtccagccagatctcttcttaccncaacatcanactctaactaattgaccagacaagaaccagacaccctactaatactctatttacnggctatctagtacgggaacgtcccgggtcctcgaccgtacttacgaggtgacaggtcgggtcgtacgggacaggtaccttcacttccacaccagtccgaacacgccgtcgacgacggactaggaaacgtagttaggtcggtacttaacttacgttactcgtacaacgtactaattaactttaacttaccttaaccgttaccgttaaccgttacgttttcggaaccggtacgggtaaccacggtacgtacggtacgtacgacccggtacgaccgtgggtacgtctacgaccgactacgttccgttacg

SEQ ID NO: 231874 - DNA, 520 bp, Homo sapiens
  misc_feature: GYAE6OF01DIDO2.25.33.C11.1.454.CMB.1.raw
  modified_base (216)..(216): a, c, t, g, unknown or other
  misc_feature (216)..(216): n is a, c, g, or t
  modified_base (372)..(372): a, c, t, g, unknown or other
  misc_feature (372)..(372): n is a, c, g, or t
  modified_base (510)..(510): a, c, t, g, unknown or other
  misc_feature (510)..(510): n is a, c, g, or t
tcagactgtacagtcacgaccggtgctcgatttagagtgagctcgttgggtttggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttccngcactggactcagcactgatgttgcaggttattactttgtctcctgtaccaacaacaccaggcaaacgccccaaacttatcatttatgaggccactaagcggccctcagagtttctaatcgtcttctctggctccaagtctgcagcacggcctccngacatctctggctcagctgaggacgagctagattattactgctactcatatgactacatacaactaactcccgtcttccggacctgggaccagggtccaccggtcctacgggtcacgccccaacggaccccaaccccncgtcgtaccc

SEQ ID NO: 231875 - DNA, 173 bp, Homo sapiens
  misc_feature: GYAE6OF01D1D0F.25.33.C11.1.454.CMB.1.raw
  modified_base (173)..(173): a, c, t, g, unknown or other
  misc_feature (173)..(173): n is a, c, g, or t
tcagactgtacagtcacgaccggtgctcgatttagagtgagctcgttgggtttgggggaagaggaagactgacggtcccccaggagttcaggtgctgggcacagcggccctgggctgcctggtcaaggactacttccactgtacagtctgagcgggctggcaaggcgcatagn

SEQ ID NO: 231876 - DNA, 540 bp, Homo sapiens
  misc_feature: GYAE6OF01CH6KC.25.33.C11.1.454.CMB.1.raw
  modified_base (308)..(308): a, c, t, g, unknown or other
  misc_feature (308)..(308): n is a, c, g, or t
tcagactgtacagtcacgaccggtgctcgatttagagtgagctcgttgggtttggggggtcacaagaggcagcgctctcgggacgtctccaccatggcctgggctctgctgctcctcactctcctcactcaggacacagggtcctgggcccagtctgccctgactcagcctgcctccgtgtctgggactcctggacagtcggtcaccatctcctgcactggaaccagccgtgacagttggtgcttaataactatcgtctcctggtacccaacaacacccaggccaacggccccaaactcatcatttangatgtcagtcatcggccctgtggtagtttctggtcgtcttctctggcttccaagtctcgcaacgtccggcctccctgaccatccgtcggggcctcgacggctgacggacgaggtcttacgttattatgctattcatacagacgacaaccaactcgttcgtggtcgtcggacggtacggacaaggttcgaccttcgcggtcacgacccaaggcctacgcccctggtcctaccg

SEQ ID NO: 231877 - DNA, 550 bp, Homo sapiens
  misc_feature: GYAE6OF01CYD9Y.25.33.C11.1.454.CMB.1.raw
  modified_base (216)..(216): a, c, t, g, unknown or other
  misc_feature (216)..(216): n is a, c, g, or t
  modified_base (358)..(358): a, c, t, g, unknown or other
  misc_feature (358)..(358): n is a, c, g, or t
  modified_base (362)..(362): a, c, t, g, unknown or other
  misc_feature (362)..(362): n is a, c, g, or t
tcagactgtacagtcacgaccggtgctcgatttagagtgagctcgttgggtttggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttccngcactggactcagcactgatgttgcaggttatactttgtctcctggtaccaacaacacccaggcaaacgcccccaaaacttatcatttatgaggccactaagcgccctcaggagtttcaatcgcttctctggctccaagtcnggcngcacggcctcctgacaatctcgtggctcgaggctgaggcgagctgattattactgcttactcatatggacacatacaactaacgtccccgttcgttaccggaccttcggggaccgtacggggtccacccggtccgtcggggttaccacggaccccaaacgggcccctaaacccccgcgttcgtacccg

SEQ ID NO: 231878 - DNA, 559 bp, Homo sapiens
  misc_feature: GYAE6OF01CHBFB.25.33.C11.1.454.CMB.1.raw
  modified_base (216)..(216): a, c, t, g, unknown or other
  misc_feature (216)..(216): n is a, c, g, or t
tcagactgtacagtcacgaccggtgctcgatttagagtgagctcgttgggtttggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttccngcactggactcagcactgatgttgcaggttattactttgtctctggtaccaacaacacccaggacaaacgcccccaaaacttatacatttatgaggaccactaagcggccctcgaggtagtttctaatcgcttctctggctccaagtctggcagcaccggtcctccctagacaactctcgtcgggctccgagctggaggacgagctgactttattactgactactacatacgtggacacataccaacaacttcccgtagttccggaccgtacggaccgtacgggtcctacccggtccgtcgggtaccacggacccgaacggaccccaacccgtcgtcgtaccc

SEQ ID NO: 231879 - DNA, 172 bp, Homo sapiens
  misc_feature: GYAE6OF01E45A7.25.33.C11.1.454.CMB.1.raw
tcagactgtacagtcacgaccggtgctcgatttagagtgagctcgttgggtttgggggaagaggaagactgacggtcccccaggagttcaggtgctgggcacagcggccctgggctgcctggtcaaggactacttccactgtacagtctgagcgggctggcaaggcgcatag

SEQ ID NO: 231880 - DNA, 571 bp, Homo sapiens
  misc_feature: GYAE6OF01CELY5.25.33.C11.1.454.CMB.1.raw
  modified_base (380)..(380): a, c, t, g, unknown or other
  misc_feature (380)..(380): n is a, c, g, or t
  modified_base (393)..(393): a, c, t, g, unknown or other
  misc_feature (393)..(393): n is a, c, g, or t
  modified_base (522)..(522): a, c, t, g, unknown or other
  misc_feature (522)..(522): n is a, c, g, or t
tcagactgtacagtcacgaccggtgctcgatttagagtgagctcgttgggtttggggagctctgggagaggagccccagccctgagattcccaggcgtttccattcggtgatcagcactgaacacagagaacgcaccatggaggttggactgagctgggttttccttgttgttttttaaaaggtgcccagtgtgaagtgcggctggaggagtctgggggaggcgtggtacaggccggggggtccttagactctcctgtaaagtctctggattcaattttgatgaatatactatgcactgggtccgtcaggctcgaggggacggtctagagtgggtctctcttataaattgggatggttccagtatagactatgtaggctntgtgaagggccgnttcaccatctccagagacaacagacaaaaactccctactatctacgacaaatggaacgaccctgacgaagtagaagacagccgaccacaataattatagtagtaaaagaggggtaattacggtaaactnttacggagacggtactaagtttactttaacgtaggtctagtggtaccgg

SEQ ID NO: 231881 - DNA, 579 bp, Homo sapiens
  misc_feature: GYAE6OF01DJ8LV.25.33.C11.1.454.CMB.1.raw
  modified_base (215)..(215): a, c, t, g, unknown or other
  misc_feature (215)..(215): n is a, c, g, or t
  modified_base (308)..(308): a, c, t, g, unknown or other
  misc_feature (308)..(308): n is a, c, g, or t
  modified_base (569)..(569): a, c, t, g, unknown or other
  misc_feature (569)..(569): n is a, c, g, or t
tcagactgtacagtcacgaccggtgctcgatttagagtgagctcgttgggtttggggggggtcacaagaggcagcgctctcgggacgtctccaccatggcctgggctctgctgctcctcactctcctcactcaggacacagggtcctgggcccagtctgccgtgactcagcctgcctcgtgtctgggtctcctggacagtcgatcaccatttccngcactggactcagcactgatgttgcaggttattactttgtctcctggtaccaacaacacccaggacaaacgcccccaaactttatctatttangacggccaactaacgccggccctcgaggtagtttctaatcgtctttctctggctcaagtctggcagcacggcctcctagactaatctcgtcgggctaccgaggctaggaggacgaggctgtattattactgcttactcaattagtacggaacctacataccaacctaacttccccgttacgttaccgggacccgtcggggaccgtacggggtcccaacccggttccgtacgggtaccacggacccaacggccccaaacccncgtcgtaccc

SEQ ID NO: 231882 - DNA, 552 bp, Homo sapiens
  misc_feature: GYAE6OF01C99GN.25.33.C11.1.454.CMB.1.raw
  modified_base (216)..(216): a, c, t, g, unknown or other
  misc_feature (216)..(216): n is a, c, g, or t
  modified_base (306)..(306): a, c, t, g, unknown or other
  misc_feature (306)..(306): n is a, c, g, or t
  modified_base (539)..(539): a, c, t, g, unknown or other
  misc_feature (539)..(539): n is a, c, g, or t
tcagactgtacagtcacgaccggtgctcgatttagagtgagctcgttgggtttggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttccngcactggactcagcactgatgttgcaggttattactttgtctcctggtaccaacaacacccaggcaaacgcccccaaacttatcatttangaggccactaagcggccctcaggatttctaatcgcttctctggctccaagtctggcagcacggcctccctgacaatctctggctccaggctgaggacgagctgatttattactgctactcatatggactacactcaactaactcccgttacttccggacccgtcgggacccgacgggttccacccggttcccgttcggggtaccacggtaccccaaacggccccaaacccccncgttcgtaccccg

SEQ ID NO: 231883 - DNA, 623 bp, Homo sapiens
  misc_feature: GYAE6OF01DEMMU.25.33.C11.1.454.CMB.1.raw
  modified_base (373)..(373): a, c, t, g, unknown or other
  misc_feature (373)..(373): n is a, c, g, or t
tcagactgtacagtcacgaccggtgctcgatttagagtgagctcgttgggtttgggggaggcgtggtacagccggggggtcccttagactctcctgtgtggcgcctagactcaccttcagtagttatggcttcgtctgggtccgccagtgtccaggcaaggggctggagtggctgggagttacttggtctgacagacaaatgacatatcacgcggagtccgtgaggggccgattcaccatctccagggacaattccaagagaaccctctatctgacaaatgaacaacttgagagtcgagatacggcgtttattactgtgcgacctcaggagtggctaggaaaaagtcgtaagtctcattcccgtcgacctcgngggccaggccacccgtggtccaccgtctcctcacgcttaccaccgaaggccccatccggtccttcccccgtggccgtccctgctcccgaggcgccacctcgtggggcacgaggccggcccgtgggcctcggtcccgtgggtaccgtaaacggtaccgtacccgttcccgaacgttcggtaacctacggttccgtacggaacggtcccggggtccgttacggggacccgtaaacgggcccgtcgtaaacgg

SEQ ID NO: 231884 - DNA, 753 bp, Homo sapiens
  misc_feature: GYAE6OF01CTCKW.25.33.C11.1.454.CMB.1.raw
  modified_base (214)..(214): a, c, t, g, unknown or other
  misc_feature (214)..(214): n is a, c, g, or t
  modified_base (306)..(306): a, c, t, g, unknown or other
  misc_feature (306)..(306): n is a, c, g, or t
tcagactgtacagtcacgaccggtgctcgatttagagtgagctcgttgggtttggggggggtcacaagaggcagcgctctcgggacgtctccaccatggcctgggctctgctgctcctcactctcctcactcaggacacagggtcctgggcccagtctgccgtgactcagcctgcctcgtgtctgggtctcctggacagtcgatcacatttccngcactggactcagcactgatgttgctaggttattacttgtctctggtaccaacaacaccaggacaaacgacccctaaattactactatttancgacggaccaactaacgccggtaccctacgaggtacgtttactaagttccgtctttctcgtcggaccttacccgtaaaggttccgttacgggcctaacggcccgtaacccggggtccctttaccccgtacggtaaccttaaaccgttcccgttaccggttaccgggggtccctttacccggaacgggtccgttacgggaaaccggggtaccggagggtaccttaggtaactttaacgtttaaccgttcgtacctttaaccttacgtaaacgttacgttacgggaacctactaacgtaaccctaaaccgtaaaccgttccccggttaccgtttaccggggaccccgttaggggaaccccggtaacgggttacccgtaacccggttcccggttacgggtaccaccggtaccccgtaaacggacccctaaacccgaccgtcgttaccccg

SEQ ID NO: 231885 - DNA, 567 bp, Homo sapiens
  misc_feature: GYAE6OF01A7RWD.25.33.C11.1.454.CMB.1.raw
  modified_base (216)..(216): a, c, t, g, unknown or other
  misc_feature (216)..(216): n is a, c, g, or t
  modified_base (306)..(306): a, c, t, g, unknown or other
  misc_feature (306)..(306): n is a, c, g, or t
tcagactgtacagtcacgaccggtgctcgatttagagtgagctcgttgggtttggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcgccatttccngcactggactcagcactgatgttgcaggttattactttgtctcctggtaccaacaacaccaggcaaacgcccccaaattactctatttangaggccactaagcggccctcaggtatttctaatccgcttctctggctccaagtctggcagcacggcctcctgacaactctctcgggctccgaggtctggacggacgaggctgactttatactgactactcaattatcggactactatacaactaactcccgtcttaccggaccgtacgggaccgtacgggtccacccggttccgttacgggtccaaccggaccccgaaacgggtaccccaacccccgtcgttccgtacccg

SEQ ID NO: 231886 - DNA, 575 bp, Homo sapiens
  misc_feature: GYAE6OF01BE8QN.25.33.C11.1.454.CMB.1.raw
  modified_base (460)..(460): a, c, t, g, unknown or other
  misc_feature (460)..(460): n is a, c, g, or t
  modified_base (465)..(465): a, c, t, g, unknown or other
  misc_feature (465)..(465): n is a, c, g, or t
  modified_base (483)..(483): a, c, t, g, unknown or other
  misc_feature (483)..(483): n is a, c, g, or t
tcagactgtacagtcacgaccggtgctcgatttagagtgagctcgttgggtttgggggaggcgtggtacagccgggggggtccctgacactctcctgcacagcttccggactcacctttggtgagcatgctatgacctgggtccgccaggctccagggaagggtctggagtggcttgggttcattagaagcgaagcctatggtggggcaacacaatacgccgcgtctgtaaaaggcagattcagcctctcaagagatgattaccaaaagcatcgcctatctgcacatgagcagcctgagaagcgaggactcagccgtgtattactgttcttattactctgagtagtagtgttatttattactactactattacagtggacgtcgtggggacaaacgggccacggtcacccgttctcctcacgccctaccaccgacgggcccagtccggtcccttccccgnggccnccgtcgcctccgaggacnccacccgtccgagcgcaccgacggcccggcccgtgggcctcggcccgtacgggtaccgtaacgggacccttaccttcccacgttcgtaaccg

SEQ ID NO: 231887 - DNA, 553 bp, Homo sapiens
  misc_feature: GYAE6OF01D5AHH.25.33.C11.1.454.CMB.1.raw
  modified_base (216)..(216): a, c, t, g, unknown or other
  misc_feature (216)..(216): n is a, c, g, or t
  modified_base (297)..(297): a, c, t, g, unknown or other
  misc_feature (297)..(297): n is a, c, g, or t
  modified_base (305)..(305): a, c, t, g, unknown or other
  misc_feature (305)..(305): n is a, c, g, or t
tcagactgtacagtcacgaccggtgctcgatttagagtgagctcgttgggtttggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttccngcactggactcagcactgatgttgcaggttattactttgtctcctggtaccaacaacaccaggacaaacgccccaaattanctatttangagccactaagcgccctcgaggtagtttactaatcgtcttctctggctaccaagtctggcagcacggcctcctgacatctctcggctcaggctgaggacgagcttagatttattactgctactcattatcggactacatacaacaacttccccgttactccggtaccgtgggacccgtacgggtccaacccggttccgtcggggtaccaccggaccccgtaacggaccccaacccctcgtcggtaccc

SEQ ID NO: 231888 - DNA, 884 bp, Homo sapiens
  misc_feature: GYAE6OF01B49WQ.25.33.C11.1.454.CMB.1.raw
  modified_base (218)..(218): a, c, t, g, unknown or other
  misc_feature (218)..(218): n is a, c, g, or t
tcagactgtacagtcacgaccggtgctcgatttagagtgagctcgttggggtttgggggggtcacaagaggcagcgctctcgggacgtctccaccatggcctggctctgctgctcctcactctcctcactcaggacacagggtcctgggcccagtctgccgtgactcagcctgcctccgtgtcgtgggtctccgtggacagtcgatcacctatttccngcatgactcagcactgattgttgactaggttattactttgtctaccgtaggtaacccaaacaacccaaccacggaccaaaaccgtaccccctaaaatttactaccttaagtttacacgacggtacctaacgtaacgcccggaccctagtaggtacgtttactaatccgtacttctcgtcggtacctaccgaacgtctacggacgacggacccgtaacggtccctaccgtacgtaacctacgtcgttccggtacggtacccgttaccggacggtcgtaacgggtaaccgggaaccgggtacggtaccgttaaagggtttaaaccttttaaccgtttaccggttaacggtaacccgtttaaaccgtaacctttaaacgttaacgggttaccggttaaaaccaacccgttaaacttaaccccgtaaaacccgtttaaaaccccggtttccccccgggttttaacccgggttaaacccggggttaccccgggtttaaaccgggggtaacccccgggttaaccccggggttaaccccggttaacccccggggttttacccggttaccccgggggttaacccctaaaccccggggtaaacccccccggaaaccccggggtaaccccccctaaaacccccgtttaaccggtcccccgggttttaaaacccccg

SEQ ID NO: 231889 - DNA, 663 bp, Homo sapiens
  misc_feature: GYAE6OF01DYR6A.25.33.C11.1.454.CMB.1.raw
tcagactgtacagtcacgaccggtgctcgatttagagtgagctcgttgggtttggggggggtcacaagaggcagcgctctcgggacgtctccaccatggcctgggctctgctgctcctcactctcctcactcaggacacgagggtcctgggcccagtctgccgtgactcagcctgcctccgtgtctgggtctccgtggacagtcgatcacctatttcctgcactggactcagcactgatgtgcgtaggtttattactttgtctcctaggtaccaacaaccaccgaggaccaaaacgtaccccctaaaatttactactatttagtacggacggacctaacgtaacgccgtaccctacgtaacggttactttactaacgttccgtcttacctcgtcggtcctacgtaacgttcgtcgacgacgccgaccggtccctaccgtagacctaactccgtcgtcgggtctaccgtagccgtaggacgggacgtacggtcgtacgttaatttacgtacctacgtacttactactagtacgtacgaactacgtaactactaaccgtaacgttccccgtacggttccgtaccggtacgggtaaccgtacggttacccgtaccggttccgcgggtaccaccggacccgtaccggaccctacccgtgtcgtaccc

SEQ ID NO: 231890 - DNA, 612 bp, Homo sapiens
  misc_feature: GYAE6OF01EDRAA.25.33.C11.1.454.CMB.1.raw
  modified_base (217)..(217): a, c, t, g, unknown or other
  misc_feature (217)..(217): n is a, c, g, or t
tcagactgtacagtcacgaccggtgctcgatttagagtgagctcgttgggtttggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcacctatttccngcactggactcagcatgatgttgctaggttattactttgtctcctggtaccaacaacaccaggcaaacgccccaaaacttatcatttatgacggccactaagcggccctacaggtagtttctaatcgcttctctgctcaagtctggcagcacgctccctgacatctcgtggctcaggctgacggacgagggtctaggtactttattaccgtgtaccttacgtcaattagtacggactactaacgtacaactaaacttccccggtacgtttaccggaacccgttggggaaccccgtaacggggttccctaacccgggttcccgttacgggggtaccctaacccgggaccccgtaaaccggggtaccccctaaaaccccccgtcgtcggttaacccc

SEQ ID NO: 231891 - DNA, 701 bp, Homo sapiens
  misc_feature: GYAE6OF01CIF4I.25.33.C11.1.454.CMB.1.raw
  modified_base (220)..(220): a, c, t, g, unknown or other
  misc_feature (220)..(220): n is a, c, g, or t
tcagactgtacagtcacgaccggtgctcgatttagagtgagctcgttgggtttggggggggtcacaagaggcagcgctcgtcgggacgtctccaccatggcctggctctgctgctcctcactctcctcactcaggacacgagggtcctgggcccaggtctgccgtgactcagcctgcctccgtgtctgggtctccgtggacagtcgatcacctatttccngctacgtggactcagctaactgatgtcgactaggttattacttgtctctggtaaccaacacaccgacgacaacgacccctaaacttatacctaatttatcgacgtacctaacgttaacgccgtaccctcgaaggttacgtttactaacgtccgtccttcgtcgtcggtcctaccgtaacggtcgttaggcgtacgtaccgaaccggtccctacccgtacgtacaacgttcctacgtccgggcctacgacgtcgtaggaaccggtagacggtacttaggtactttacttacgtcgttacttacgtacttagtaacgttacgtaaacaccttaacgtacccgtaactaacccgtcccgttacgttaacccgggaccgtacgggacccggttaacggtcccgtaacccggttccggtaccgggtaaccgtaacccggtaaccccggtaacggtaccccccaaaccgtccgttccggttaacccc

SEQ ID NO: 231892 - DNA, 598 bp, Homo sapiens
  misc_feature: GYAE6OF01DHOJQ.25.33.C11.1.454.CMB.1.raw
  modified_base (210)..(210): a, c, t, g, unknown or other
  misc_feature (210)..(210): n is a, c, g, or t
  modified_base (244)..(244): a, c, t, g, unknown or other
  misc_feature (244)..(244): n is a, c, g, or t
  modified_base (278)..(278): a, c, t, g, unknown or other
  misc_feature (278)..(278): n is a, c, g, or t
  modified_base (296)..(296): a, c, t, g, unknown or other
  misc_feature (296)..(296): n is a, c, g, or t
  modified_base (304)..(304): a, c, t, g, unknown or other
  misc_feature (304)..(304): n is a, c, g, or t
  modified_base (328)..(328): a, c, t, g, unknown or other
  misc_feature (328)..(328): n is a, c, g, or t
  modified_base (334)..(334): a, c, t, g, unknown or other
  misc_feature (334)..(334): n is a, c, g, or t
tcagactgtacagtcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgttgacccagtccccggtctccctgcctgtgtctcgtgggcgagacgggccaccntcatctgcaagtccagccagatctcttcttaccncaacatcagatctactaatggtacagcagaaacnggacaccctctaagtacnctattacnggcatctatcggaatccgggtccngaccgnttcgagtgcagcgggtctagggactagcttcgactctcacctatcgacacgcctgacgacggctagaaagtagtgtggtcttacttagttactcggtacacgtactaaattagttaacttacctaccttaccgttaacttacgttttcgggacccgtaaacgggtacccaaacggtcgtacggtaaacgtaacgtacccggtaaaccgtaaacggttcggtacgggtaccttacggaccctaaccgtaacgtccgtttaaccgg

SEQ ID NO: 231893 - DNA, 559 bp, Homo sapiens
  misc_feature: GYAE6OF01BXT8Z.25.33.C11.1.454.CMB.1.raw
  modified_base (215)..(215): a, c, t, g, unknown or other
  misc_feature (215)..(215): n is a, c, g, or t
tcagactgtacagtcacgaccggtgctcgatttagagtgagctcgttgggtttggtgggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcacatttccngcactggactcagcactgatgttgctaggttattacttgtctcctggtaccaacaacaccaggcaaacgcccccaaattatcatttatgagccactaagcggcctacaggtacgtttctaactcgtcttctctggcctaccaaagtctggacagcacggcctccctgacaatcctgtcgggctccgagctagacggtacgaggctagaatttattactgacttactcaatagtgaaccacataccaactaaacctcccgttacttccggaaccgttcgggacccgtagggtccctacccggtccgtgggtacacggacccaaggccccaaaccccgtgtacccg

SEQ ID NO: 231894 - DNA, 689 bp, Homo sapiens
  misc_feature: GYAE6OF01DJENT.25.33.C11.1.454.CMB.1.raw
tcagactgtacagtcacgaccggtgctcgatttagagtgagctcgttgggtttggggagctctgggagaggagccccagccctgagattccccaggcgtttccattcggtgatcagcactgaacacagagaacgcaccatggaggttggactgagcttgggttttccttgtttagttttttaaaaggtgtccctagtgtgaagtgcggctggaggagtcgtgggggaggcgtggtacgagggccggggggtccttagactctcctagtaaagtctcgtggtattctaattttgatagtaatataactatgctacgtgggtccgtcgaggcctacggaggggacgggttctagaggtgggtctcttacttaataaagttgggtatggttacctagtatagtactatgtagtctgtgtaggaacggtccgtactcacctactactaccagaacgaacaacaacgaaccaaaaaccttccctaactactcacgactaaagtcgacgtacctacgaacgaacgtaagaacgaaccgacgtaaccgaccaaactaacgttaatttagttaagtaaaggttaaaaggaggggttaaagttaccggttaaaacgttaccgttacgggtaacggtaacggttaacgttaaacgttttaccgttttaacgtacgggtactaggtacgggttaaccggg

SEQ ID NO: 231895 - DNA, 543 bp, Homo sapiens
  misc_feature: GYAE6OF01EAEIG.25.33.C11.1.454.CMB.1.raw
  modified_base (422)..(422): a, c, t, g, unknown or other
  misc_feature (422)..(422): n is a, c, g, or t
tcagactgtacagtcacgaccggtgctcgatttagagtgagctcgttgggtttggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttcctgcactggactcagcactgatgttgcaggttattactttgtctcctgtaccaacaacaccaggcaaagcccccaaacttatcatttatgaggccactaagccggccctcaggtagtttctaatcgcttctctggctcaagtctggcagcacggcctcctgacatctctgggctcagctgaggacgaggctgattattactgcttacncatatggacacatacaacaactcccgtcttccggaccgtagggacccgtacgggtccacccggttccgtcggggtaccaaccggaccccaacggaccccaaacccccgtacgtcggtaccc

SEQ ID NO: 231896 - DNA, 566 bp, Homo sapiens
  misc_feature: GYAE6OF01DXUMS.25.33.C11.1.454.CMB.1.raw
  modified_base (216)..(216): a, c, t, g, unknown or other
  misc_feature (216)..(216): n is a, c, g, or t
  modified_base (301)..(301): a, c, t, g, unknown or other
  misc_feature (301)..(301): n is a, c, g, or t
tcagactgtacagtcacgaccggtgctcgatttagagtgagctcgttgggtttggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttccngcactggactcagcactgatgttgctaggttattactttgtctcctgtaccaacaacaccagcaacgccccaaactatcatttangagccactaagcggccctcgaggtagtttctaatcgtcttctctggctaccaagtctggcagccaccggccctcccgtagacaactcctcgtcgggctccgaggctaggacggacgaggctagtactttattactcgtactactctaatagtacggacacactacaactaactcccgttacgttaccggaccgtcgggacccgtacgggtcccacccggttcgtcgggtcaccggacccaacggaccccaacccctgtcgtaccc

SEQ ID NO: 231897 - DNA, 627 bp, Homo sapiens
  misc_feature: GYAE6OF01AJTN1.25.33.C11.1.454.CMB.1.raw
  modified_base (403)..(403): a, c, t, g, unknown or other
  misc_feature (403)..(403): n is a, c, g, or t
tcagactgtacagtcacgaccggtgctcgatttagagtgagctcgttgggtttggggagctctgggagaggagccccagccctgagattcccaggcgtttccattcggtgatcagcactgaacacagagaacgcaccatggaggttggactgagctgggttttccttgttgttttttaaaaggtgcccagtgtgaagtgcggctggaggagtcgtgggggaggcgtggtacaggccggggggtcccttagactctcctgtaaagtctctggattcaatttgatgaatatactatgcacgtggtccgtcaggctcgaggggacggtctaggagtgggtctctacttataaagttgggatggttccagtatagactagtgtaggctcgtggtaggaacgggtccncttccacctactcctaccgagacgacaacacgaacaaaacctccctactactctacgacaaacgtggacgacccgtgacgaagtacgaacgacgacgaccgaccaactattaacttagttagttaaggtaaaggtaacggggtaagtttaacggtaaacgttcgttacggaaggaacggtaacgttaacgtttactttaacgtacggtactagtcggtaacggg

SEQ ID NO: 231898 - DNA, 569 bp, Homo sapiens
  misc_feature: GYAE6OF01EEPK5.25.33.C11.1.454.CMB.1.raw
  modified_base (217)..(217): a, c, t, g, unknown or other
  misc_feature (217)..(217): n is a, c, g, or t
  modified_base (280)..(280): a, c, t, g, unknown or other
  misc_feature (280)..(280): n is a, c, g, or t
  modified_base (285)..(285): a, c, t, g, unknown or other
  misc_feature (285)..(285): n is a, c, g, or t
  modified_base (291)..(291): a, c, t, g, unknown or other
  misc_feature (291)..(291): n is a, c, g, or t
  modified_base (300)..(300): a, c, t, g, unknown or other
  misc_feature (300)..(300): n is a, c, g, or t
  modified_base (367)..(367): a, c, t, g, unknown or other
  misc_feature (367)..(367): n is a, c, g, or t
tcagactgtacagtcacgaccggtgctcgatttagagtgagctcgttgggtttggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcacctatttccngcactggaaccagccactgattgttgcttactttgaccttgtctctgtaccaacaacaccganaagcncaactnatatttganacagtaacgcgcctcgtgggtttctagtcgtattcactggctcaagtctgcacacgcctaccctaanactctcgtggctcgaggtctagaacgacgaggtcttagtttatttctgtcttgttgtcttatgtggacttaagaaacttagtttggtgtccgtcgggacggacggtacctagttcgaccgttagttaacgtccgacgtacccgaaggtccctcccggcccccgttcggtcctacttccgttccgttcccccgcccttccccg

SEQ ID NO: 231899 - DNA, 576 bp, Homo sapiens
  misc_feature: GYAE6OF01DDNZC.25.33.C11.1.454.CMB.1.raw
  modified_base (214)..(214): a, c, t, g, unknown or other
  misc_feature (214)..(214): n is a, c, g, or t
  modified_base (321)..(321): a, c, t, g, unknown or other
  misc_feature (321)..(321): n is a, c, g, or t
  modified_base (375)..(375): a, c, t, g, unknown or other
  misc_feature (375)..(375): n is a, c, g, or t
  modified_base (390)..(390): a, c, t, g, unknown or other
  misc_feature (390)..(390): n is a, c, g, or t
tcagactgtacagtcacgaccggtgctcgatttagagtgagctcgttgggtttggggggggtcacaagaggcagcgctctcgggacgtctccaccatggcctgggctctgctgctcctcactctcctcactcaggacacagggtcctgggcccagtctgccgtgactcagcctgcctcgtgtctgggtctcctggacagtcatcaccatttccngcactgactcagcactgatgttgcaggttattactttgtctcctgtaccaacaacaccagacaaacgccccaaattatcatttatgaggccaagtaagccggcctanaggtacgtttctaatcgctttctctggccttcaagtctggcagcaccggctccngacatctcgtgggcnccgagctaggaggacgagctagtattacttactgactacgtcaagttagtcggaactacataccaactaacttccccgttacttaccgggacccgttgggacccgtaacgggtccctaccggttcccgtacggggtacccaacggaccccctaaacgggacccctaaaccccgcttacggtaaccc

SEQ ID NO: 231900 - DNA, 564 bp, Homo sapiens
  misc_feature: GYAE6OF01CUB1E.25.33.C11.1.454.CMB.1.raw
  modified_base (396)..(396): a, c, t, g, unknown or other
  misc_feature (396)..(396): n is a, c, g, or t
  modified_base (440)..(440): a, c, t, g, unknown or other
  misc_feature (440)..(440): n is a, c, g, or t
  modified_base (480)..(480): a, c, t, g, unknown or other
  misc_feature (480)..(480): n is a, c, g, or t
  modified_base (553)..(553): a, c, t, g, unknown or other
  misc_feature (553)..(553): n is a, c, g, or t
tcagactgtacagtcacgaccggtgctcgatttagagtgagctcgttgggtttggggagctctgggagaggagccccagccctgagattcccaggcgtttccattcggtgatcagcactgaacacagagaacgcaccatggaggttggactgagctgggttttccttgttgttttttaaaaggtgcccagtgtgaagtgcggctggaggagtctgggggaggcgtggtacaggccgggggggtcccttagactctcctgtaaagtctctggattcaattttgatgaatatactatgcactgggtccgtcaggctcgaggggacgggtctaggagtgggtctctcttataaattgggatggttccagtatagactatgtaggctctgtgaagggccncttcacctatctcagagacaacagacaaaactccctactatctnacaaagtgacgaccctgacgaagtgaaagacagcgaccanatattatagtagtaaaagagggtagttacggaaactcttacgaaggagaactaagtttactttactacggacngtggtaaccgg

SEQ ID NO: 231901 - DNA, 566 bp, Homo sapiens
  misc_feature: GYAE6OF01E5C8S.25.33.C11.1.454.CMB.1.raw
  modified_base (218)..(218): a, c, t, g, unknown or other
  misc_feature (218)..(218): n is a, c, g, or t
  modified_base (309)..(309): a, c, t, g, unknown or other
  misc_feature (309)..(309): n is a, c, g, or t
  modified_base (331)..(331): a, c, t, g, unknown or other
  misc_feature (331)..(331): n is a, c, g, or t
  modified_base (464)..(464): a, c, t, g, unknown or other
  misc_feature (464)..(464): n is a, c, g, or t
tcagactgtacagtcacgaccggtgctcgatttagagtgagctcgttgggtttggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatccaccattttccngcactggactcagcactgatgttgcaggttattactttgtctcctggtaccaacaacacccaggccaaagcccccaaattactctatttangacggccactaagccggccctnaggtagtttcaatcgcttctctggctccaagtctcggctacgcaccggtcctccctgactaatcctcgtcgggcctccgagggtcctgacgggtacgaggtcctagatttacttactgctactcatatcgganacatcaacaaccttccgtcgttaccggacctcgggaacctcggggtaccaccggttcccgtgggtaccaccgtcccgaacggccccaaccctcgtcgtaccc

SEQ ID NO: 231902 - DNA, 703 bp, Homo sapiens
  misc_feature: GYAE6OF01D2NKY.25.33.C11.1.454.CMB.1.raw
tcagactgtacagtcacgaccggtgctcgatttagagtgagctcgttgggtttgggggagctctgggagaggagccccagccctgagattcccaggcgtttccattcggtgatcagcactgaacacagagaacgcaccatgggaggttggactgagcttgggttttccttgtttgttttttaaaaggtgcccagtgtgaagtgcggcgtggaggagtcgtggggggaggcggtggtacgaggccgggggggtccctagactctcctgtaaagtctctggtattcaattttgatgaattatactatgcacgtgggtccgtcgaggctcggagggggacgggtctaggaggttgggtctcttacttaagtaaagttgggattggttccagtatagactatgtagtctcgtggtaggaacgggtccgtcttacacctatcctacgagacgacaacaacgaacctaaaacctcccctactactcctacgaactaaacgtcggaacgacccgtacggacggaaagtacggaaacgtaaccgacgacccgaccaactaattaacgtttagttaacggttaaaggtaaaagggtaggggttaaacgttttaaccgggtaaaccgtttacgttacgggtaaggtacggttaaacgttaacggttttaccgttttaaccgtaaccggtacgttacggtcggttaacccgggg

SEQ ID NO: 231903 - DNA, 644 bp, Homo sapiens
  misc_feature: GYAE6OF01DP35Q.25.33.C11.1.454.CMB.1.raw
  modified_base (315)..(315): a, c, t, g, unknown or other
  misc_feature (315)..(315): n is a, c, g, or t
  modified_base (633)..(633): a, c, t, g, unknown or other
  misc_feature (633)..(633): n is a, c, g, or t
tcagactgtacagtcacgaccggtgctcgatttagagtgagctcgttggggtttggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcacctatttcctgcactggactcagcactgatgttgctaggttattactttgtctcctagtaaccaacaacaccaggaccaaacgacccctaaacttatactaatttancgaacggcctaacgtaagccggaccctacgaggtaacgtttactaacttccgtctttctctcggactaccgaagtcgtcggcacgccgaccggtccctcccgtagacctaacgtcctccgtgggccctccgaaggtctacggaaggaccggaggtccgttagtatttaacgttctcgtaccttacgtacgtaataacgtaggacctaacactacaacctaaccgttccccgttacggttacccggacccggtacggacccgtacgggtccctaccggttcccgtagggtcccaacggtcccgaacgacccctaacccncgttcgtaccg

SEQ ID NO: 231904 - DNA, 649 bp, Homo sapiens
  misc_feature: GYAE6OF01D8AJ0.25.33.C11.1.454.CMB.1.raw
  modified_base (303)..(303): a, c, t, g, unknown or other
  misc_feature (303)..(303): n is a, c, g, or t
tcagactgtacagtcacgaccggtgctcgatttagagtgagctcgttgggtttggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcacctatttcctgcactggactcagcactgatgttgctaggttattactttgtctctgtaccaacaacaccaggcaaacgccccaaactatcatttangacggaccactaagcggccctcaggtagtttctaatcgtcttctctgctcaagtctgcagcacggcctcctgacaatctctgggtctccgagcgtggaacggacgacggtctagtaatttattacgtcgtacttaccgtactagttaacgtacggaacctaacgtaacttacctaaaaccgtaaccgttacccccggttacccgtttaccggggtaacccggttaccgggggtaacccggtaaccggggttacccgttaaccccgggttccgttaccgggggttacccaaccgggtaacccccgaaaccgggtacccccaaaccccccgtccgttacgttaccccg

SEQ ID NO: 231905 - DNA, 614 bp, Homo sapiens
  misc_feature: GYAE6OF01A20CR.25.33.C11.1.454.CMB.1.raw
  modified_base (220)..(220): a, c, t, g, unknown or other
  misc_feature (220)..(220): n is a, c, g, or t
tcagactgtacagtcacgaccggtgctcgatttagagtgagctcgttggggtttggggggggtcacaagaggcagcgctcgtcgggacgtctccaccatggcctgggctctgctgctcctcactctcctcactcaggacacagggtcctgggcccagtctgccgtgactcagcctgcctccgtgtctgggtctccgtggacagtcgatccactatttccngcactgactcagcactgatgttgctaggttattactttgtctctggtaccaacacaccagacaaacgcccctaaatatctatttatgacgccaactaagcggccctagaggtagtttactaactcgtacttctcgtcgctaccaagtctggcacgcgtacggcctccgtacgactaatctacgcggctccgaggcgtagacggacgagctgtattattcctagtcttactctatagtcggaactacgtactaactaacctaaccgttcccgttcgttacccgggaccgtaccggggaacccgtacgggttaccgtaacccggttaccggtcggtaacccaccggtacccccggaaaccggaccccctaaaccccgtaccgttacggttaccccg

SEQ ID NO: 231906 - DNA, 972 bp, Homo sapiens
  misc_feature: GYAE6OF01DG8LG.25.33.C11.1.454.CMB.1.raw
  modified_base (217)..(217): a, c, t, g, unknown or other
  misc_feature (217)..(217): n is a, c, g, or t
tcagactgtacagtcacgaccggtgctcgatttagagtgagctcgttgggtttggggggggtcacaagaggcagcgctctcgggacgtctccaccatggcctgggctctgctgctcctcactctcctcactcaggacacagggtcctgggcccagtctgccgtgactcagcctgcctcgtgtctgggtctcgtggacagtcgactcacctatttccngcacgtggactcagactactgagttgttcgactaggttttactttactttcgtccttccgtacggtaacccaaaccaaccgacccgaggaccaaaaccccgacccccctaaatcctaattaccttaattttagtcgtaacgtttacgtcgtaacgttaccgaaccggtttccccggtcccctttaggttacggtttaaccgggtttttccggtttacgggtttcccgtttccgttttcccggtccggtttacgggtacccctttaaccggtaaacggttttcccgtaacccggggtaacccgtaacccgggtttcccgggtaccccctttacccggttaaccggtaaccccgtttaccgggttccccgggttaccgggggtcccctttaccccgggtaacgggttaccggtaacggggtaaaccgggtacccgggttaaacgggtttaacccgttttaaaccggtttttaacgtttttaaaccgttccggttttaaaccgttaaaccgttttttaccgaaaaccgtttaacggtaaacccggtaaaccccgtaaaccgtaaacccgttaacggtttaacgggtttacggggttccgggtttaacccggggttaaccgggggaccgggttaaaccggggttaaacccgtaacgggtttaccccggtacccggttaaccgggttccgtaacccggtacccggtaacccggtaaccgtcccccggttaccccgttcccccgggttcccggttaccccg

SEQ ID NO: 231907 - DNA, 609 bp, Homo sapiens
  misc_feature: GYAE6OF01AM4K9.25.33.C11.1.454.CMB.1.raw
  modified_base (215)..(215): a, c, t, g, unknown or other
  misc_feature (215)..(215): n is a, c, g, or t
  modified_base (452)..(452): a, c, t, g, unknown or other
  misc_feature (452)..(452): n is a, c, g, or t
tcagactgtacagtcacgaccggtgctcgatttagagtgagctcgttgggtttggggggggtcacaagaggcagcgctctcgggacgtctccaccatggcctgggctctgctgctcctcactctcctcactcaggacacagggtcctgggcccagtctgccgtgactcagcctgcctcgtgtctgggtctcctggacagtcatcacctatttccngcactggactcagcactgatgttgctaggttattactttgtctcctggtaccaacaacaccaggcaaacgccccctaaacttactctatttatggacggaccaacgtaacgccggccctacgaggtacgtttactaatccgtacttctacgtggcctactaagtctgcacgcacggtcctcctgactactctcgtggcctcgaggctgacggacgagctagattatcgtgcttactntaagtatcggaactacacttacaaccgtaacttcccggttacgttaccgggacccgttacggggacccgtacgggttacccgtacccgggttcccgtaggggtacccaccggtaccccgaaccgggaccccctaaaccccgtcgttcggtaaccccg

SEQ ID NO: 231908 - DNA, 550 bp, Homo sapiens
  misc_feature: GYAE6OF01A3RHZ.25.33.C11.1.454.CMB.1.raw
tcagactgtacagtcacgaccggtgctcgatttagagtgagctcgttgggtttgggggagctacaacaggcaggcaggggcagcaagatggtgttgcagacccaggtcttcatttctctgttgctctggatctctggtgccgtacggggacatcgtgttgacccagtccccggtctccctgcctgtgtctctgggcgagagggccaccatcatctgcaagtccagccagaatctcttcttacctcaacatcagatctacctaaattggtaccagcaagaaaccaggaccaccctcctaagttactcattactgggcatctagttcgggaacttccggggtccctgaccgtattcaggtggcaggcgggtctgggacacgacttcactctacaccatcgacacgcctgcaggctgaagagtgtgactactttattacctagtacagtacaataattataaccttactaccgttactacgtttacggccgacgggaaccagcgtaggacgtacgtaccgacgaacgtgtacggctacgccaactgtcttacg

SEQ ID NO: 231909 - DNA, 742 bp, Homo sapiens
  misc_feature: GYAE6OF01DKAQH.25.33.C11.1.454.CMB.1.raw
  modified_base (221)..(221): a, c, t, g, unknown or other
  misc_feature (221)..(221): n is a, c, g, or t
tcagactgtacagtcacgaccggtgctcgatttagagtgagctcgttgggtttgggggagctacaacaggcaggcaggggcagcaagatggtgttgcagacccaggtcttcatttctctgttgctctggatctcgtggtcgccgtacggggacagtcgtgttcgacccgacggtccccggtctcctgcctgtctctcgtgggcgagacggccacatcatcngacaagtccagccaagtaactccttcctttaccttaaccctacaaacaatcaactactacctaaccttaaagttcggtaacagacaacgaaaccgacggacctaccctacttaacttactactattacgcggactacttacgtagttacgggaacgtcccggggtacctacgtacgtacttacgaggtcgtacggacggtccgggtcgtacgggactaacggttaccttccgaaccttcctaccaacccgtacgtaccggaccgtacggtccgtacggacgtacggtacgtaacggaagtacgtcggtacggtaccttaactttactttaacgtcgtacgtataacgttaactttaacgttacttaaccgtaaccgttacccgttaaccgtttaccggttttaccggaacccgggtaaccgggtaccgtaacgggtaccgtaacggggtaaccgtacgggttaacccgaacggttacggtcggtacgggaccttacgacccgtactcgttaccgtttaccg

SEQ ID NO: 231910 - DNA, 780 bp, Homo sapiens
  misc_feature: GYAE6OF01CDK34.25.33.C11.1.454.CMB.1.raw
  modified_base (202)..(202): a, c, t, g, unknown or other
  misc_feature (202)..(202): n is a, c, g, or t
  modified_base (220)..(220): a, c, t, g, unknown or other
  misc_feature (220)..(220): n is a, c, g, or t
  modified_base (553)..(553): a, c, t, g, unknown or other
  misc_feature (553)..(553): n is a, c, g, or t
tcagactgtacagtcacgaccggtgctcgatttagagtgagctcgttggggtttggggggggtcacaagaggcagcgctctcgggacgtctccaccatggcctgggctctgctgctcctcactctcctcactcaggacacagggtcctgggcccagtctgccgtgactcagcctgcctccgtgtccgtgggtctcctggacngtcgatcacctatttccngcacgtggactcagcactgatggttgactaggttattactttcgtctaccgtagtaaccaacaaccaccgagaccaaacgacccctaaattactctatttagtcgacggaccaacgtaacggccgtaccctgtacggtagttttacctaagtccgtcttccgtacgtcggtacccttacgtaacggttctcggactacggcccgtaccggtccctaccctaggtaacctaacgttccgtaccggtcgggaccttcccggaaggtccgtacggggacggtaaccggaacggtccgtttaggtaacttttagttaccgtcgtaccgtttaacctntaacggttaacgtaccggtaacctaaaccgtactaaacccgtaaccgttaaaccccgtttccccgggtttacccgttaacccggggtacccgttaaccggggggtaaccccggttacggggttacccctaccccggggtttccgggtacccggggtaaccctaccccgggacccccggtaaacccgggacccccctaaacccccggttccgttaccgggttaacccc

SEQ ID NO: 231911 - DNA, 796 bp, Homo sapiens
  misc_feature: GYAE6OF01B7Z1L.25.33.C11.1.454.CMB.1.raw
  modified_base (208)..(208): a, c, t, g, unknown or other
  misc_feature (208)..(208): n is a, c, g, or t
tcagactgtacagtcacgaccggtgctcgatttagagtgagctcgttgggtttggggagctctgggagaggacgccccagccctgagattcccaggtcgtttccattcggtgatcagcactgaacacagagaacgcacagtggaggttggactgagtcttcgggttttcttgttttagttttttaaagtgtcctagtgtgagtgcggngtgggaggaggtcggtgggggaggtcggtggtacggacggggtccggggggttccttaggaccgttcctaccgtagtaaacgtctgtggttacttcgttaattttgaatagtaaatattaactagtcgactacgttcgggttccgtcgtacggcgtacggagggggtaccggtacgtaggtacggttcggtcttacgtttacgttaaagttaaggttcgggtacggttacgttaccgtaggttaataagtaacgtagtacggtaacggtcgtacgtaggttacggacgggtcctaccgttactaccgtactcctaacgaacgtaacgaacctaaccgaactaaaccctaaaacccttccctacttaactacgtacctaaacgtaaagtcggaacctacccgtaggaaccgtaaacggtagaaacggacaacggtaccaccgtaaacttattaacgtttaggttaaggtaaacgggtaaaagggttagggttaaaccgtttaaccggtaaacgttacggttaaggaacggtacgttaaccgtttaacgttttaccgttaaggtaccggtatacgggttgggtaaccggg

SEQ ID NO: 231912 - DNA, 679 bp, Homo sapiens
  misc_feature: GYAE6OF01EH5ME.25.33.C11.1.454.CMB.1.raw
  modified_base (183)..(183): a, c, t, g, unknown or other
  misc_feature (183)..(183): n is a, c, g, or t
  modified_base (669)..(669): a, c, t, g, unknown or other
  misc_feature (669)..(669): n is a, c, g, or t
  modified_base (673)..(673): a, c, t, g, unknown or other
  misc_feature (673)..(673): n is a, c, g, or t
tcagactgtacagtcacgaccggtgctcgatttagagtgagctcgttgggtttggggagctctgggagaggagccccagccctgagattcccaggcgtttccattcggtgatcagcactgaacacagagaacgcaccatggaggttggactgagctgggttttcttgttgttttttaaaaggngcccagtgtgaagtgcggctggaggagtcgtgggggaggcgtggtacaggccggggggtcccttaggacttctcctagtaaagtctctggattcaattttgatgaatatactatgcacgttggtccgtctaggctcgagggggtacggtacgtaggaggttgggtctctacgtttaagtaaagttgggaattcggttaccaagtataagtactagtcggttagcttcgtggtacggtaacgggtccccgtatttaccgaaccctagtttccgtacccgtaagtaaccggaaaccgaaaccgaacgtaaaccctaaaaaacccttacccccgtagttaaaccttacccgtacgtaacgtaaaacgttcgggaacgtacccctaggtaccgaagtacgaagaacgacggacgaccataactattagtagtaagtaaaacggtgggtaacttacggaaacttgtagacgagactacgttacttagacgntagnggtacg

SEQ ID NO: 231913 - DNA, 1039 bp, Homo sapiens
  misc_feature: GYAE6OF01A1JUV.25.33.C11.1.454.CMB.1.raw
tcagactgtacagtcacgaccggtgctcgatttagagtgagctcgttgggtttggggagctctgggagaggagccccagccctgagattccccaggcgtttccattcggtgatcagcactgaacacagagaacgcaccatggaggttggactgagcttgggttttccttgtttgttttttaaaaggtgccagtgtgaagtgcggctggaggagtcgtgggggaggcgtggtacgaggccggggggtcccttaggacctctcctagtaagtctcgtggtattctaattttgatagtaatatactatgactacgttggggtacccgttcgacgggtccgtacgggaacggggggtaccgggttaccgttaagggtacgggttcggggttccttaccgtttacgtttaaagtttaaaaggttttgggggtaacgtttcgggttttaccccgtaaaggtttaacgttaaacggtaaccgtttaagtttacgggttaaacgggttcctttaccgggttagggtttaaccggggaaacgggggtccccccggtttaccgttttaaccccggaaccccgttaacttacccccgtttaacccggtaaacgggtaaccggtaaaaccccgaaaaccccgtaaacccgggttaaaaaccccgtaaaaaaaaccccccttttaccccccgttaaacctttaaacccgtttaacccgtttaacccgggtaaacccgttaaaaacggtttacccgggggaaacccgtaacccccggttaacgggtaaaccggtaaacgggttaacggaaaacggtaaccgaaccggaaccccggtacccaaacgttaactttaacgttttaacgtttaagggttaaacgggttaaaaaacgggtaacgggggttttaaaccggttttaaacccggggtaaacctttacgggtttaaaccgggtaaacgggtaaaccgggttaaaccggttttaaaccgttttaacccgtttttaacccgggttaaaccggttacgtaacgggtttacgggttaacccggggg

SEQ ID NO: 231914 - DNA, 738 bp, Homo sapiens
  misc_feature: GYAE6OF01EZU0J.25.33.C11.1.454.CMB.1.raw
  modified_base (206)..(206): a, c, t, g, unknown or other
  misc_feature (206)..(206): n is a, c, g, or t
tcagactgtacagtcacgaccggtgctcgatttagagtgagctcgttgggtttggggagctctgggagaggagccccagccctgagattcccaggcgtttccattcggtgatcagcactgaacacagagaacgcaccatgggaggttggactgagctgggttttccttgtttgtttttttaaaaggtgcccagtgtgaagtgcggntggaggagtcgtgggggaggcgtggtacgaggccggggggtcccttagactctcctgtaaagtctctggattcatttgatagaatatactatgcacgtcgggtccgtcgaggtctcggagggggacgggtcgtaggaggtgggtctcttacttataagttgggtattggttccaagtatagactagtgtaggtctcgtggtagaacgggtccgcttacgacctactacctaccgagaacgaaccaaacgaacgaaaccctaaaaaccttcccctaacttaacgtacctagtaactaaacgtacggtaccgtacccgtaggacccggaaagttacggaaaccgaaccgtaaccggacccggtaacccaaacgttactttaaacgtttaacgtttaagggttaaacgggttaaaaaaggggttaaagggggtaaaccgtttttaaacgggaaaccgtttacggttaaccgggtaaggtaaacggtaacgttaaacgtttacgttttaacgaccggtacgtagtacggtaccggg

SEQ ID NO: 231915 - DNA, 653 bp, Homo sapiens
  misc_feature: GYAE6OF01DHU9W.25.33.C11.1.454.CMB.1.raw
  modified_base (208)..(208): a, c, t, g, unknown or other
  misc_feature (208)..(208): n is a, c, g, or t
  modified_base (408)..(408): a, c, t, g, unknown or other
  misc_feature (408)..(408): n is a, c, g, or t
  modified_base (479)..(479): a, c, t, g, unknown or other
  misc_feature (479)..(479): n is a, c, g, or t
tcagactgtacagtcacgaccggtgctcgatttagagtgagctcggttggggtttgggggggggtcacaagaggcagcgctctcgggacgtctccaccatggcctgggctctgctgctcctcactctcctcactcaggacacgagggtcctgggcccagtctgtcgtgactcagcctgcctccgtgtctggtctcgtggacagtcgancactattcctgcacgtgactcagcacgtgatggttgacgttaagtttatttacgtttcgtcttccgtacgtaaccaacaaccaccgagaaccaaaccgaccctaaattactactaatttagacggaacgccaacgtaacgccggaccctagagttacgtttactaactctcttctacgtcgtctaccgaagtcgtacgcncgacgaccggtccctaccgtacgaactacttccgtacggtcggtccgtcgtaggcgtaggaacggtacggnggtactagtaactttacttacgtcacttactacaatacgtacgaactataactaccgtaacctaccgttacccgttaccgtaccgacccgggttacgacccggtacggtcccgtaccggtccggtacggtaccacccggtaccgaacccggacccaaacccgtgtccgtaaccg

SEQ ID NO: 231916 - DNA, 672 bp, Homo sapiens
  misc_feature: GYAE6OF01AH4JU.25.33.C11.1.454.CMB.1.raw
  modified_base (148)..(148): a, c, t, g, unknown or other
  misc_feature (148)..(148): n is a, c, g, or t
  modified_base (216)..(216): a, c, t, g, unknown or other
  misc_feature (216)..(216): n is a, c, g, or t
  modified_base (235)..(235): a, c, t, g, unknown or other
  misc_feature (235)..(235): n is a, c, g, or t
  modified_base (252)..(252): a, c, t, g, unknown or other
  misc_feature (252)..(252): n is a, c, g, or t
  modified_base (294)..(294): a, c, t, g, unknown or other
  misc_feature (294)..(294): n is a, c, g, or t
tcagactgtacagtcacgaccggtgctcgatttagagtgagctcgttgggtttggggggggtcgacgaagaggcagcgctctcgggacgtctccaccatggcctggctctgctgctcctcactctcctcactcaggacacagggtccngggcccagtctgccgtgactcagcctgccctccgtgtctgggtcctccgtggacagtcgatccaaccntctcctgacactggaaccngccgtgacctagttggntacttataactagtgtcctccgtcgtacccaacacctaccgngaccaaccggacccccaaactccaatcctaatttactagattcgtacatccagtcccgtccttacgtggtactttcgtcgtcgtctcttcgtaggcctacgaacggttctaggccttaccgtccgtcccttccgtactactactctcgtacggcccttaccgagtccgtaggaccggtaacgtacgggtactagttacgtttaacgtttacgaccgttactacttaccgtaagttacgtacgaaccttacgacttacgaaaccttaaccgtcccgttacgttacccgtaccggtcggaacccgtacgggtcccttaaccccggttcgtcgggttacccacccggaaacccctacccggaacccccgtacccgtaaccg

SEQ ID NO: 231917 - DNA, 756 bp, Homo sapiens
  misc_feature: GYAE6OF01EFNTM.25.33.C11.1.454.CMB.1.raw
  modified_base (220)..(220): a, c, t, g, unknown or other
  misc_feature (220)..(220): n is a, c, g, or t
tcagactgtacagtcacgaccggtgctcgatttagagtgagctcgttgggtttggggggggtcacaagaggcagcgctctcgggacgtctccaccatggcctgggctctgctgctcctcactctcctcactcaggacacgagggtcctgggcccagtctgccgtgactcagcctgcctccgtgtctgggtctccgtggacagtcgatccacctatttccngcactgactcagcactgatgtgactaggtttattactttgtcctccgtaggtaaccaacaacacccaggacaaaccgacccccaaatttatactaatttacgtggacgaccctaacgtaacgtccggccctacgtaaggtacttttactaaatccgtctttcctcgttcggacccttaccgtaaacgttcgtcggacctaacgccgtacccggtccccttcccgtacggaacctaacgttcctccggttcgggcctaccccgtaggtccgtagggaacgggtaaccggacgggtacgttacgttaacgtttaacgtttaacgttcggtaaccctttaacgtaacgtaagtttaacggtacggaaacctaaccgtaacttacccaaacgttaaacccgttccccgttaggtacccggtacccgttaccggggtaacccggtacggggttaccctaccccggttcccgggcgggttaaccgaaccccggttaccccgaaacccggtacccccctaaacccctcgtcccggttaacccc

SEQ ID NO: 231918 - DNA, 726 bp, Homo sapiens
  misc_feature: GYAE6OF01AFCMI.25.33.C11.1.454.CMB.1.raw
tcagactgtacagtcacgaccggtgctcgatttagagtgagctcgttgggtttggggggggtcacaagaggcagcgctctcgggacgtctccaccatggcctggctctgctgctcctcactctcctcactcaggacacgagggtcctcgggcccagtctgccgtgactcagcctgcctcgtgtctgggtctccgtggacagtcgactccacctatttcctgccacgtcggactcacgcactgatgttgctagttattactttgtcctctagtaccaacaccaccgacggaccaaaccgtccccctaaattactactatttagtcgacggacctaacgtaacgccgtccctagtaggtacgtttactaacttccgtactttccgtcgtcggtccttaccgtaacgttcgtacggacgacgtcccgtacccgtccccgttacccgtacggtaacctaacgttccgtccggtcgggtaccgttccgacgggtcgtacgggaacgggtacggacgggtacgtagttaacgtttacttacgtcgtacttactacgttatacgtacggtaacaactacctactaaacctaaccgttccccgttacggtcccggtaacccgtcggggtaaacccggttaccgggtaccccgttacccgggttaccgggttacccgggacgacccgtaacccccggaacccgaaccccccaacccggtaccctcggttaacccc

SEQ ID NO: 231919 - DNA, 641 bp, Homo sapiens
  misc_feature: GYAE6OF01BUM8F.25.33.C11.1.454.CMB.1.raw
tcagactgtacagtcacgaccggtgctcgatttagagtgagctcgttgggtttggggggggtcacaagaggcagcgctctcgggacgtctccaccatggcctgggctctgctgctcctcaccctcctcactcagggcacagggtcctgggcccagtctgccctgactcagcctgcctccgtgtctgggtctcctggacagtcgatcaccatctcctgcactggactcagcactgatgtgctaggttattacttgtctctggtaccaacacaccagcaacgcccctaatatctatttatgacgaccactaacgccggccctgacggtacgtttctaactcgtcttctcgtcggctacctaagtctggcacgccgaccggccctccctcgactaacttcgtcgtcgggtcctccgacggtcgtaggacggacggtacggtcttaggtaatttacgttaccgtcgtacttaacctacgtaacttacgtcggaacctactaacttaccaacctaaaccgttcccgttaccggtttacccggacccgttacggggacccgtaccggggtacccgtaccccgggtccccgggtaccgaacccggacccgaaccggtacccccaaccccgtacctcgtccctacccgg

SEQ ID NO: 231920 - DNA, 797 bp, Homo sapiens
  misc_feature: GYAE6OF01CBAW3.25.33.C11.1.454.CMB.1.raw
tcagactgtacagtcacgaccggtgctcgatttagagtgagctcgttgggtttggggagctctgggagaggagccccagccctgagattcccaggcgtttccattcggtgatcagcactgaacacagagaacgcaccatggaggttggactgagtcgttgggtttttccttgtttagtttttttaaaaggtgcctagtgtgaagtgcggctggaggagtcggtgggggaggcggtggtacgagggcccgggggggtcccttaggaccttctccgtagttaaacgtctctggtattctaattttgatagaatatactatcgctacgtcggtccgtcgaggtcgtcggaacggggggtaccgggttacgtagggtacggttcggggttccttaccgttactttaagttaaaacggtttggggtaatttcgggtttacccgtaaggttaattaacggtaacgttaagttgggtaacgggtccttacggttagggtacggggaaccggggtcccggttccctttaaccgtaacccctacgttacccgttaccgaacggtaacgaaacccgtaaaaccgaaccgtaaaccctaaaaaaccccgttcccctaacttacgtactacgaacgtaaacgtacgaccgtacccgtagacgaagtacgaacgacgacgaccgtaccaataacttagttagttaggtaaaggtaaaggtagggttaacgtttaacggtaaacgtacgttacggtaagaacggtacttaacggttttacgtttaaccgtaaggtctaggtcggtaacggg

SEQ ID NO: 231921 - DNA, 176 bp, Homo sapiens
  misc_feature: GYAE6OF01AZ5UI.25.33.C11.1.454.CMB.1.raw
  modified_base (175)..(176): a, c, t, g, unknown or other
  misc_feature (175)..(176): n is a, c, g, or t
tcagactgtacagtcacgaccggtgctcgatttagagtgagctcgttgggtttgggggaagaggaagactgaccggtccccccaggagttcaggtgctgggcacagcggccctgggctgcctggtcaaggactacttccactgtacagtctgagcgggctggcaaggcgcatagnn

SEQ ID NO: 231922 - DNA, 708 bp, Homo sapiens
  misc_feature: GYAE6OF01AIQZT.25.33.C11.1.454.CMB.1.raw
  modified_base (257)..(257): a, c, t, g, unknown or other
  misc_feature (257)..(257): n is a, c, g, or t
  modified_base (335)..(335): a, c, t, g, unknown or other
  misc_feature (335)..(335): n is a, c, g, or t
tcagactgtacagtcacgaccggtgctcgatttagagtgagctcgttgggtttgggggagctacaacaggcaggcaggggcagcaagatggtgttgcagacccaggtcttcatttctctgttgctctggatctctggtgccgtacggggacatcgtgttcgacccacgtccccggtctcccgtgcctgtcgtctcgtgggcgaggcgggccaccatcatctgacaacgtccacgccagtactccttcttccttaccncaacatcagactactaacctaagtcgtaccagacaacgaaccacggaccacccgtacttaacgtactctactttacgnggactatctacgtcggacgtcccgggtcctagtaccgtatcgtaggtcggcgacggtccgggtacgtacgggactacggtaccttccgtacgtcctaccgtaaccacgttaccgaaccgtaccgtaccgtacgaccggacgggtacgtacggtaacgtacgttcgggttacgtacctttaacgtttacttacgtacgtactaacgtaacgttaaactttacttaacgtaccgttaacccgttaccgttaacgttaaccggtttacccgggaacggtaaccggggtacctacggtacgtaacgggtacgtaccgtaaccggtaacgttacggtggtaccggtacgacccgtaccaaccttcgttccgttacccg

SEQ ID NO: 231923 - DNA, 678 bp, Homo sapiens
  misc_feature: GYAE6OF01DVSA7.25.33.C11.1.454.CMB.1.raw
  modified_base (315)..(315): a, c, t, g, unknown or other
  misc_feature (315)..(315): n is a, c, g, or t
tcagactgtacagtcacgaccggtgctcgatttagagtgagctcgttggggtttggggggggtcacaagaggcagcgctctcgggacgtctccaccatggcctgggctctgctgctcctcactctcctcactcaggacacgagggtcctgggcccagtctgccgtgactcagcctgcctcgtgtcgtggtctccgtggacagtcgatccacctatttcctgcacgtggactcagcactgattgttgctaggttattacttgtctctagtaaccaacaaccaccaggacaaaccgaccccaaattatactatttangacggaccaacgtaacggccgtaccctacgaaggttacgtttactaatccgtacttcgtctcggcctacgtaacgtccgtacggactacgccctaccggtcccttacccgtagaaccttaacgtccgttacggtccggggtacctaccggacggtcggtaaggaacgggtaacggagggtctaggtaactttagtacctagacttaactcgtaattagcgacctaacacttaaccgaaccttaacccgttcccgtacgttaccggaccggtacgggaccggtaccgggtaccgtacccggttccggtacgggtacccaaccggtaccccgaacgtaacccccaacccctcgtccgttaacccg

SEQ ID NO: 231924 - DNA, 812 bp, Homo sapiens
  misc_feature: GYAE6OF01C2357.25.33.C11.1.454.CMB.1.raw
  modified_base (216)..(216): a, c, t, g, unknown or other
  misc_feature (216)..(216): n is a, c, g, or t
  modified_base (297)..(297): a, c, t, g, unknown or other
  misc_feature (297)..(297): n is a, c, g, or t
  modified_base (306)..(306): a, c, t, g, unknown or other
  misc_feature (306)..(306): n is a, c, g, or t
tcagactgtacagtcacgaccggtgctcgatttagagtgagctcgttgggtttggggggggtcacaagaggcagcgctctcgggacgtctccaccatggcctgggctctgctgctcctcactctcctcactcaggacacagggtcctgggcccagtctgccgtgactcagcctgcctcgtgtctgggtctcctggacagtcgatcacctatttccngcactggactcagcactgatgttgctaggtttattactttgtctcctaggtaccaacacaccagcaaacgcccctaaattntacatttanacgacggccaacgtaacgccggtaccctacgtaggtacgttttactaacttccggtacctttccgtccgttagggtcccttaccgtaaacgttccgtggggaccctaggtacccgtaacccgggtcccttaccccgtacggtaacctaaacgttcccgttccggttaccgggggtacccttacccggacgggttccgttagggaaacggggtaccggtacgggtaccgttaaggttaacttttaacgtttaaccgtacgtaccgtttaaccgtacgtaaacttaacgtacgggtaaacctaccgtaacttaccctaaaccgttaaaccgttcccccggttaaccgtttaccccggggaacccggttacggggaaccccgttaaccgggggttaccccttaaccccggggttcccggttaccggggttaacccaacccgggtaaccccccggtaaaacgggtaccccccccgtaaaacccccgtacggtttccccggttaacccccg

SEQ ID NO: 231925 - DNA, 533 bp, Homo sapiens
  misc_feature: GYAE6OF01AYOMP.25.33.C11.1.454.CMB.1.raw
  modified_base (216)..(216): a, c, t, g, unknown or other
  misc_feature (216)..(216): n is a, c, g, or t
tcagactgtacagtcacgaccggtgctcgatttagagtgagctcgttgggtttggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttccngcactggactcagcactgatgttgcaggttattactttgtctcctggtaccaacaaccaccaggcaaaagcccccaaaactttatccatttatgaggccactaagccggccctcaggagtttctaatcgcttctctgctcaagtctggcagcacggcctcctgacatctctgggcctccgagctggaggacgaggctgattacttactgctactcattatgactacatcaacaactcccgtctcggacctgggaccagggtccaccggtccgtacgggtccacggaccccgaaggccccaaaccccgtctcgtaccg

SEQ ID NO: 231926 - DNA, 707 bp, Homo sapiens
  misc_feature: GYAE6OF01A92KF.25.33.C11.1.454.CMB.1.raw
  modified_base (215)..(215): a, c, t, g, unknown or other
  misc_feature (215)..(215): n is a, c, g, or t
tcagactgtacagtcacgaccggtgctcgatttagagtgagctcgttgggtttggggggggtcacaagaggcagcgctctcgggacgtctccaccatggcctgggctctgctgctcctcactctcctcactcaggacacagggtcctgggcccagtctgccgtgactcagcctgcctcgtgtctgggtctcctggacagtcgatcaccatttccngccactggactcagcactgatgtgcaggttattacttgtctctggtaccaacaacaccaggaccaaacgaccccctaaactttactactatttactacggacggacctaacgtaacggccggtacccctcgacggtaacgtttctaacttcgtccttctcgtcggtcctacctaacgttcctggcacgccgaccggtccctacccgtacgaacctaacttcccgtcgtcggggtccctaccgtacgggtcgttagggaacggtaacgggacggtacgttaggtactttaactacgttcggtacttaccttacgtaacgttaagtcggtaacctactaacttaccgtaaacctaaccttacccggttaccgttaccgggtacccgtacggggtacccggtacgggttacccgttacccggtcccggttacggggtaacctacccgggtaccccgtaaccggaccccgtaacccctaccgtccgttaaccccgg

SEQ ID NO: 231927 - DNA, 780 bp, Homo sapiens
  misc_feature: GYAE6OF01A66VQ.25.33.C11.1.454.CMB.1.raw
tcagactgtacagtcacgaccggtgctcgatttagagtgagctcgttgggtttggggggggtcacaagaggcagcgctctcgggacgtctccaccatggcctgggctctgctgctcctcactctcctcactcaggacacgacgggtcctgggcccagtctgccgtgactcacgcctcgcctcgtgtcgtcgggtctccgtggacagtcgactccaaccttactttcctcgcctacgtcggacctacagcctacgtgtagttcggttcgaccgttaaggttttactttacgttttcgttcctaccgttacggtaaaccctaaaccaacccgtaacccgaacggaacccctaaaaccccgtacccccctaaaatttacgtacttaacgttttacgacggaccggtaacctaaaccgtaaccggcccggtacccttacggtaacggttacgtttactaacgttccttacgttcctcgtaccgtccgttaccgtacgtcggtcgacgaccggtccgtccggtacccttcccgaagtaacctacgttccgtccggtccggtaccgtaccgtggtacgtacgggacggtacggacgtactagttaatttaccgtaccgtacgtactaccgtataagtaccgtacgaacctataccgtacaaacctaccggttccctaccggttcgggaaaccctccggggtaaccgtcgggtacccgacccggtttacggggccgtaaacccgccggtaaccccgaccggaaccccttaccgcgttaaccgtaccc

SEQ ID NO: 231928 - DNA, 723 bp, Homo sapiens
  misc_feature: GYAE6OF01CAKQA.25.33.C11.1.454.CMB.1.raw
  modified_base (183)..(183): a, c, t, g, unknown or other
  misc_feature (183)..(183): n is a, c, g, or t
  modified_base (272)..(272): a, c, t, g, unknown or other
  misc_feature (272)..(272): n is a, c, g, or t
  modified_base (315)..(315): a, c, t, g, unknown or other
  misc_feature (315)..(315): n is a, c, g, or t
  modified_base (341)..(341): a, c, t, g, unknown or other
  misc_feature (341)..(341): n is a, c, g, or t
tcagactgtacagtcacgaccggtgctcgatttagagtgagctcgttgggtttggggagctctgggagaggagccccagccctgagattcccagcgtttccattcggtgatcagcactgacacagagaacgcaccatggaggttggactgagtctgggttttccttggttgttttttaaaggngcccagtgtgaatgcggctggaggagtcgtggggagcgtggtacagggccggggggtccctagacgtctcctagtaaacgtctctaggnttcattttgactaggaattatactagtgcacgtgggttcctanaggctcggaggggtccggttataggngttgggtctacgttacttaataacgttgggtatcggtacctaggtatagtacgttagtacggtacgcttcgtaggtacggaacgggtcccgtacgtttccgaacctacgttaccctaacccgtacgtaacgaaaccgaacgtaacggaacctaaaaacccgttcccttaacgtaacttaccgtagtaccgtaaacgttcggaaccgtacccgttagacgtaaacggtagtaaaccggaacgttacggacccgtacctaacgtacgttaacgttacgttacggttaaggtaaaaggtagggtaacgtttacgtaaccgttgttaacggtagaacggtattaaagtttccgttttacgaccggtacgtgttacgggtaaccggg

SEQ ID NO: 231929 - DNA, 786 bp, Homo sapiens
  misc_feature: GYAE6OF01CKRXS.25.33.C11.1.454.CMB.1.raw
  modified_base (402)..(402): a, c, t, g, unknown or other
  misc_feature (402)..(402): n is a, c, g, or t
  modified_base (777)..(777): a, c, t, g, unknown or other
  misc_feature (777)..(777): n is a, c, g, or t
tcagactgtacagtcacgaccggtgctcgatttagagtgagctcgttgggtttgggggagctacaacaggcaggcaggggcagcaagatggtgttgcagacccaggtcttcatttctctgttgctctggatctcgtggtcgccgtacggggacatcgtgttcgaccctacgtcccccggtctccctgcctgtgtctcgtgggcgaggacggccaccatcatcgtgactaacgtccagaccagtaacttccttcttacctttaaccctaccaaactaactctaagtaacttaccttaaacctttaaaagttaccggtaaccacgaaccgaaaacgaaaacccgtacggaacccctaaccccgttaaccgtttaaacgtttaaccttcttaaagttttaccggngggtaccttaagttccgtttaaggttaccggggaaaccggttccccggggttaccccgtacggtaaccgtaacgtttcggaaggggttcggaccggacgggtccgggtacgtacggggaacctacggtaccttccgtaccttccgtaaccctctaacgttacccgaacgtccggtaccgtcgggaacgacggtacctaaggaaacggtgtacgggtacgttacctttaaccgtttagttaccgtacgtacaacgtaataaatttaacttacctaacttaccgttaccgttacgttacgtttacgggaccgtagggacctaaggtccgagggtaccgacgtacccgtaacggtacgtcggacgtccacgtacctcngtcgttacg

SEQ ID NO: 231930 - DNA, 760 bp, Homo sapiens
  misc_feature: GYAE6OF01DZ9EI.25.33.C11.1.454.CMB.1.raw
  modified_base (222)..(222): a, c, t, g, unknown or other
  misc_feature (222)..(222): n is a, c, g, or t
tcagactgtacagtcacgaccggtgctcgatttagagtgagctcgttgggtttggggggggtcacaagaggcagcgctctcgggacgtctccaccatggcctgggctctgctgctcctcactctcctcactcaggacacgagggtcctgggcccagtctggccgtgactcagcctgcctccgtgtcgtgggtctcgtggacagtcgatccacctattttccngcctagtcggacctcagcctagtgagtttggtacgtacgttaaggtttatttaccgttttcgtccttccgtacggtaacccaaacgaacccaccgaacggaaccaaaccgtaccccctaaaactttataccttaatttaagacgtaaccggaccctaaacgttaaccggcccggtaaccctacgtaacggttaagtttacctaagttccgtactttacgtacgtaccggtccttaacgtaacgtcgttacggactaaacgtacccgtcccctaaccaactaacgttcgtaaccggtcggtaccctacgaaggtcttaggaaacgtacgtacgggttctttacgtttagtttacgtcgtcgttgggttactcgttacgttggtaaccggtaactaaacggtaaacctttagtttcgggtacgtaccggtacggggaccgtaccgggaacctttaacgtcggtaccgtacgttaacgcggaaccgttacccgaggtcccgttaaccgtccccccgtattcctaccgtcccgtttccccgg

SEQ ID NO: 231931 - DNA, 857 bp, Homo sapiens
  misc_feature: GYAE6OF01EP230.25.33.C11.1.454.CMB.1.raw
  modified_base (199)..(199): a, c, t, g, unknown or other
  misc_feature (199)..(199): n is a, c, g, or t
tcagactgtacagtcacgaccggtgctcgatttagagtgagctcgttgggtttgggggagctacaacaggcaggcaggggcagcaagatggtgttgcagacccaggtcttcatttctctgttgctctggatctctggtgccgtacggggactatcggtgttcgacccgacgtcccccggtctccctgcctgtgtctcgngggcaggacggcctaaccatcatcgtagacaagtccagaccgtaagtaacttcctactttaccgtttaaccacctaaaacaactacaagtaacttacctaaccttaaaagttcggtaaccagacaaagaaaccgaacggaacctaccctaaccgtaacgttaactacgttaacttacgtacgggtactagtacctacgtacgggtacgtacccgggtcctacggacgtatcgtaggtcgcgaacggtcggttcggtacggtaaccgtaggtacctacgtaaccttcctaaccgtaaccgtaacgtaccggaacgtaccgtaccctaaggacccgtaaggtaccgtaaggtaaacggttaaccgtagggttaaccggtaaccgtttaaacgttttaaccgttaaagtccggttaaactaacggttaaacgtaaatttaaccgtttaaaccttaacccgttaaacgtttaccccgttttaaacgttaccggttttacccgggaacccgggtaaaacgggggtaacctaaaccccggggttagtaaccgggggtaaacttaacccggttaaccggtaaacccgggttaaacgtttgggtaaccggtacccgttaccgggtaaacccgttaaaccgttaaccgtttaccggtttaaacccgg

SEQ ID NO: 231932 - DNA, 651 bp, Homo sapiens
  misc_feature: GYAE6OF01DGENT.25.33.C11.1.454.CMB.1.raw
  modified_base (249)..(249): a, c, t, g, unknown or other
  misc_feature (249)..(249): n is a, c, g, or t
tcagactgtacagtcacgaccggtgctcgatttagagtgagctcgttgggtttggggggggtcacaagaggcagcgctctcgggacgtctccaccatggcctgggctctgctgctcctcactctcctcactcaggacacgagggtcctgggcccagtctgccgtgactcagcctgcctcgtgtctggtctcctggacagtcgactcactatttcctgctacgtggactcagcactgatgtgactagttnttacttgtctctacgtacacacaccagacaaccgtaccctaatatactattagcgacgacctaacgtacgccgcctagacgtagttactactctcttcgtcgtcgtctactacgtcgtcgcgacgtccgaccggtccttacccgtacgtacctaacgttccgtccggtccgggtccgtaccggtacggtacgacgggtacggacgggtacggtacgttaagttatttaacgttccgtacgtccttaactacgtacgtacgtacgtaacctacgtacttaaccgaaccttaacccgttcccgttaccgtaccggtaccgtcgggtacccggtaacggtcccgtccgggtaccgtccggtaccgaccgtacccgtaacccgacccacccctgttaccgtacccg

SEQ ID NO: 231933 - DNA, 661 bp, Homo sapiens
  misc_feature: GYAE6OF01EZVTT.25.33.C11.1.454.CMB.1.raw
tcagactgtacagtcacgaccggtgctcgatttagagtgagctcgttgggtttggggagctctgggagaggagccccagccctgagattccccaggcgtttccattcggtgatcagcactgaacacagagaacgcaccatggaggttggactgagcttgggttttccttgtttgtttttttaaaaaggtgcccagtgtgaagtgcggctggaggagtcgtggggggaggcggtggtacgaggccgggggggtcccttagacctctcctgtaaagtctctggattctaatttgatgaatatactatgctacgtgggtccgtcgaggctcgagggggacgggtcgtaggaggttcgggtctcgttactttaataaaagtttggggtagttcgggtttccgaagttaactaagtacgttaagtgttagggcttcgtggtaggaagggtcccgctttccaaccctatctaccagacgacaacagaacaaaaccctccctactatctgactaaatcgacgacccgtagacgaagtagaacgacaggccgaacccgatattaattacgttaggtaagtaaagggagggtaacgttacggtaaaccttcgttacggaaggtacgtaacgtaacgtttaacgtttacgtacggtctaaggtcggtacgg

SEQ ID NO: 231934 - DNA, 795 bp, Homo sapiens
  misc_feature: GYAE6OF01ALG85.25.33.C11.1.454.CMB.1.raw
  modified_base (202)..(202): a, c, t, g, unknown or other
  misc_feature (202)..(202): n is a, c, g, or t
tcagactgtacagtcacgaccggtgctcgatttagagtgagctcgttggggtttgggggggggtcacaagaggcagcgctctcgggacgtctccaccatggcctgggctctgctgctcctcactctcctcactcaggacacgagggtcctgggcccagtctgccgtgactcagcctcgcctccgtgtcgtggtctctggacngtcgatcacctattctgccacgtggactcacgctaacgtgtacgttgttacgtacgttaacggtttactttaactttcggtccttaccgtaacggttaacccaaaaccaaacccgaaccccgaacggaaccccgtaaaaaccccgacccccttaaaaactttacttacctaagttttaacgacggaaccggaccctaaacggtaaccggcccgtaccctaagtacggttagtttactaacgtccgtacttccgtaccgttaggacctacgtaacgtcggtacgccgacggtacccgtaccggtcccttaccgtacgtaacctaacgttcccgtacggtccgggtaacctcgaaacggtcgttaacggaacggtacggaacggttcctaacgttaatttaacgttactccgttaacgtactaagtacttaacggaccgtaactaactaacctacgtaaacccgtacccgttcccggttacggaacccggtccgtaccggggtaaccgtaccgggtcccgtaacccggtcggtacgggtacccgaacccgttacccggaaacccggtaccccaacccgtaagttcccggtaaccc

SEQ ID NO: 231935 - DNA, 742 bp, Homo sapiens
  misc_feature: GYAE6OF01D3EE4.25.33.C11.1.454.CMB.1.raw
  modified_base (492)..(492): a, c, t, g, unknown or other
  misc_feature (492)..(492): n is a, c, g, or t
  modified_base (514)..(514): a, c, t, g, unknown or other
  misc_feature (514)..(514): n is a, c, g, or t
tcagactgtacagtcacgaccggtgctcgatttagagtgagctcgttggggtttggggggggtcacaagaggcagcgctcgtcgggacgtctaccaccatggcctggctctgctgcttcctcactctcctcactcaggacacgagggtcctgggcccagttctgccgtgacctcagcctcgcccgttccgtgttcgtgggttacctccgtagggacctagtccgaactccgaaccttacgttttcccaggtcctaccgtggaccttcgaacgcctaacgtggtaattggtcgtactaaggtttatttactttacgtctccgtaccggtaaccaacaaccgaccctaggaccaacctaccccgtaacttacgtctaatttacgtcggacgtacctaacgtaacggccgttaccgtacgtacggttaacgttactacgtccgtcttccgtactcgtactcgtaacgtcgtcgcgacgtcgacgtcctaccgtanactatcgtcgtacggctaccgngtaccgtggacggacgacgtacgtcgttaagttacctacgtacgtacttaagtctaacgttccgttaagaacctaacgtactaacgtaaccgttaccggttcccgttaaccgtccgggtaacccgtcgggtaacccggtacgggttaccctaacccgggttcggtaccgggtaccgaccggtaccccggtaaacccgacccctaacccttaaccgttcggtaaccccg

SEQ ID NO: 231936 - DNA, 883 bp, Homo sapiens
  misc_feature: GYAE6OF01DVVZI.25.33.C11.1.454.CMB.1.raw
tcagactgtacagtcacgaccggtgctcgatttagagtgagctcgttgggtttgggggagctctgggagaggacgccccagccctgagattccccgaggtcgtttccattcggtgatcagcactgaacacagagaacgcaccagtggaggttgactgagtcgttggtttttcctttaggttttaggtttttttaaaggtcgtacccgtaggtgtaggaagtggcggtgtgggaggtacggtcgggtaggggggacggtcggtgggtaccgtacgggggtcccgggggggttacccttagtaccgttccgttaccgttaggtaaacgttccgtacgtaggtactttacgttaattttagattacgtaattacttactagtcgtaccgtacggttcgggttccgtaccggacggtccgtacggggtacggggggtaccggttaggtaagggtacggttcgggtttaccttacgttaacgttttaaaggtttaaaggttgggtacgttacggttacgtaagtaacgttaagtacgttaggttacggtgtcgtttacgtacgggttaggacccggtaccgttccttaccgacctacgtccctaaccgaacgaacggaaaccaaccgaacgtaaaccccttaaaccccttcccttatacgtttaccgacgtaacctaacgggtacggaccgttacccgaggtaaccggtaagaacggtaaccgagtaccggaccctaacgactttaagtttagtttaggtaaagggttaagtaaacggggtaggttaaaccgtttacggaacgtttaccggtaacggtagtaacccggtttaattaaacccggttttacgtttaacggaccgggtttactcggggtacggttaccggg

SEQ ID NO: 231937 - DNA, 925 bp, Homo sapiens
  misc_feature: GYAE6OF01EEPFC.25.33.C11.1.454.CMB.1.raw
tcagactgtacagtcacgaccggtgctcgattttagagtgagctcgtttgggtttggggagctctgggagaggagccccagccctgagattcccaggcgtttccattcggtgatcagcactgaacacagagaacgcaccagtggtaggttggactgagtcgtttgggtttttacctttgttttagtttttttaaaaggcgtccctagttgtagaagtggcggtcgtagggacggtagtcgggtggggggacggtcggttggtaccggacggggtcccgggggggttacccttagaccttccgtccgttaggttaaacgtcgttacgttggtaatttacgttaatttttagtaatttaaagttattaactagtcgtaccgtaccggttcgggttaccgtcgtaagggtccgttacgggaacgggggggtaccggttaccgttaaggggtacgggttcggggttacctttacgtttacgttttaaagttaaaacggtttggggtacgtttacgggtttaacctaaggtttacgtaaacggttaacgtttaaggttacggtaacggttcccgtttaagttacggggtaacgggtaaccccgggttcgttccctttacccgaacctacgttaccctaccggaaggaaccgtaaccgaaactaaccgaaaccttaaaacccgttccccttataaccttcgtaaacgacgttaaaggtaccgaacccgtaccggaggtaacggaagtaaccggaacacggaccgtacctacctaaagttaattagtttaactaagggtaaaccgggttaaaggttacggggtttaaccgttaaacggttaaccgttcggttacggaaaggtaccggttaaacgttacggttttacttaaccgggtactaaggtcggttaaaccggttcgggtaacccgggg

SEQ ID NO: 231938 - DNA, 732 bp, Homo sapiens
  misc_feature: GYAE6OF01DHHS0.25.33.C11.1.454.CMB.1.raw
  modified_base (226)..(226): a, c, t, g, unknown or other
  misc_feature (226)..(226): n is a, c, g, or t
  modified_base (429)..(429): a, c, t, g, unknown or other
  misc_feature (429)..(429): n is a, c, g, or t
tcagactgtacagtcacgaccggtgctcgatttagagtgagctcgttggggtttgggggggggtcacaagaggcagcgctctcgggacgtctccaccatggcctgggctctgctgctcctcactctcctcactcaggacacagggtcctgggcccagtctcgccgtgactcacgcctgcctccgtgtcgtgggtctccgtggacaggtcgactccacctatttccngacctactcggactcagcctacgtgagttggttcgacgtaggtttactttacgtttcgtacttccgtacggtaaccaacaaccaccgtacggaccaaaccgacccctaaattctactatttagacgacgacaacgtacgccggtcctagtacggtactttactaactccgtacgttctcgtcgccgtaccgtaacgttccggngtacacgtccgtaccggtcccttaccgacgtaccgtatccgtaccggtcgggtccttacgacgggttacgtcgggaacggcggtacggcgttaggtaatttacgtacgtcgactttactacgtaagttaccgacgtaaccagtaacctaccgttaacctacccggttacccttacggttaacccgggacccggttaccggggaaacccgttccggggtacccgttaacccggttccgggtaccgggtaccctaaaccccggccccgaaacccgggtacccccaacccttccgccgttaacccg

SEQ ID NO: 231939 - DNA, 632 bp, Homo sapiens
  misc_feature: GYAE6OF01DXBV7.25.33.C11.1.454.CMB.1.raw
  modified_base (191)..(191): a, c, t, g, unknown or other
  misc_feature (191)..(191): n is a, c, g, or t
  modified_base (216)..(216): a, c, t, g, unknown or other
  misc_feature (216)..(216): n is a, c, g, or t
  modified_base (237)..(237): a, c, t, g, unknown or other
  misc_feature (237)..(237): n is a, c, g, or t
  modified_base (390)..(390): a, c, t, g, unknown or other
  misc_feature (390)..(390): n is a, c, g, or t
  modified_base (623)..(623): a, c, t, g, unknown or other
  misc_feature (623)..(623): n is a, c, g, or t
tcagactgtacagtcacgaccggtgctcgatttagagtgagctcgttggggtttggggggggtcacaagaggcagcgctctcgggacgtctccaccatggcctgggctctgctgctcctcactctcctcactcaggacacagggtcctgggcccagtctgccgtgactcagcctgcctcgtgtctgggtcncctggacagtcgatcaccatttccngcatgactcagcatgatgttnactagttattacttgtctctacgtaccaacacaccagaccaacgacccctaattatactatttaagcgacgaccacgtagccgacctagagtacgttacatcgacttgtctcgactacgaagtcgtacgtcacgtccgacgtcctaccgttanaactaacgttcctcggtacgggtcctaccggaggtccgtacgggaacgggtacccggtggtaccttaggtaactttacgttaacgtcgtacccttaacgttcgaagtttacgtacgaacctaccgaacgtttaccaaccggttaaccttcccgttacgtaccgggaccgtacgggacccgtacgggtctacccggtcgttaccggacaccgtacccgtaacgccctaacccgntcgtacccg

SEQ ID NO: 231940 - DNA, 803 bp, Homo sapiens
  misc_feature: GYAE6OF01EU35E.25.33.C11.1.454.CMB.1.raw
  modified_base (121)..(121): a, c, t, g, unknown or other
  misc_feature (121)..(121): n is a, c, g, or t
  modified_base (253)..(253): a, c, t, g, unknown or other
  misc_feature (253)..(253): n is a, c, g, or t
tcagactgtacagtcacgaccggtgctcgatttagagtgagctcggttgggttggggggggtcacaagaggcagcgctctcgggacgtctccaccgatggcctgggctctgctgcctcctnactctcctacactcaggacacgaggggtcctacgggcccaggtcctgccgtgacctcgagtccgtcgccttacggtgtcgttcgggtcctccggttacgacgagttacgactaccgaccttaggttttcccnggaccgtacttacggaacctcgaacggctaacgtgaacgttgtcgtacgttacggtttactttacgttcggtactccgtagtaaccaaacgaaccgtaccgacggtaccaaaaccggtacccctaaagttactcgtagtttacgcgtaacggcctaacgtacgaccgtaccgtacggtagttacgttactacgttcggtcctttacgtacgcggttacctacgtaacgttcgtaacggcctaaccgccgtaccggtacctaccgtacggaactacttccggtacgtcgggaccttacggacggtcggttacggacgggtaacgtacgggttacctaaggttctttaacggttaccctaggtaccttaacggtctaaaggttacctaaccggaaccgtacttaaaccggtaaaccgtaacccgtttaaaccgtcccccgggttaggtttaaccccgggaccggtaaccggggtaccgtaccggtcgtaccccggttggtaccgggtactaccgaacccggttaaccgacccgtaccgtacgtcttacccgg

SEQ ID NO: 231941 - DNA, 791 bp, Homo sapiens
  misc_feature: GYAE6OF01A2T1E.25.33.C11.1.454.CMB.1.raw
  modified_base (228)..(228): a, c, t, g, unknown or other
  misc_feature (228)..(228): n is a, c, g, or t
tcagactgtacagtcacgaccggtgctcgatttagagtgagctcgttggggtttggggggggtcacaagaggcagcgctctcgggacgtctccaccatggcctgggctctgctgctcctcactctcctcactcaggacacgagggtcctcgggcccagtctgccgtgactcacgcctgcctcgtgtctgggtcctccgtaggactagtcgatccaccttagttttccngacctacgtggacctcgacgctaacgtgtagtttggttacgacgtttaacggttttacttttaccgttttcgttcccttaccggttaacggtaacccaaaaccaaacccgaaaccgaaccggtaaccaaaacccgtaaccccctaaaatttcctacgttaatttacgacggaccgtaaccaaccgtaacggcccggttacctagtaacgggttactttaccgtaacttccgtcgttcctacgttcggtactacgtaacgttcgtacgactaccggacgtacccgtcccgttaccgtacggtaactaccttacgttacccggtcggtacccgtaccgggtaacgtaccgggtaagggtaacgggaacggttacgttaccggtaagtttaaccgtttacgttacctcgttaacgttacctacgtaagttacgacgtaacctaactacttaccgaaccttaacccgttccgtaccggttaaccgtccgggtaacgtccgtacgggtaccctaccggcgttaccgccggaaacctacccggaacaccccctaccgtagtccgtaccc

SEQ ID NO: 231942 - DNA, 692 bp, Homo sapiens
  misc_feature: GYAE6OF01CPAGZ.25.33.C11.1.454.CMB.1.raw
  modified_base (127)..(127): a, c, t, g, unknown or other
  misc_feature (127)..(127): n is a, c, g, or t
  modified_base (163)..(163): a, c, t, g, unknown or other
  misc_feature (163)..(163): n is a, c, g, or t
  modified_base (182)..(182): a, c, t, g, unknown or other
  misc_feature (182)..(182): n is a, c, g, or t
  modified_base (378)..(378): a, c, t, g, unknown or other
  misc_feature (378)..(378): n is a, c, g, or t
  modified_base (545)..(545): a, c, t, g, unknown or other
  misc_feature (545)..(545): n is a, c, g, or t
  modified_base (667)..(667): a, c, t, g, unknown or other
  misc_feature (667)..(667): n is a, c, g, or t
tcagactgtacagtcacgaccggtgctcgatttagagtgagctcggttgggggtttggggggggtcacaagaggcagcgctcgtcgggacgtcctccaccagtggccgtggctctgctgcctcctcncctctcctcactcaggacacgcgggtccgtcggccngtcgtcgccgtagactcgncctcgccgtccgtgtcgtcgggtctacgtgacgacgtcatcctactacttcctgactcgtgactcgagctagtgtagtgtacgtacgttgtttacttcgttcgtaccttccgtaacgaaacccaaaccgaacccgaaccgtaacggtaacccaaaaccccgttaacccctaaactttagtaaccttagttaaccgnggtaacccgaaccgaacggttaaccggcccgtcccgaaggttaggttaacctttaccgtagttccaccgtttcgccggtcgtaccttacggacttcggcgtaccgaccgcccggttaccgccgtacctagtaacccgtcgttcgtaccggttcggccgttaacgggngacgaggaccggtaacgtgttaccgtaagttaacttgacgttccgatttacgacgtatcgataactcaagtacaacgtccgtcgtaccgtcggaccgtagaccgcgtaccgcgtcgacgacncccgagtaccccacacctgacgtcc

SEQ ID NO: 231943 - DNA, 685 bp, Homo sapiens
  misc_feature: GYAE6OF01CJ2FX.25.33.C11.1.454.CMB.1.raw
  modified_base (204)..(204): a, c, t, g, unknown or other
  misc_feature (204)..(204): n is a, c, g, or t
  modified_base (601)..(601): a, c, t, g, unknown or other
  misc_feature (601)..(601): n is a, c, g, or t
  modified_base (622)..(622): a, c, t, g, unknown or other
  misc_feature (622)..(622): n is a, c, g, or t
  modified_base (641)..(641): a, c, t, g, unknown or other
  misc_feature (641)..(641): n is a, c, g, or t
  modified_base (676)..(676): a, c, t, g, unknown or other
  misc_feature (676)..(676): n is a, c, g, or t
tcagactgtacagtcacgaccggtgctcgatttagagtgagctcggttggggtttggggggggtcacaagaggcagcgctctcgggacgtctccaccatggcctgggctctgctgctcctcactctcctcactcaggacacaggtcctgggccagtctgccgtgactcacgcctcgcctccgtgtcgtgggtcctcctcggacngtcgatcaccatttcctgcactcggactcacgcactgatgttgctaaggttatttactttcgtcttcctacggtaaccctaacaaccaacccctaggaacaaaaccgtaccccctaaaaacttactacctaacgtttagacggacggacctaacgttaaacgccggtaccctacgaaggttacgtttaccaagttccgtacgtttcctcgtcggtacctaccgtaaagtcgtggtacacgtaccgaccggtaccctccctaggtaacacttaccgttcgacgggtccctacccgaggtacgtacgggaaggtaccggagtacgttagtaattaacgttaccgtgtaaccttacgtactaatagtacgaaccatacgtaacaaccgtaacgtcccgtntacccggactacggggaaccncgggtacctaccggtccgnggaccaaacggccctaaaacggccccaaacccgtntcgtaaccc

SEQ ID NO: 231944 - DNA, 213 bp, Homo sapiens
  misc_feature: GYAE6OF02GUMPC.25.33.C11.1.454.CMB.1.raw
  modified_base (175)..(213): a, c, t, g, unknown or other
  misc_feature (175)..(213): n is a, c, g, or t
tcagactgtacagtcacgaccggtgctcgatttagagtgagctcgttgggtttggggaagaggaagactgacggtccccaggagttcaggtgctgggctacagcggccctggctgcctggtcaaggactacttccacctgtacagtctggagcgggctggctaaggcgcatagtnnnnnnnnnnnnnnnnnnnnnnnnnnnnnnnnnnnnnnn

SEQ ID NO: 231945 - DNA, 172 bp, Homo sapiens
  misc_feature: GYAE6OF02FWKYW.25.33.C11.1.454.CMB.1.raw
  modified_base (171)..(172): a, c, t, g, unknown or other
  misc_feature (171)..(172): n is a, c, g, or t
tcagactgtacagtcacgaccggtgctcgatttagagtgagctcgttgggtttggggaagaggaagactgacggtccccaggagttcaggtgctgggcacagcggccctgggctgcctggtcaaggactacttccactgtacagtctgagcgggctggcaaggcgcatagnn

SEQ ID NO: 231946 - DNA, 173 bp, Homo sapiens; identical to SEQ ID NO: 231875
  misc_feature: GYAE6OF02FNBDJ.25.33.C11.1.454.CMB.1.raw
  modified_base (173)..(173): a, c, t, g, unknown or other
  misc_feature (173)..(173): n is a, c, g, or t

SEQ ID NO: 231947 - DNA, 808 bp, Homo sapiens
  misc_feature: GYAE6OF02IQC7R.25.33.C11.1.454.CMB.1.raw
  modified_base (186)..(186): a, c, t, g, unknown or other
  misc_feature (186)..(186): n is a, c, g, or t
  modified_base (234)..(234): a, c, t, g, unknown or other
  misc_feature (234)..(234): n is a, c, g, or t
  modified_base (264)..(264): a, c, t, g, unknown or other
  misc_feature (264)..(264): n is a, c, g, or t
  modified_base (349)..(349): a, c, t, g, unknown or other
  misc_feature (349)..(349): n is a, c, g, or t
tcagactgtacagtcacgaccggtgctcgatttagagtgagctcgttggggtttggggggtcgacaaggaggccagcgctcgtcgggtacgtcgtcctacccattggcctgggctctgctgctacctcactctcctcactcaggactacgaggtcctgggcccaggttcctgtccgtgacttacgngcctgcctcgtgtctggtctcctggacagtcgagtcacctagtttccngccggtacctggactcagcactgactgtcnctaggttattactttcgtctccgtggtaccaacgaacctacccaggccaaacgtcccccgtaaaacttactacgtacttttacgngggaacgggccctaacgtaaaggccgggtacccccttacgaacgggttaacgttttttaccgtaaaacgttccggtaccttttaccgtacgtttcgggtaccctttacccgaaagttccgttacgggtacccgtaacgggccctaaaccgggttccccttacccccgtagtaaccctaacttcccgttacgtacggggtacctttaccccgaagggtacccttagggacgggttaacccggtagggtaccttaggaaacttttaacctttacgtcgtacccttaacgtcaacgttacgttacggtaactactacttaccgtaaactaaaccgttcccggtacttaccgggtacctaccggggaacccgtaacggggttacccaacccggtttcccgtacggggtaaccctacggaccccgtaaacgggtcccctaaacccccgtacgttcggtaacccg

SEQ ID NO: 231948 - DNA, 543 bp, Homo sapiens
  misc_feature: GYAE6OF02IDCMB.25.33.C11.1.454.CMB.1.raw
  modified_base (325)..(325): a, c, t, g, unknown or other
  misc_feature (325)..(325): n is a, c, g, or t
tcagactgtacagtcacgaccggtgctcgatttagagtgagctcgttgggtttggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttcccgcactggactcagcactgatgttgcaggttattactttgtctcctggtaccaacaacacccaggcaaagcccccaaattatcattttatgaggccactaagcggccctnaggagtttctaatcgcttctctggctccaagtctggcagcacggcctcctgacatctctgggctccaggctgaggacgaggctgaattattactgactactcattatggacacatcaacaaactcccgtcttccgacctgggaccctagggtccaacccggttcctcgggttccacggaccccaacgggccccaaaccccgacttcggtaccctaccg

SEQ ID NO: 231949 - DNA, 174 bp, Homo sapiens; identical to SEQ ID NO: 231869
  misc_feature: GYAE6OF02H2BRY.25.33.C11.1.454.CMB.1.raw
  modified_base (173)..(174): a, c, t, g, unknown or other
  misc_feature (173)..(174): n is a, c, g, or t

SEQ ID NO: 231950 - DNA, 526 bp, Homo sapiens
  misc_feature: GYAE6OF02G0Q8N.25.33.C11.1.454.CMB.1.raw
  modified_base (409)..(409): a, c, t, g, unknown or other
  misc_feature (409)..(409): n is a, c, g, or t
tcagactgtacagtcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgttgacccagtcccccggtctccctgcctgtgtctctgggcgagagggccaccatcatctgcaagtccagccagaatctcttctttacctccaacaatcagatctacctaaattggtaccagcagaaaccaggacaccctcctaagttactcattactggcatctattcgggaatccggggtccctgaccgattcagtggcagcgggtctgggacagacttcactctcaccatcgacagcctgcaggctgaagntgtggcttacttattactgtcagcaattattatactactccgttactacttttcggccgtacggggaccagctaggagtactcccgacgaacgttgtcggtctagccaccatcttcg

SEQ ID NO: 231951 - DNA, 570 bp, Homo sapiens
  misc_feature: GYAE6OF02H8S9E.25.33.C11.1.454.CMB.1.raw
tcagactgtacagtcacgaccggtgctcgatttagagtgagctcgttgggtttgggggaggcgtggtacagccgggggggtcccttagactctcctgtaaagtctctggattcaattttgatgaatatactatgcactgggtccgtcaggctcaggggacgggtctagagtgggtctctcttataaattgggatggttccagtatagactatgtaggctctgtgaagggccgcttcaccatctccagagacaacagcaaaaaactccctctatctgcaaaatggagaccctgcgaagtgaagacagcgcccacatattattgtgtaaaagaggggatttcggaaaactctttacgagaggacaagtttcttttactacggcatggacgtctggggccgagggaccacggtcaccgtgtcctcagccctccaccaacgggcccatccggtccttccccctcggccaccccttccctcccaagacgccacctcctgggggccaccacgccggcccgtgggcctgccgtgtcaggactacctccactgtacagtctgacgcggctggcaggcg

SEQ ID NO: 231952 - DNA, 512 bp, Homo sapiens
  misc_feature: GYAE6OF02GCFTD.25.33.C11.1.454.CMB.1.raw
  modified_base (303)..(303): a, c, t, g, unknown or other
  misc_feature (303)..(303): n is a, c, g, or t
  modified_base (323)..(323): a, c, t, g, unknown or other
  misc_feature (323)..(323): n is a, c, g, or t
  modified_base (421)..(421): a, c, t, g, unknown or other
  misc_feature (421)..(421): n is a, c, g, or t
tcagactgtacagtcacgaccggtgctcgatttagagtgagctcgttgggtttgggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttcctgcactggactcagcactgatgttgcaggttattactttgtctcctggtaccaacaacacccaggcaaagcccccaaattatcatttangaggccactaagcggccctnaggatttcaatcgcttctctggctccaagtctggcagcacggcctcctgacaatctctgggctcaggctgaggacgaggctgattattactgctttcncactatgtcggcagttagctacgttgggtgttcggcaggacgggaaccaaaggtcgaccgtcgtggtcagcccgaaggcctcgcccctcgg

SEQ ID NO: 231953 - DNA, 517 bp, Homo sapiens
  misc_feature: GYAE6OF02HOM43.25.33.C11.1.454.CMB.1.raw
  modified_base (306)..(306): a, c, t, g, unknown or other
  misc_feature (306)..(306): n is a, c, g, or t
  modified_base (324)..(324): a, c, t, g, unknown or other
  misc_feature (324)..(324): n is a, c, g, or t
  modified_base (342)..(342): a, c, t, g, unknown or other
  misc_feature (342)..(342): n is a, c, g, or t
  modified_base (416)..(416): a, c, t, g, unknown or other
  misc_feature (416)..(416): n is a, c, g, or t
  modified_base (427)..(427): a, c, t, g, unknown or other
  misc_feature (427)..(427): n is a, c, g, or t
  modified_base (444)..(444): a, c, t, g, unknown or other
  misc_feature (444)..(444): n is a, c, g, or t
  modified_base (450)..(450): a, c, t, g, unknown or other
  misc_feature (450)..(450): n is a, c, g, or t
  modified_base (466)..(466): a, c, t, g, unknown or other
  misc_feature (466)..(466): n is a, c, g, or t
tcagactgtacagtcacgaccggtgctcgatttagagtgagctcgttgggtttgggggggtcacaagaggcagcgctctcgggacgtctccaccatggcctgggctctgctgctcctcactctcctcactcaggacacagggtcctgggcccagtcctgccgtgactcagcctgcctccgtgtctgggtctcctggacagtcgatcaccatttcctgcactggactcagcactgatgttgcaggttattactttgtctcctggtaccaacaacacccaggcaaaacgccccaaacttatcatttangagccactaagcggcctnagagtttcaatcgcttcnctgctcaagtctgcagcacggcctccctgacatctctgggctccaggctaggaggacgaggctagattattacngctactcatangacacatcaaactaacncccgtntccggacctgggaccngggtccaccgtccgtgggtccacggcccaacggcccaacccctagtctacc

SEQ ID NO: 231954 - DNA, 539 bp, Homo sapiens
  misc_feature: GYAE6OF02GSSR6.25.33.C11.1.454.CMB.1.raw
  modified_base (217)..(217): a, c, t, g, unknown or other
  misc_feature (217)..(217): n is a, c, g, or t
tcagactgtacagtcacgaccggtgctcgatttagagtgagctcgttgggtttggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccattttccngcactggactcagcactgatgttgcaggttattactttgtctcctggtaccaacaacacccaggcaaagccccaaacttatcatttatgaggccactaagccggccctcaggtagtttctaatcgcttctctggctccaagtctggcagcacggccctcctgacaatctctgggctccgaggctgaggacgagcttgatttattactgctactcatatggacacatcaactaaactcccgtacgttccggaccgtcgggaccgtagggtcctaccggtcctgggtccacggccccgaacggccccaaccccacgtctacccg

SEQ ID NO: 231955 - DNA, 608 bp, Homo sapiens
  misc_feature: GYAE6OF02I021M.25.33.C11.1.454.CMB.1.raw
  modified_base (329)..(329): a, c, t, g, unknown or other
  misc_feature (329)..(329): n is a, c, g, or t
  modified_base (372)..(372): a, c, t, g, unknown or other
  misc_feature (372)..(372): n is a, c, g, or t
tcagactgtacagtcacgaccggtgctcgatttagagtgagctcgttggggtttggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttcctgcactggactcagcactgatgttgcaggttattactttgtctcctggtaccaacaaccaccaggcaaacgccccaaaacttatcatttatgaggaccaactaagcggccctnaggtagtttctaatcgtcttctctggcctaccaagtctggacngcacggccctccctgactaactctcgtcgggcctccgaggcctaggacggacggacggtctagtaatttacttactcgtaccttactacctaattaacgtacggaaccactactaccaaacctaaaacttccccggttactttaccgggaccgttcgggaacccgtacgggttacccacccggttccgtacgggtccgaacgcccgaaaccggccccaaaccccgtactcgtaccc

SEQ ID NO: 231956 - DNA, 523 bp, Homo sapiens
  misc_feature: GYAE6OF02GMABY.25.33.C11.1.454.CMB.1.raw
  modified_base (307)..(307): a, c, t, g, unknown or other
  misc_feature (307)..(307): n is a, c, g, or t
  modified_base (344)..(344): a, c, t, g, unknown or other
  misc_feature (344)..(344): n is a, c, g, or t
  modified_base (473)..(473): a, c, t, g, unknown or other
  misc_feature (473)..(473): n is a, c, g, or t
tcagactgtacagtcacgaccggtgctcgatttagagtgagctcgttgggtttggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttcctgcactggactcagcactgatgttgcaggttattactttgtctcctggtaccaacaacacccaggcaaacgcccccaaacttatacatttangaggccataagcggcctcaggatttctaatcgcttcnctggctcaagtctggcagcacgcctcctgacaatctctcgggctccgagctgaggacgaggctgattattactgtactactctatagtgacacgactacaactaaactccgtacttccgactggaccgnggtccaccgtccgtggccacgaccgaaccgcccaacccgacgtgtacccg

SEQ ID NO: 231957 - DNA, 561 bp, Homo sapiens
  misc_feature: GYAE6OF02GEQOS.25.33.C11.1.454.CMB.1.raw
  modified_base (301)..(301): a, c, t, g, unknown or other
  misc_feature (301)..(301): n is a, c, g, or t
  modified_base (371)..(371): a, c, t, g, unknown or other
  misc_feature (371)..(371): n is a, c, g, or t
tcagactgtacagtcacgaccggtgctcgatttagagtgagctcgttgggtttgggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttcctgcactggactcagcactgatgttgcaggttatactttgtctcctggtaccaacaacaccaggcaaacgccccaaattatcatttangaggccactaagcgccctcaggtagttctaatcgcttctctggctaccaagtctggcagcacggcctccngacatctcgtggctccgagcgtgacggacgaggctgattatactgctactcatagtaggacacgtatacaactaaacgtcccgttacgttccggtaccgtcgggaaccgtacgggtacctacccggtccgttacgggtacctaccggaccccgaaacggacccccaacccccgtacgttaccgtaacccg

SEQ ID NO: 231958 - DNA, 516 bp, Homo sapiens
  misc_feature: GYAE6OF02FXI0M.25.33.C11.1.454.CMB.1.raw
  modified_base (302)..(302): a, c, t, g, unknown or other
  misc_feature (302)..(302): n is a, c, g, or t
  modified_base (448)..(448): a, c, t, g, unknown or other
  misc_feature (448)..(448): n is a, c, g, or t
tcagactgtacagtcacgaccggtgctcgatttagagtgagctcgttgggtttgggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttcctgcactggactcagcactgatgttgcaagttattactttgtctctggtaccaacaacacccaggcaaagcccccaaattatcatttangaggccactaagcggccctcaggtagtttctaatcgcttctctggctcaagtctggcagcacggcctcctgacatctctggctcaggctgaggacgaggctgattatactgcctatcatatcggacacatcaacaaactcccgttntacggacctagggacctacgggtccacccggtcgtggtccacgcccgaacggcccaacccgatgtacc

SEQ ID NO: 231959 - DNA, 564 bp, Homo sapiens
  misc_feature: GYAE6OF02JDLUO.25.33.C11.1.454.CMB.1.raw
  modified_base (214)..(214): a, c, t, g, unknown or other
  misc_feature (214)..(214): n is a, c, g, or t
  modified_base (332)..(332): a, c, t, g, unknown or other
  misc_feature (332)..(332): n is a, c, g, or t
  modified_base (384)..(384): a, c, t, g, unknown or other
  misc_feature (384)..(384): n is a, c, g, or t
  modified_base (395)..(395): a, c, t, g, unknown or other
  misc_feature (395)..(395): n is a, c, g, or t
tcagactgtacagtcacgaccggtgctcgatttagagtgagctcgttgggtttgggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacgtcaatcaccatttccngcactggaaccagcactgatgttggctactttgaccttgtctcttggtaccaacaaccaccccgacaaacgcccccaaactcatgatttatgaggcactaagcgccctgagggtttcngctcgcttctctgctcaagtctggcaatacgcctcctgacatctctgtctcngctgaggacgnggctgattattactgtcttctcactatcgtcgcagtagctacgtttgggtgttccggacgtaggaacgggtaaccgaaggttccggaacccggttccggtacgggtaccacggtaccccgaagggtccttacccggcccccgttcgggtcctaccgttccgttccccgg

SEQ ID NO: 231960 - DNA, 534 bp, Homo sapiens
  misc_feature: GYAE6OF02FWER0.25.33.C11.1.454.CMB.1.raw
tcagactgtacagtcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgttgacccagtccccggtctccctgcctgtgtctctgggcgagagggccaccatcatctgcaagtccagccagaatctcttcttacctccaacatcagatctacctaaatgtaccagcagaaaccaggacaccctactaagttactcatttactgggcatctattcgggaatccgggtcctgaccgattcagtgcagcgggtctgggacagacttcacgtctcacatcgacagcctgcagcctagaagagtgtggccttacttattacgtcgtcagtactaagttacttatacttaccttacgtacttactttcggaccgagggtaccaagcgtaggagacgtccgaacgtaaccgtggtcgtactgccactatcttcg

SEQ ID NO: 231961 - DNA, 174 bp, Homo sapiens
  misc_feature: GYAE6OF02GEER7.25.33.C11.1.454.CMB.1.raw
  modified_base (172)..(174): a, c, t, g, unknown or other
  misc_feature (172)..(174): n is a, c, g, or t
tcagactgtacagtcacgaccggtgctcgatttagagtgagctcgttgggtttgggggaagaggaagactgacggtcccccaggagttcaggtgctgggcacagcggccctgggctgcctggtcaggactacttccactgtacagtctgagcgggctggcaaggcgcatagnnn

SEQ ID NO: 231962 - DNA, 532 bp, Homo sapiens
  misc_feature: GYAE6OF02HPYYP.25.33.C11.1.454.CMB.1.raw
  modified_base (218)..(218): a, c, t, g, unknown or other
  misc_feature (218)..(218): n is a, c, g, or t
  modified_base (229)..(229): a, c, t, g, unknown or other
  misc_feature (229)..(229): n is a, c, g, or t
  modified_base (298)..(298): a, c, t, g, unknown or other
  misc_feature (298)..(298): n is a, c, g, or t
  modified_base (308)..(308): a, c, t, g, unknown or other
  misc_feature (308)..(308): n is a, c, g, or t
  modified_base (325)..(325): a, c, t, g, unknown or other
  misc_feature (325)..(325): n is a, c, g, or t
  modified_base (425)..(425): a, c, t, g, unknown or other
  misc_feature (425)..(425): n is a, c, g, or t
  modified_base (437)..(437): a, c, t, g, unknown or other
  misc_feature (437)..(437): n is a, c, g, or t
  modified_base (453)..(453): a, c, t, g, unknown or other
  misc_feature (453)..(453): n is a, c, g, or t
tcagactgtacagtcacgaccggtgctcgatttagagtgagctcgttgggtttggggggggtcgacgaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttccngcactggactnagcactgatgttgcaggttattactttgtctctggtaccaactacaccaggcaaacgcccccaaattanacctatttangagaccataagcgcctnaggtatttcaatcgcttctctgctctaagtctggcagcacggtcctctgacatctactcggctcagctgacggacgagctcgtattagtactgctacgtnactagtgactantacgacaagtcccgtnttaccggactcgggaccgtacgggtacctaccgtcgtacggtacgtacgcccgtaacgaccccacctacgtcgtacccg

SEQ ID NO: 231963 - DNA, 579 bp, Homo sapiens
  misc_feature: GYAE6OF02IFU0E.25.33.C11.1.454.CMB.1.raw
tcagactgtacagtcacgaccggtgctcgatttagagtgagctcgttgggtttggggagctctgggagaggagccccagccctgagattcccaggcgtttccattcggtgatcagcactgaacacagagaacgcaccatggaggttggactgagctgggttttccttgttgtttttttaaaaggtgcccagtgtgaagtgcggctggaggagtcgtggggaggcgtggtacaggccgggggggtcccttagactctcctgtaaagtctctggattcaattttgatgaatatactatgcactgggtccgtcaggctcgaggggacgggtctaggagtgggtctctcttaataaaagttgggatggttaccaggtataagactatgtaggctctgtagagggccgtcttcaccatctccagagacaaacagacaaaaacctccctactatctgacaaagtaggaacgacccgtgacgaagtagaagaacagccgaccacgaatattaattagtagtaaaggaggatagttacggaactcgttacgaagaggaactagttacttttacgtacgctagtacgg

SEQ ID NO: 231964 - DNA, 559 bp, Homo sapiens
  misc_feature: GYAE6OF02I4QGO.25.33.C11.1.454.CMB.1.raw
  modified_base (219)..(219): a, c, t, g, unknown or other
  misc_feature (219)..(219): n is a, c, g, or t
  modified_base (368)..(368): a, c, t, g, unknown or other
  misc_feature (368)..(368): n is a, c, g, or t
  modified_base (379)..(379): a, c, t, g, unknown or other
  misc_feature (379)..(379): n is a, c, g, or t
  modified_base (393)..(393): a, c, t, g, unknown or other
  misc_feature (393)..(393): n is a, c, g, or t
  modified_base (435)..(435): a, c, t, g, unknown or other
  misc_feature (435)..(435): n is a, c, g, or t
tcagactgtacagtcacgaccggtgctcgatttagagtgagctcgttgggtttggggggggtcacaagaggcagcgctctcgggacgtctccaccatggccctgggctctgctcgcctcctcactctcctcactcaggacacagggtcctgggcccagtctgccgtgactcagcctgcctccgtgtctgggtctcctggacagtcgatcactatttccngcactgactcagcactgatgttgctaggttattacttgtctcctggtaccaacaacaccaggacaaacgccccctaaattctctatttatgacggaccactaagccgccctgaggtatttctaatcgtcttctctgctacagtctgcancgacgcctccngacatctctcgtcncagctgacggacgaggtctagtatttacgtacgtcgtcttcnctactagttggccgagtagtacgcgtagtttgggtacgttcgacgtaggaacgggaacctaaggtccggtacccgttcggtacggtcgaccgtaccgaacggtccgtacccgccccggttacgg

SEQ ID NO: 231965 - DNA, 725 bp, Homo sapiens
  misc_feature: GYAE6OF02GCIUU.25.33.C11.1.454.CMB.1.raw
  modified_base (197)..(197): a, c, t, g, unknown or other
  misc_feature (197)..(197): n is a, c, g, or t
  modified_base (218)..(218): a, c, t, g, unknown or other
  misc_feature (218)..(218): n is a, c, g, or t
tcagactgtacagtcacgaccggtgctcgatttagagtgagctcgttgggtttgggggggtcacaagaggcagcgctctcgggacgtctccaccatggcctgggctctgctgctcctcactctcctcactcaggacacagggtcctgggcccagtctgccgtgactcagcctgccctcgtgtcgtggtctcgtgacngtcgatccacttactttccgngacctacgtcggtacctcgacgacctacgtgtagttggttcgacgttaggtttacttttacttttcgtccttccgttacggtaacccaaaccaacccaacccgacggaaccaaaacccgaccccccttaaaaatttactaccgttaattttacgtacggaaccggaccctaaacgtaacggcccggtaccctagacggttacgtttactaacgtcgtcttctcgtcggcctacgtaagttcgtcgcacgacgtaccggtcccttccgtacgaactaacttccgtcggtcggtcctaccggagtctagggacggtacggacgtcgtagttaactttacgttacgtcgtaccttactactaacgttacggtcgaactactactaaccaaacgtaaccttcccgttcgtacccgggtacgtaccgggaaccgtacgggtaccctacccggttccggtcggtaccacccggtacccggaaccggaccccctaacccgtcgttacgtacccg

SEQ ID NO: 231966 - DNA, 593 bp, Homo sapiens
  misc_feature: GYAE6OF02HS6CB.25.33.C11.1.454.CMB.1.raw
  modified_base (397)..(397): a, c, t, g, unknown or other
  misc_feature (397)..(397): n is a, c, g, or t
tcagactgtacagtcacgaccggtgctcgatttagagtgagctcgttggggtttgggggagctctgggagaggagccccagccctgagattcccaggcgtttccattcggtgatcagcactgaacacagagaacgcaccatggaggttggactgagctgggttttccttgttgttttttaaaaggtgcccagtgtgaagtgcggctggaggagtctgggggaggcgtggtacagccgggggggtcccttagactctcctgtaaagtctctggattcaattttgatgaatatactaatgcactgggtccgtcaggctcgaggggacggtctagaggtgggtctctcttataaattgggatggttccagtatagactatgtaggctctgtgaagggccncttcaccatctccagacgacaaacagaacaaaaacctccctactaactctagacaaaatcggacgaccctgaccgtaagtagaaacgacgagccgaccacattattatagtagtaaaaggagggtaactttacgggaaacttcgttacggagtaaggaactaagtttctttaacgtacggtactagtaggtaccgg

SEQ ID NO: 231967 - DNA, 261 bp, Homo sapiens
  misc_feature: GYAE6OF02HEU85.25.33.C11.1.454.CMB.1.raw
  modified_base (164)..(164): a, c, t, g, unknown or other
  misc_feature (164)..(164): n is a, c, g, or t
  modified_base (181)..(181): a, c, t, g, unknown or other
  misc_feature (181)..(181): n is a, c, g, or t
  modified_base (183)..(261): a, c, t, g, unknown or other
  misc_feature (183)..(261): n is a, c, g, or t
tcagactgtacagtcacgaccggtgctcgatttagagtgagctcgggttgggtttgggggaagaggaagactgacggtccccccaggagttcaggtgctgggcacaggcggccctgggctgccctggtcaaggactacttccactggtacagtctgagccgggntggcaaggcgcatagcncnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 231968 - DNA, 553 bp, Homo sapiens
  misc_feature: GYAE6OF02GP0TU.25.33.C11.1.454.CMB.1.raw
  modified_base (331)..(331): a, c, t, g, unknown or other
  misc_feature (331)..(331): n is a, c, g, or t
  modified_base (347)..(347): a, c, t, g, unknown or other
  misc_feature (347)..(347): n is a, c, g, or t
tcagactgtacagtcacgaccggtgctcgatttagagtgagctcgttggggtttggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttcctgcactggactcagcactgatgttgcaggttattactttgtctcctggtaccaacaacacccaggcaaagcccccaaaacttatcatttatgaggccactaagcggccctcaggngtttcaatcgcttctntggctcaagtctggcagcacggcctcctgacaatctcgtgggctccgaggctgacggacgaggctgatttacttactgcttactctaatagtgaccaacactccaaactaaactcccgttacttccggaccgtacgggacctacgggtacctacccgtccgtcggtccgtaccgcccgtaacggccccaaccccgtctagtacccg

SEQ ID NO: 231969 - DNA, 841 bp, Homo sapiens
  misc_feature: GYAE6OF02JB4QF.25.33.C11.1.454.CMB.1.raw
  modified_base (311)..(311): a, c, t, g, unknown or other
  misc_feature (311)..(311): n is a, c, g, or t
tcagactgtacagtcacgaccggtgctcgatttagagtgagctcgttgggtttggggggggtcacaagagggcagcgctctcgggacgtctccaccatggcctgggctctgctgctcctcactctcctcactcaggacacagggtcctgggcccagtctgccgtgactcagcctgcctccgtgtctggtctcctggacagtcgatcacctatttcctgcactggactcagcactgatgttgcaggttattacttgtctctggtacctaactaactaccaggacaaacgcccccaaattactctaagtttancggaacgccaacgttaacggccggtccctacgacggtacgttttactaaacgttccgtactttcctacgttcgggccctttacccgaaaggtttccgtggggtacctaacggtacccgtacccgggtccccctttaccccgttacgtaaaccgtaaacgtttcccgttcccggttacggggttacccctaccccggtaacggggtcccgttacggggtaaacggggtaaacccgggtaggggttccctttaagggttaaacctttttaacgtttacccgttacggttaaccgtttaaacccgttcccgtttaaagttaacgtttacgggtaaaccctaaccgttaacttaacccaaacgttaaaacccgtttccccggttaaccgttttaccggggaccccgtttacggggtaaccccggtaacggggttccccgtaaaccccggttcccgggttaaccgggttacccgtaacccggtaaccccgtaaaccgggaaccccctaacccccgtacggttaccgttaaccccg

SEQ ID NO: 231970 - DNA, 551 bp, Homo sapiens
  misc_feature: GYAE6OF02F5IAU.25.33.C11.1.454.CMB.1.raw
  modified_base (381)..(381): a, c, t, g, unknown or other
  misc_feature (381)..(381): n is a, c, g, or t
tcagactgtacagtcacgaccggtgctcgatttagagtgagctcgttgggtttggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttcctgcactggactcagcactgatgttgcaggttattactttgtctcctggtaccaacaacacccaggcaaacgcccccaaacttatcattttatgacggccactaagccggccctcaggtagtttctaactcgcttctctggctccaagtctggcagcacggcctccngacatctcgtgggctccaggctggacggacgaggctgtattattactgctactcatataggacacatacaacaaactcccgtacttaccgaccgtcgggacccgcgggttaccacccgttccgtcgggtaccacggaccccgaacggaccccaaccccgtactcgtaccc

SEQ ID NO: 231971 - DNA, 606 bp, Homo sapiens
  misc_feature: GYAE6OF02ILPM7.25.33.C11.1.454.CMB.1.raw
  modified_base (329)..(329): a, c, t, g, unknown or other
  misc_feature (329)..(329): n is a, c, g, or t
tcagactgtacagtcacgaccggtgctcgatttagagtgagctcgttggggtttgggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcacctatttcctgcactggactcagcactgatgttgcaggttattactttgtctctgtaccaacaacacccaggacaaacgaccccaaacttatctatttatgaggccactaagccgccctnaggtagtttactaatcgtcttctctggctaccaagtctggcacgcaccggccctaccctaacactctccgtggcctccaggctagacggacgaggctagtatttaacttactgtacctactactaattagtaggaccactactacctaactaaacctcccgttaccgttccggtaccgtacgggaccgtacgggtaccgtacccggttccgttacgggtaccaaccggacccgaaccgggtacccccaaacccccgtacttaccggtaccctacccg

SEQ ID NO: 231972 - DNA, 608 bp, Homo sapiens
  misc_feature: GYAE6OF02IZMYG.25.33.C11.1.454.CMB.1.raw
  modified_base (306)..(306): a, c, t, g, unknown or other
  misc_feature (306)..(306): n is a, c, g, or t
tcagactgtacagtcacgaccggtgctcgatttagagtgagctcgttgggtttggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcacctatttcctgcactggactcagcactgatgttgctaggttattactttgtctcctggtaccaacaacaccaggcaaacgccccaaattatactattangacggccactaacgccgcctcaggtagtttctaatcgacttctctcggcctcgtaagtcgtcggacagccaccggtccctccgtacgactaactcctcgtcggcctcgaggtctaggacggacggaggcttaggtactttacttacgtgtacctactactatagtacggaactacgattaccaactaaacctcccgttacgttaccgggaccgttacgggtaacccgtacgggtaccctacccgggtcgttacgggtaccaccggtacccgaaccggaccccaacccgtacgtcgtaccccg

SEQ ID NO: 231973 - DNA, 759 bp, Homo sapiens
  misc_feature: GYAE6OF02G18J7.25.33.C11.1.454.CMB.1.raw
tcagactgtacagtcacgaccggtgctcgatttagagtgagctcgttgggtttggggggggtcacaagaggcagcgctctcgggacgtctccaccatggcctgggctctgctgctcctcactctcctcactcaggacacagggtcctgggcccagtctgccgtgactcagcctgcctcgtgtctgggtctcctggacagtcgatcacctatttcctgcactggactcagcactgattgttgctaggtttattactttgtcttccgtggtaaccaacaaccacccaggaccaaacgaccccctaaacttactactaattttatggacggaccctaacgtaacggcccggccccttacgacgggttacgttttacctaaacgttccggtcctttcctaccgttcgggtcccttacccgtaaaggttccgttcgggaccaacggcccgtaacccgggtcccccttacccgttacggaaccctaacttcccgttccggttcgggggtaccccttacccggacgggtccgtacgggaacggggtaaccggacgggtaccttaggtaacttttacgttacgtacgtaccttacgtactaattacgttacggaacctacctacttaccaaactaaaccttccccggttaccgttaccggtacccggttagggaccccgtacggggttaccctacccgggttccgtacggggttaccaacccggtacccgtaaaccgggcccccaaacccccgtgtacccgtacccg

SEQ ID NO: 231974 - DNA, 690 bp, Homo sapiens
  misc_feature: GYAE6OF02F7QU7.25.33.C11.1.454.CMB.1.raw
tcagactgtacagtcacgaccggtgctcgatttagagtgagctcgttgggttggggagctctgggagaggagccccagccctgagattccccaggcgttccattcggtgatcagcactgaacacagagaacgcaccatgggaggttggactgagctgggttttccttgttgttttttaaaaggtgtcccagtgtgaagtgcggctggaggagtctgggggaggcgtggtacaggccggggggtcctaggactctcctgtaaagtctctggattcaatttgatgatatactatgcactgggtccgtcaggctcgaggggacggtctaggaggtgggtctctcttataaattgggatggttccagtatagtactagtggtaggctcgtggtggaacgggtccgtactttacgaaccctacgtcctacccgagtaacgacaaaccgaacgaacaaaaacctccctactaactacctagtactaaagtcggaacgacccgtagacggaagtacgaacgaccgacgaccgtaccgtaacgtaacgttaacgttaacgttagggtaaaggttaaaagggtacggggttaaacgtttaaccgggtaaaccttacggttaccgggaaggtaacggtaaccgttaacggttttaccgttttaaaccgtaaccgggttactacggtacgggttaacccgg

SEQ ID NO: 231975 - DNA, 561 bp, Homo sapiens
  misc_feature: GYAE6OF02IDS91.25.33.C11.1.454.CMB.1.raw
  modified_base (216)..(216): a, c, t, g, unknown or other
  misc_feature (216)..(216): n is a, c, g, or t
  modified_base (306)..(306): a, c, t, g, unknown or other
  misc_feature (306)..(306): n is a, c, g, or t
tcagactgtacagtcacgaccggtgctcgatttagagtgagctcgttgggtttggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttccngcactggactcagcatgatgttgcaggttattactttgtctcctggtaccaacaacacccaggcaaacgccccaaaacttatcattttangaggccactaagccggccctcgaggtagtttctaatcgtctttctctggctacaagtctggcagcaccggcctccctgaccaatctcgtcgggctccgaggctggaggacgaggcttgtattattactgctactcaatagtggacacactccaactaaacgttcccgtacgttccggaccgttgggaccctagggttcccaccggtccgtacgggtccacggtacccgaaacggccccaaaccctacgtcgtacc

SEQ ID NO: 231976 - DNA, 556 bp, Homo sapiens
  misc_feature: GYAE6OF02GGDBY.25.33.C11.1.454.CMB.1.raw
  modified_base (306)..(306): a, c, t, g, unknown or other
  misc_feature (306)..(306): n is a, c, g, or t
tcagactgtacagtcacgaccggtgctcgatttagagtgagctcgttgggtttggggagctctgggagaggagccccagccctgagattcccaggcgtttccattcggtgatcagcactgaacacagagaacgcaccatggaggttggactgagctgggttttccttgttgttttttaaaaggtgcccagtgtgaagtgcggctggaggagtctgggggaggcgtggtccagcctgggaagtccctgagactctcctgtgtggcgcctagactcaccttcagtagttatggcttcgtctgggtccncagtgtccaggcaaggggctgggagtgggctggggagttacgttggtctgacagacaaatgacatatcacgcggagtccgtggaggggcctattccacatctcgagggacaattccaagacgaaccctctatctagacaaatagaacaacttagaggagtacgaggacgtacggtccgtttatactgtgacgtactcgaggtgtaggcgtaggtaaacgtcgtagtctactacttcccgtacgacctcgg

SEQ ID NO: 231977 - DNA, 753 bp, Homo sapiens
  misc_feature: GYAE6OF02JLEVO.25.33.C11.1.454.CMB.1.raw
  modified_base (309)..(309): a, c, t, g, unknown or other
  misc_feature (309)..(309): n is a, c, g, or t
  modified_base (337)..(337): a, c, t, g, unknown or other
  misc_feature (337)..(337): n is a, c, g, or t
tcagactgtacagtcacgaccggtgctcgatttagagtgagctcgttgggtttgggggggtcgtacgaagaggcgagcgctctcgggacgtctccaccatggcctgggctctgctgctcctcactctcctcactcaggacacaggtcctgggcccagtctgccgtgactcagcctgcctccgtgtctgggtctcctggacagtcgatcaccatttccgcactggactcagcactgatgttgcaggttattacttgtctcctggtaccaacactaccaggtcaaacgcccccaaattactcaacttttangacggaccaacttaagccggtacccttnaacggttacgttttaccaagtccgactttctcttaggccttaccaacgttcgtgggtaccaggtacctaccgggcccttacccgtaggaacctaacgttccgttaccgtacgggtccctacccgaagggtcttacgggaacgggtaccggaacgggtccttaacgggtaacttttacgttaacctcgggtacctacccttagtaaccgttaggttaccgggtaacctaacttaacgtacctaaaaccgtaaaaccgtttcccccggttacgtttacccgggtaccggttaaccggggaaccccgttaacggggttacccaccccgggtttacccggttacgggggttacccaacggggttacccccaaacccggggtttaccccccaaaacccccgttggttacccgttaccccgg

SEQ ID NO: 231978 - DNA, 545 bp, Homo sapiens
  misc_feature: GYAE6OF02JD23A.25.33.C11.1.454.CMB.1.raw
  modified_base (387)..(387): a, c, t, g, unknown or other
  misc_feature (387)..(387): n is a, c, g, or t
  modified_base (506)..(506): a, c, t, g, unknown or other
  misc_feature (506)..(506): n is a, c, g, or t
tcagactgtacagtcacgaccggtgctcgatttagagtgagctcgttgggtttggggagctctgggagaggagccccagccctgagattcccaggcgtttccattcggtgatcagcactgaacacagagaacgcaccatggaggttggactgagctgggttttccttgttgttttttaaaaggtgcccagtgtgaagtgcggctggaggagtctgggggaggcgtggtacagccgggggggtcccttagactctcctgtaaagtctctggattcaattttgatgaatatactatgcactgggtccgtcgaggctcgagggggtacgggtctagaggtgggtctcgtcttataaattgggatggttccagtatagactatgtaggctntgtgaagggccgcttcaccatctccagagacaacagacaaaactcctctatctagcaaatggacaccctgcgaagtgaagacagcgcacatattatgtagtaagaggattacggaactnttacgagagtacagttcgtttacgtacgtcagtgtacgg

SEQ ID NO: 231979 - DNA, 654 bp, Homo sapiens
  misc_feature: GYAE6OF02JPCTW.25.33.C11.1.454.CMB.1.raw
tcagactgtacagtcacgaccggtgctcgatttagagtgagctcgttgggttggggagctctgggagaggagcccagccctgagattcccaggcgttccattcggtgatcagcactgaacacagacgaacgcaccatggaggttggactgagctgggtttcctgttgttttttaaaggtgtccctagtgtgaagtgaggctggaggagtctgggggagcgtggtacgagccgggggggtcctaggactcgtccgtgtaaaggtctctggattcaattttgatgaatatactatcgcacgtgggtaccgtcacggtctacggagggggacggtcgtaggtaggtgggtcctacgtcgtttaagtaaacgttgggattcggtttccagttacgtagtaccgtagttcgtaggcttcgtgtaggaaggtccacttcaccgtatacctcagtacgaacacagaccaaaacttcctatactcacgacgtaacgtacgacgacctcgaagacggtacgaacgtacgagtacccacaacgtaacgtattacgttaagtaggttaaaagtcggggtaagtttaccggaaacgttacgttacgggaacgaacggtacgttaacggtttcgtttaaccgagttccggtagtaggttaacccggg

SEQ ID NO: 231980 - DNA, 625 bp, Homo sapiens
  misc_feature: GYAE6OF02JNBUV.25.33.C11.1.454.CMB.1.raw
  modified_base (216)..(216): a, c, t, g, unknown or other
  misc_feature (216)..(216): n is a, c, g, or t
tcagactgtacagtcacgaccggtgctcgatttagagtgagctcgttgggtttggggggggtcacaagaggcagcgctctcgggacgtctccaccatggcctgggctctgctgctcctcactctcctcactcaggacacagggtcctgggcccagcctgccgtgactcagcctgcctccgtgtctgggtctcctggacagtcgatcaccatttccngcactggactcagcactgatgttgcaggttattactttgtctcctggtaccaacaacacccaggccaaacgcccccaaacttactctatttatgacgccaactaagcgccctacgaggtagttactaatcgcttactctgctcaagtctggcagcacgcctcctagactaactctcgtcgggtcctccgacggctaggacgggaccggacggtctaggtactttaagttaccgtcgtacctacctactaacgttacgtacggaacctaacgtaactacctaaactaaacgttccccgttacgttacccggaccgttaccgggaccgtacgggtacctaccggttacccggtacggtaccgtaccggaacccggaaccggtaccccaaccccgtacgtacccgttacccg

SEQ ID NO: 231981 - DNA, 601 bp, Homo sapiens
  misc_feature: GYAE6OF02HB8NK.25.33.C11.1.454.CMB.1.raw
  modified_base (216)..(216): a, c, t, g, unknown or other
  misc_feature (216)..(216): n is a, c, g, or t
  modified_base (322)..(322): a, c, t, g, unknown or other
  misc_feature (322)..(322): n is a, c, g, or t
  modified_base (337)..(337): a, c, t, g, unknown or other
  misc_feature (337)..(337): n is a, c, g, or t
tcagactgtacagtcacgaccggtgctcgatttagagtgagctcgttgggtttggggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttccngcactggaaccagcactgatgttggctacttgaccttgtctcttggtaccaacaacaccaggcaacggcccccaaactcatcatttatgatgtcagtcatcgcctntggtatttctggtcncttctctggctacaagtctggacctaacgtccggccctcccgtagacctacgtccgtccggggccttaccgagggtcctaggacggacgtacggtccttaactttaagttacgtttgacttactttacactacagacgaaccaaccaaactgttcgtggttacgttcggacggacggtaccaggttcgaccgttccgttacggtccgaacgtacccgaaggtcccgttccggcccccgttacggtcctacgttccgttacccgg

SEQ ID NO: 231982 - DNA, 583 bp, Homo sapiens
  misc_feature: GYAE6OF02G9BDH.25.33.C11.1.454.CMB.1.raw
  modified_base (428)..(428): a, c, t, g, unknown or other
  misc_feature (428)..(428): n is a, c, g, or t
tcagactgtacagtcacgaccggtgctcgatttagagtgagctcgttgggtttgggggggggtcacaagaggcagcgctctcgggacgtctccaccatgacctgggctctgctgctcctcactctcctcactcaggacacagggtcctgggcccagtctgccgtgactcagcctgcctccgtgtctgggtctcctggacagtcgatcacctatttcctgcactggactcagcactgatgttgcaggttattactttgtctcctggtaaccaacaacacccaggacaaacgacccctaaacttatctatttatggaggccactaacgccggccctgaggtagtttactaatcgtcttctctggtctacaagtctggcagccacggcctcctgaactatctcgtgggcctccgaggctaggacggacggngcgtagtatttacttacgtctactactacgtaatagtaggaactactactaacaactaccttccgttacgtccggacgtcgggaaccgtcggtaccgtaccgtccggtacggtacctacggacccgtaaccgaccccaaccctacgtcgtaaccg

SEQ ID NO: 231983 - DNA, 631 bp, Homo sapiens
  misc_feature: GYAE6OF02F09PL.25.33.C11.1.454.CMB.1.raw
  modified_base (219)..(219): a, c, t, g, unknown or other
  misc_feature (219)..(219): n is a, c, g, or t
  modified_base (296)..(296): a, c, t, g, unknown or other
  misc_feature (296)..(296): n is a, c, g, or t
  modified_base (304)..(304): a, c, t, g, unknown or other
  misc_feature (304)..(304): n is a, c, g, or t
  modified_base (419)..(419): a, c, t, g, unknown or other
  misc_feature (419)..(419): n is a, c, g, or t
tcagactgtacagtcacgaccggtgctcgatttagagtgagctcgttgggtttggggggggtcacaagaggcagcgctctcgggacgtctccaccatggcctgggctctgctgctcctcactctcctcactcaggacacagggtcctgggcccagtctgccgtgactcagcctgcctccgtgtctgggtcctccgtggacagtcgatcacctatttccngcactggactcagcactgatgttgctaggttattacttgtctctcgtaccaacacaccaggacaacgccccaaattntctatttngaggcctaactacgcgcctgagtcgtttactaatcgtcttcgtctcggcctactaagtcgtggcagccgaccggtccctacccgtacgactacgtcctcggtcgggtccctccgnggtccgtaggacgggacggacgtagttacgtaatttacttacgtcgtaccttacctataagttacgtagaacctacgtactacctaaaccgtaaccgttcccgttacgttacccggaccggttaccgggaccggtacggtacccgttaccggtccggttacgggaccacggtacccgaaccggtaccccaaccccgtcgtacgttaaccccg

SEQ ID NO: 231984 - DNA, 700 bp, Homo sapiens
  misc_feature: GYAE6OF02IMY65.25.33.C11.1.454.CMB.1.raw
  modified_base (180)..(180): a, c, t, g, unknown or other
  misc_feature (180)..(180): n is a, c, g, or t
  modified_base (323)..(323): a, c, t, g, unknown or other
  misc_feature (323)..(323): n is a, c, g, or t
  modified_base (342)..(342): a, c, t, g, unknown or other
  misc_feature (342)..(342): n is a, c, g, or t
  modified_base (386)..(386): a, c, t, g, unknown or other
  misc_feature (386)..(386): n is a, c, g, or t
  modified_base (422)..(422): a, c, t, g, unknown or other
  misc_feature (422)..(422): n is a, c, g, or t
tcagactgtacagtcacgaccggtgctcgatttagagtgagctcgttgggtttggggagctctgggagaggagccccagccctgagattcccaggcgtttccattcggtgatcagcactgaacacagagaacgcaccatggaggttggactgagctgggtttcctgttgtttttaaaggncccagtgtgaagtgcggctggaggagtcgtgggggaggcgtggtacgaggccggggggtcccttaggctcgtccgtagtaaacgttctcgtggattctaagttttcgatgaatagtactatgctacgtgggtccgtcaggtcncggtagggacggtctaggnggtggtctacgttacttaataagttgggatggttaccaggttanagtacttagtgtaggtctgtaggtcgaacgggtccnttaccgacttatcgtaccaagacgacaaacgacgaacctaaaactcccgattactcgtaacgactaaacgttcggaaccacgtacgtaacggaacgttacgaaacgaccgacgtacccgaccgaacttaagtacgtttaaagttagtaaacgttaaaacgggtaggggttaaacgtttaccggtaaaaccgtcgttttagggaacgtaacgggttaacgtttaaaccgttttaccgtttaaaccgttaaccgggacgttaacggtacgggttaaccgg

SEQ ID NO: 231985 - DNA, 185 bp, Homo sapiens
  misc_feature: GYAE6OF02GLLZ6.25.33.C11.1.454.CMB.1.raw
  modified_base (175)..(185): a, c, t, g, unknown or other
  misc_feature (175)..(185): n is a, c, g, or t
tcagactgtacagtcacgaccggtgctcgatttagagtgagctcggttgggtttgggggaagaggaagactgacggtccccccaggagttcaggtgctgggcacagcggccctgggctgcctggtcaaggactacttccactgtacagtctgagcgggctggcaaggcgcatagnnnnnnnnnnn

SEQ ID NO: 231986 - DNA, 575 bp, Homo sapiens
  misc_feature: GYAE6OF02I0VU2.25.33.C11.1.454.CMB.1.raw
tcagactgtacagtcacgaccggtgctcgatttagagtgagctcgttgggtttgggggggggtcacaagaggcagcgctctcgggacgtctccaccatggcctgggctctgctgctcctcactctcctcactcaggacacagggtcctgggcccagtctgccgtgactcagcctgcctccgtgtctgggtctccgtggacagtcgatcacctatttcctgcactggactcagcactgattgttgctaggttattactttgtctcctggtaccaacaaccacccaggaccaaacgacccccaaacttactctatttactgacggccactaagccggccctcgaggtagtttctaactcgtcttctctcggctcctaagtctggcagcgaccgtccctcctagactatctcgtcggtctccgaggctggacggacgacgcgttcgatttacttactgtctactactatcgtagaacacatacaactaactcccgttacttccgtaccgtacgggaccgtaacgggtccaccggttccgtggtccgacgaccgaaccgcccaacccgtactcgtaccc

SEQ ID NO: 231987 - DNA, 700 bp, Homo sapiens
  misc_feature: GYAE6OF02HKSXC.25.33.C11.1.454.CMB.1.raw
tcagactgtacagtcacgaccggtgctcgatttagagtgagctcgttgggtttggggagctctgggagaggagccccagccctgagattcccaggcgtttccattcggtgatcagcactgaacacagagaacgcaccatggaggttggactgagctgggttttccttgttgttttttaaaaggtgcccagtgtgaagtgcggctggaggagtcgtggggggaggcgtggtacagccgggggggtcccttagactctcctgtaaagtctctggattcaattttgatgaatatactatgcactgggtccgtcaggctcgagggggacggtcgtagaggtggtctctcttataaattgggtatggtcagtataagactatgtaggcttactggtaggaagggtcccgtcttaccacctacttcctaccaaggaacgtaaccaaacgaacgaactaaaaaacccgtcccttactaaactctacgactaaaacgtgggaacgtaccccgaggtaccgaacggttagaaacggaacacgggacccgacccaacctaattaactttaagttaaggttaacggttaaaaagggacggggggttaattttaccgggtaaaacttccggtttaacgaagggtacggtaaacgtacggttttaacccgtttttaaccgtaaccgggtacgttacgtaggggttaacccggg

SEQ ID NO: 231988 - DNA, 696 bp, Homo sapiens
  misc_feature: GYAE6OF02GKU1I.25.33.C11.1.454.CMB.1.raw
tcagactgtacagtcacgaccggtgctcgatttagagtgagctcgttgggtttgggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttcctgcactggactcagcactgatgttgcaggttattacttgtctcctcggtaccaacaaccacccaggccaaacgcccccaaaattactacatttatggacggccaactaacgccggtccctcgaggtacgtttcctaaactccgtactttcctcgtcggacccttaccgtaaacgttccgtgggtccgaagcccgtaacccgggtcccttaccccgttagacctaacttccgtcgttaccggggcctacccgaagggtcctagggtaacgggaaccggtacgggtaccttaggtaacgttttaagtttaccgtcggttacccttaacttacgtaagttacgtcgggaacctaacgtacttaccaaacgtaaaccttcccgttaccgttaccggaccgtacgggaccgtacgggtcctacccgggtccgttacgggtacctacggaccccgtaacggacccctaaccctaccgtcgtacccg

SEQ ID NO: 231989 - DNA, 757 bp, Homo sapiens
  misc_feature: GYAE6OF02G2GTY.25.33.C11.1.454.CMB.1.raw
  modified_base (219)..(219): a, c, t, g, unknown or other
  misc_feature (219)..(219): n is a, c, g, or t
tcagactgtacagtcacgaccggtgctcgatttagagtgagctcgttgggtttggggggggtcacaagaggcagcgctctcgggacgtctccaccatggcctgggctctgctgctcctcactctcctcactcaggacacagggtcctgggcccagtctgccgtgactcagcctgcctccgtgtctgggtctccgtggacagtcgatccacctatttccngcactggactcagcactgatgttgctaggttattactttgtctccgtacgtaccaacaccaccaggaccaaacgacccctaaattactactatttagtggacggcctaacgtaacgccggtccctacgaggttacgtttactaacgtccgtctttaccgtcgtcggtaccttaccgtaagttcgtacggtacgacggtaccgacccggtccccttcccgtagtaaccctaacgttcccgttcggttaccgggtaccctacccggtaacgggtccggtaacgggtacgggtaacccgggtacggtaccgttaaggttacttttaaacgtttccgtacgtaccgttaccttacgtacgttaacggtacgtaaccacttaactacctaacgtaaaccgttcccgtaccgtttaccggacccggtacggggtaccgtacgggttacccgtacccgggttaccggttaccgggtaaccgtacccggaaccccgggtaaacccggtaacccccgtaaccccgttaccgttaccggttaaccccg

SEQ ID NO: 231990 - DNA, 631 bp, Homo sapiens
  misc_feature: GYAE6OF02JBLA0.25.33.C11.1.454.CMB.1.raw
  modified_base (218)..(218): a, c, t, g, unknown or other
  misc_feature (218)..(218): n is a, c, g, or t
  modified_base (317)..(317): a, c, t, g, unknown or other
  misc_feature (317)..(317): n is a, c, g, or t
  modified_base (342)..(342): a, c, t, g, unknown or other
  misc_feature (342)..(342): n is a, c, g, or t
  modified_base (434)..(434): a, c, t, g, unknown or other
  misc_feature (434)..(434): n is a, c, g, or t
  modified_base (463)..(463): a, c, t, g, unknown or other
  misc_feature (463)..(463): n is a, c, g, or t
tcagactgtacagtcacgaccggtgctcgatttagagtgagctcgttgggtttggggggggtcacaagaggcagcgctctcgggacgtctccaccatggcctgggctctgctgctcctcactctcctcactcaggacacagggtcctgggcccagtctgccgtgactcagcctgcctccgtgtctgggtctccgtggacagtcgatcacctatttccngcactggactcagcactgatgtgcaggttattactttgtctcctaggtaccaaccaaccacccaggaccaaaacgacccccaaattactctaattttanagacgccaacgtaagccggccctanacgggtacttttactaacgtccgtcttccgtcgtcggacctaccgtaagtcgtggctacgccgtacggcccttcccgtagactaatccgtcncgggtcctcgacgtcgtacggacggacgngtacgttcgttaattacgttactcgtactctactatagtacgacagtactacctaacaaaccttccgttacgttaccggaccgttcggaaccggtacggttccctaccggtcccgttacgggtaccgaaccggcccgaaaccggccccaacccgtaccgcgttacccg

SEQ ID NO: 231991 - DNA, 691 bp, Homo sapiens
  misc_feature: GYAE6OF02GCY3Z.25.33.C11.1.454.CMB.1.raw
  modified_base (147)..(147): a, c, t, g, unknown or other
  misc_feature (147)..(147): n is a, c, g, or t
  modified_base (201)..(201): a, c, t, g, unknown or other
  misc_feature (201)..(201): n is a, c, g, or t
  modified_base (219)..(219): a, c, t, g, unknown or other
  misc_feature (219)..(219): n is a, c, g, or t
  modified_base (328)..(328): a, c, t, g, unknown or other
  misc_feature (328)..(328): n is a, c, g, or t
tcagactgtacagtcacgaccggtgctcgatttagagtgagctcgttgggtttggggggggtcacaagaggcagcgctctcgggacgtctccaccatggcctggctctgctgctcctcactctcctcactcaggacacagggttccngggcccagtctgccgtgactcagcctgcctccgtgtcgtgggtctccgtggacngtcgatcacctatttccngcacgtgactcgacgtcacgtgattggttacgctacggttattactttgtctcgtacgtaccaacaactaccgaggacaaccgacccctaaagttactactacgtttanacgaacggacaaccgtagaccggtcctaccgtaacggtacgtttactaacgtcgtacctttcgtacctacggtccttaccgtaacggtctcgggactaccgtcccgaaccgtcccttacccgtatacgtaaccttcgcgttaccggaccgttaccgtacgcgttaacgggaccggacggtaacggtccgttagtactttacgtaactctacgtacttactagtacgacgaccgtactacgtacaacgttaaccctaccgttaccgtaccgtaccggacggaccggtaccggttccgaaccggttccggtaaccgtccggtaaccgaccgtaacccggtaccccaccgtacgtacccgttcccg

SEQ ID NO: 231992 - DNA, 726 bp, Homo sapiens
  misc_feature: GYAE6OF02GY9F2.25.33.C11.1.454.CMB.1.raw
  modified_base (218)..(218): a, c, t, g, unknown or other
  misc_feature (218)..(218): n is a, c, g, or t
  modified_base (241)..(241): a, c, t, g, unknown or other
  misc_feature (241)..(241): n is a, c, g, or t
tcagactgtacagtcacgaccggtgctcgatttagagtgagctcgttgggtttgggggggtcacaagaggcagcgctctcgggacgtctccaccatggcctgggctctgctgctcctcactctcctcactcaggacacagggtcctgggcccagtctgcccgtgacctcagcctgccctccgtgtctgggtctcctggacagtcatcacctatttccngcactggactcagcatgatggtnctaggttattactttgtctcctggtaaccaacaaccgaccaggaccaaacgaccccctaaattacactaatttacgagacggaccaacgtaacggccgtcccttacgaacggttacgtttactaactccggtacctttcttaccgttcggccttaacccgtaacggttccgttacgggaccctaaccggtaccggtaacccgggtcccttaccccgttagaacctacgttaccgtccgtcggggcccttacccggaggtaccgttaggaaccgggtaacgtacgggtccgttagtaacgttttacgttacgtcgtaccttactaccgtaatacggtaggaacctacgtactacctaaccgttaaaccgttcccgttacgtttaccgggcccgttacgggacccggtaacgggttacccgtacccgttccgtacgtacgtaccgtaccggaacccgtaacccggacccctacccgtacttacccgg

SEQ ID NO: 231993 - DNA, 737 bp, Homo sapiens
  misc_feature: GYAE6OF02JGU3L.25.33.C11.1.454.CMB.1.raw
  modified_base (192)..(192): a, c, t, g, unknown or other
  misc_feature (192)..(192): n is a, c, g, or t
  modified_base (249)..(249): a, c, t, g, unknown or other
  misc_feature (249)..(249): n is a, c, g, or t
tcagactgtacagtcacgaccggtgctcgatttagagtgagctcgttgggtttgggggggtcacaagaggcagcgctctcgggacgtctccaccatggcctgggctctgctgctcctcactctcctcactcacggacacgagggtcctcgggcccaggtctcgccctagactcacgcctcgcctccgtgtcncgggactccgtggactacgtcgaccacctctcctccgtacgcgtacgtacggaaccncgtccgtagacgtagttggtactacttaataacttacgtcgttccgtaccgtaccggtaaccccaaaccgaaccgacccggaacggtaccgaaacccggtaaccccctaaacgtcctaaacttactacgttttaagcgtacgttacgtactaacgtccacgttcccgaccttcgttaggttacgtttcgtcggtccttcgtttacgtccgtcggtacctaccgtaggtcctacggacctaccggtccggtccctcgtacgacctacggtcgtccggtactccgcggtagacggacggtccgtagttacctttaagttcttaacgtcctacgttaattaccgtaagacggaaacgtaccgaacctacgtaaacgttcgttcggttaaacggttcggacgggtacggtacgtacgtacggttcccggtaccgtcgtccggtaccgacgtacccgtacggtccctacccgttcccggcgttaccttacccg

SEQ ID NO: 231994 - DNA, 648 bp, Homo sapiens
  misc_feature: GYAE6OF02FPDR9.25.33.C11.1.454.CMB.1.raw
  modified_base (216)..(216): a, c, t, g, unknown or other
  misc_feature (216)..(216): n is a, c, g, or t
  modified_base (411)..(411): a, c, t, g, unknown or other
  misc_feature (411)..(411): n is a, c, g, or t
tcagactgtacagtcacgaccggtgctcgatttagagtgagctcgttgggtttggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttccngcactggactcagcactgatgttgctaggttattactttgtcttcctggtaaccaacaaccaccccaggaccaaaacgccccccaaaattactactaattttatgacggccctaacgtaacggccggaccctcgaggtagtttctaatccgtctttctctcggcctacctaaggtctggctagcaccggcctccngacatctctcggcctcgagtctggacggacgaggtctagtactttattaccgtgtaccttactacgtatagtacggaacctacgacttacaaacctaaaccgttcccgttacgttaccgggtacccgtcgggtaacccgtaacggggttaccctaccccgggttccgttacggggtacccgtaccggaacccccgtaaccgggacccccctaacccccgtaccgttccggtaccccg

SEQ ID NO: 231995 - DNA, 741 bp, Homo sapiens
  misc_feature: GYAE6OF02HWG4O.25.33.C11.1.454.CMB.1.raw
  modified_base (223)..(223): a, c, t, g, unknown or other
  misc_feature (223)..(223): n is a, c, g, or t
tcagactgtacagtcacgaccggtgctcgatttagagtgagctcgttgggtttgggggggggtcacaagaggcagcgctctcgggacgtctccaccatggcctgggctctgctgctcctcactctcctcactcaggacacagggtcctgggcccagtctggccgtgactcacgcctgcctccgtgtctgggtctccgtggactagtcgatcacctattttccngctacgtggaactcgacgctactgattgttgcgtaggtttacttacgtttgtctccgtagtaaccaacaacaccgaggactaaaccgaccccctaaattacttactaagtttagacggacgtacctaacgtacggccggtaccctacggtaggttacgttttacgaacgttccgtacctttcgtacgttcgggtaccttaccgtaaggttcgtacggacgtacgacccggtaccggtccccttaccgtagtaacctacgttccgtacggtccgggtacctaccgggtacggtacgtaacgggtacgggtaccggtaacggttcttaacggtttaacgtttaacgttacctacggtactaccgttaagtacgttacgtaccggaactacctaacttaccgtaaacttaaccgtcccgtttacggtaccggtaccgaccggttaccggaaccggttcctacggtccggtacggtaccgaccggtacccggtaaccaccccgtaaccgtcgtacggtaccc

SEQ ID NO: 231996 - DNA, 686 bp, Homo sapiens
  misc_feature: GYAE6OF02JYT6C.25.33.C11.1.454.CMB.1.raw
  modified_base (168)..(168): a, c, t, g, unknown or other
  misc_feature (168)..(168): n is a, c, g, or t
  modified_base (198)..(198): a, c, t, g, unknown or other
  misc_feature (198)..(198): n is a, c, g, or t
  modified_base (264)..(264): a, c, t, g, unknown or other
  misc_feature (264)..(264): n is a, c, g, or t
  modified_base (280)..(280): a, c, t, g, unknown or other
  misc_feature (280)..(280): n is a, c, g, or t
  modified_base (317)..(317): a, c, t, g, unknown or other
  misc_feature (317)..(317): n is a, c, g, or t
  modified_base (352)..(352): a, c, t, g, unknown or other
  misc_feature (352)..(352): n is a, c, g, or t
  modified_base (475)..(475): a, c, t, g, unknown or other
  misc_feature (475)..(475): n is a, c, g, or t
  modified_base (485)..(485): a, c, t, g, unknown or other
  misc_feature (485)..(485): n is a, c, g, or t
tcagactgtacagtcacgaccggtgctcgatttagagtgagctcgttgggtttgggggggtcacaagaggcagcgctctcgggacgtctccaccatggcctgggctctgctgctcctcactctcctcactcaggacacagggtcctgggcccagtctgccgtgactcngcctgcctccgtgtctgggtctcctggacnggtcggtcaccatctccgtgacactggaaccaggtccgtagacctgtttggcactttataactgtntctctaggtacccaanaccacccgagcaacggccccaaactcatccgtattangactctcagtcactcggtcctgtaggacttttcgnggtctctttctcgtggtcctaacgtacgttctagggttaacctccggtccctccgttacgaccctagtcccggttcgggccttacggcggccgtaggacgggaccgtaagggtccttaatttntttacggttntaccttaatttcctaaggtaacagggaacacctaaaccgaacgtagttccgtttgggttaacgttccggggaacgggtacggtacgtaaggtttccgtaaccggttaccccggttggttaaacccgaccgttacccggaacgggtcccggttaccccgttcccccgggtttccgggttaccccttaccgggttttaccccg

SEQ ID NO: 231997 - DNA, 766 bp, Homo sapiens
  misc_feature: GYAE6OF02IMQNI.25.33.C11.1.454.CMB.1.raw
  modified_base (218)..(218): a, c, t, g, unknown or other
  misc_feature (218)..(218): n is a, c, g, or t
  modified_base (755)..(755): a, c, t, g, unknown or other
  misc_feature (755)..(755): n is a, c, g, or t
tcagactgtacagtcacgaccggtgctcgatttagagtgagctcgttgggtttggggggggtcacaagaggcagcgctctcgggacgtctccaccatggcctgggctctgctgctcctcactctcctcactcaggacacagggtcctgggcccagtctgccgtgacctcagcctgcctccgtgtctgggtctcgtggacagtcgatcacctatttccngcatggactcacgcactgatgttgactaggtttattactttgtccttccgttacggtaaccaaacctaaaccgaaccccaagggtacccaaaaccgtacccccctaaaaactttacttaaccttaagttttaacgacggaaccggtacccctaaccgttaaacggccccgggtacccctacggtaacgggttacgttttactaaacgttccgtaccttttccgtcgttacgggtacccttaccgtaaacggttccgtacgggtacaacggtacccgaacccgggttcccctacccgttacgaaccttaacgttccgttcccggtacgggtccctacccggagggttacgtacgggaaggaccggtacgggtcttaaggttactttaaacgttacgtacgtaccgtacttactaagttacgtaggaaccaagtactaacctaaaccgtaaccttcccgttccgtaaccggtacgtacgggaccgtacgggtaccgtaccgtaccgtcggacaccggacctaaccggacccctaacccncttacgtaccg

SEQ ID NO: 231998 - DNA, 670 bp, Homo sapiens
  misc_feature: GYAE6OF02G98LS.25.33.C11.1.454.CMB.1.raw
tcagactgtacagtcacgaccggtgctcgatttagagtgagctcgttgggtttggggagctctgggagaggagccccagccctgagattccccaggcgtttccattcggtgatcagcactgaacacagagaacgcaccatggaggttggactgagcttgggttttccttgtttagttttttaaaaggtgcccagtgtgaagtgcggctggaggagtcgtgggggaggcgtggtacgaggccgggggggtcccttaggactctcctgtaaagtctctggattctaattttgatagaatatactatcgactactggggtcccgtcacggctcggaggggacggtcgtaggagtgggtctcgtattataaacgttgggattcggttcagtatagactgtgtaggtcttcgtggtaggaacgggtcccgtacttccaccgtacttccgtaccagtaacgaccaaacgaacgaacctaaaaccctcctactaacgtctacgtaacaaagtacggaaccgtacccgtagacggtaaaggtacgaaagaaccgacggaccgacccgaataacgtttattaagttacggtaagtaaaggtagggttaacgttaccggtaactcgttaacgaaggtacgtacgtaagtttccgtttacgaccggtctaggtcgtaacgg

SEQ ID NO: 231999 - DNA, 704 bp, Homo sapiens
  misc_feature: GYAE6OF02JMKC8.25.33.C11.1.454.CMB.1.raw
  modified_base (147)..(147): a, c, t, g, unknown or other
  misc_feature (147)..(147): n is a, c, g, or t
  modified_base (164)..(164): a, c, t, g, unknown or other
  misc_feature (164)..(164): n is a, c, g, or t
  modified_base (168)..(168): a, c, t, g, unknown or other
  misc_feature (168)..(168): n is a, c, g, or t
  modified_base (224)..(224): a, c, t, g, unknown or other
  misc_feature (224)..(224): n is a, c, g, or t
  modified_base (366)..(366): a, c, t, g, unknown or other
  misc_feature (366)..(366): n is a, c, g, or t
  modified_base (404)..(404): a, c, t, g, unknown or other
  misc_feature (404)..(404): n is a, c, g, or t
tcagactgtacagtcacgaccggtgctcgatttagagtgagctcgttgggtttggggggggtcacgaagaggcagcgctctcgggacgtctccaccatggcctgggctctgctgctcctcactctcctcatcaggacacgaggtccncggcctagtctcgcgtnactnacgtcctgcctcgtgtcgtcggtctcggtaggacgtacatccaccttactttccgngaacttcggaaccggaaaccctagcctaagttgtagttcggttcggtccttttactttacgtacctttcgtactttcgttacgtaacccaactaacccaacccgaactaaacccgaccccctaaactcactaagtctttagnggaccgactaacgtacgccgtcctcgggttacggttcncgtctcgtcctcgtcgtcggtacctacgtacgtcgtaacgacgtaaccggtacctcccgtaccgaacgtactaaccttccgttcgtaccgtcgtccggtagtacgtagggaccggtacgtacggtctaggttactttaaggtctttaccgtctacctcgtactcgttacgtcgaaccttggtacgtcgtttacggttgttacgggacgtacgaacgggttacgaaccttggtccggtaacgttccggtggtaccgaccgtaccgtaccgccgtcccgtacccggcttacgtccttacccg

SEQ ID NO: 232000 - DNA, 671 bp, Homo sapiens
  misc_feature: GYAE6OF02IY5QU.25.33.C11.1.454.CMB.1.raw
  modified_base (377)..(377): a, c, t, g, unknown or other
  misc_feature (377)..(377): n is a, c, g, or t
  modified_base (427)..(427): a, c, t, g, unknown or other
  misc_feature (427)..(427): n is a, c, g, or t
  modified_base (453)..(453): a, c, t, g, unknown or other
  misc_feature (453)..(453): n is a, c, g, or t
  modified_base (472)..(472): a, c, t, g, unknown or other
  misc_feature (472)..(472): n is a, c, g, or t
tcagactgtacagtcacgaccggtgctcgatttagagtgagctcgttgggtttggggggggtcacaagaggcagcgctctcgggacgtctccaccatggcctgggctctgctgctcctcactctcctcactcaggacacagggtcctgggcccagtctgccgtgactcagcctgcctccgtgtcgtgggtcctccgtggactaggtcgactccacctattttcctgctacctggactcagtcactgatgttcacgtaggttattactttgtcctccgtgtaccaacaacaccgaggacaaacgacccctaaacttatctaactttagacgaaggcctaacgtaacggccgtaccctcgaggttactttactaactcncctttctccgtaggccttacgaacgtcgtggccagcaccggacctccganaacgtatccgtacgtcggcctaccgnggtctagggaccggacggnggtacgttagtagtttacttcgtacgtaccttacgtataacggttagtacgtaactaaccgtatacctaaacgtaacgttcccgttacggtacccgtacggtacggtacccggtacggtaccgttaccccggtaccgttccgggtaccgaacccggtacccgaaccgggtacccaaccccgtaggtcccgttaaccccg

SEQ ID NO: 232001 - DNA, 660 bp, Homo sapiens
  misc_feature: GYAE6OF02H1P6C.25.33.C11.1.454.CMB.1.raw
  modified_base (222)..(222): a, c, t, g, unknown or other
  misc_feature (222)..(222): n is a, c, g, or t
  modified_base (226)..(226): a, c, t, g, unknown or other
  misc_feature (226)..(226): n is a, c, g, or t
  modified_base (445)..(445): a, c, t, g, unknown or other
  misc_feature (445)..(445): n is a, c, g, or t
  modified_base (451)..(451): a, c, t, g, unknown or other
  misc_feature (451)..(451): n is a, c, g, or t
  modified_base (536)..(536): a, c, t, g, unknown or other
  misc_feature (536)..(536): n is a, c, g, or t
tcagactgtacagtcacgaccggtgctcgatttagagtgagctcgttggggtttggggggggtcacaagaggcagcgctctcgggacgtctccaccatcggcctgggctctgctgctcctcactctcctcaactcaggacacgtagggtcctgggaccctagtctcgccgtagactcacgcctgccctccgtgtctgggtcctcgaggacagtcatcacctnttcngactagtggactcgatccagtgattcgtacgacgtagtttaacttcgttcgtcctcgttacgaaccaacaaccaccgacggacaaaacctacccctaaattactacgttaatttagacggtaccgaccgtaacgtaaccggccggtaccctacgtaagggttacttactactccggtcttctagtcgtctaccgagtcgtacgcgacgcgacccgtccnccgtanactactccgttcggacggtacctccggaggtacgtacgggaacgtaacgggtccggtattaacgggttaattacggttaaccgtnttacctacctaatacggtacacgaacctataccaactaaacgtaacctccgttacgtacggacgtcggtaacgacgtcctaccgtgtaccggaccacgacgaacccgaccctactacgctaccg

SEQ ID NO: 232002 - DNA, 837 bp, Homo sapiens
  misc_feature: GYAE6OF02IGV1R.25.33.C11.1.454.CMB.1.raw
  modified_base (700)..(700): a, c, t, g, unknown or other
  misc_feature (700)..(700): n is a, c, g, or t
  modified_base (818)..(818): a, c, t, g, unknown or other
  misc_feature (818)..(818): n is a, c, g, or t
tcagactgtacagtcacgaccggtgctcgatttagagtgagctcgttggggtttgggggagctacaacaggcaggcaggggcagcaagatggtgttgcagacccaggtcttcattttctctgttgctctggatctctggtcgaccgtacggggacatcgtgttcgacccacggtccccggtctcccgtcgcgtgtcgtctcggtgggacggaggaccggccaacctactacactcgtagacgaacgtcccgacgaccgaagttaaccttcccttacttttacccttaccctaacctaaaactaataccgaacgttaaccttaaacccgttaaaaccgtttaaaacggtttaccggaaccgaacgtaaccgaaaacggaaaacccgaaccggtaaaacccctaaccccctttaaacggttaaaccttaacttaccgtttaacgttaaccgggtacggtacttaactttacggttaacggttaacccggggtaaccgggttcccccgggttaccgtaacggaccgttacgttacggaacggtcggacgggtacggggtccggtacggttaacgggaaaccttacgtaaccttaccgtaccgtccaccctaacgtaacgtaccgaccgtaacggtcccgtagaacggacggtaactaacgggaaactcggttacggacgtttaactttatttacgttaaccgngtaacacgttaaactaaagttttaactacctaaccttacccgttactacgtttacggtacggaccgaaggacaggtcggtagactaccggtaacgtaacgtagtacggtcaaccggtnaccctagtccgttgtaccg

SEQ ID NO: 232003 - DNA, 760 bp, Homo sapiens
  misc_feature: GYAE6OF02IA0QG.25.33.C11.1.454.CMB.1.raw
tcagactgtacagtcacgaccggtgctcgatttagagtgagctcgttggggtttgggggagctacaacaggcaggcaggggcagcaagatggtgttgcagacccaggtcttcatttctcttgttgctcgtggatctctggtgcctacggggacatcgtgttcgacccacggtccccggtctccctgcctgtcgtctcgtgggccgagacgggccaccagtcatctgacaacgtccagaccaagaactctcttcttacctccaaacaactcagatacctaaacctaaattcggaccagcaacgaaaccgaacggacctaaccctctaaacgttacctactattacgtggctagtcttaagttacgggaacgttcccgggtacctcggaccgtagttccacggtggtacgacgggtcgggtacgtcgggtaacacggttcttacccaacttccgaccgtaaacctaggtccaaccgtaacgtccgtacggtacggacgtaacgtacgaaaggttacgtggtacgggttacttaacgtttaacggtttaccctagggtactaacggtataaaaccgttaactttaaccgttaaacccgttaccttacccgggttaaaccttttaaccggtttttacgggaaccccgtaagggggaacccttacgggacggttacgggtaacgtaaaccggttaccccgggaaaacgtaaccgttccgggtacgggtaccgtacccgtacgtaaccctacgtttacggttaccg

SEQ ID NO: 232004 - DNA, 631 bp, Homo sapiens
  misc_feature: GYAE6OF02ISPZ9.25.33.C11.1.454.CMB.1.raw
  modified_base (379)..(379): a, c, t, g, unknown or other
  misc_feature (379)..(379): n is a, c, g, or t
  modified_base (396)..(396): a, c, t, g, unknown or other
  misc_feature (396)..(396): n is a, c, g, or t
  modified_base (416)..(416): a, c, t, g, unknown or other
  misc_feature (416)..(416): n is a, c, g, or t
tcagactgtacagtcacgaccggtgctcgatttagagtgagctcgttgggtttgggggggggtcacaagaggcagcgctctcgggacgtctccaccatggcctgggctctgctgctcctcactctcctcactcaggacacagggtcctgggcccagtctgccgtgactcagcctgcctcgtgtctgggtctcctggacagtcgatccacctattttcctgcacgtggactcagcactgatgtgcaggttattactttgtctcctggtaccaacaaccacccaggacaaacgcccctaaaacttactactatttatggacggccaactaacgccggccctagaggtatttctaatcgtcttctctcggctaccaagtcgngcagcacgccctccgtnactactctcgtcggctccgngtcgtaggacggacggaggtcttagtattacgttactcgtcctacttacaatacgtacggtacactactaccgtaaactaaaccgttcccgttacgttaccggtaccggtacgggtacccgtaacggggttaccctacccgggttccgtacgggtacccgaaccggtaccccggaaaccgggtaccccctaaaccccggtacgtaccgttacccg

SEQ ID NO: 232005 - DNA, 748 bp, Homo sapiens
  misc_feature: GYAE6OF02GTOYB.25.33.C11.1.454.CMB.1.raw
  modified_base (244)..(244): a, c, t, g, unknown or other
  misc_feature (244)..(244): n is a, c, g, or t
  modified_base (329)..(329): a, c, t, g, unknown or other
  misc_feature (329)..(329): n is a, c, g, or t
  modified_base (355)..(355): a, c, t, g, unknown or other
  misc_feature (355)..(355): n is a, c, g, or t
  modified_base (367)..(367): a, c, t, g, unknown or other
  misc_feature (367)..(367): n is a, c, g, or t
  modified_base (373)..(373): a, c, t, g, unknown or other
  misc_feature (373)..(373): n is a, c, g, or t
  modified_base (460)..(460): a, c, t, g, unknown or other
  misc_feature (460)..(460): n is a, c, g, or t
tcagactgtacagtcacgaccggtgctcgatttagagtgagctcgttgggtttgggggagctacaacaggcaggcaggggcagcaagatggtgttgcagacccaggtcttcatttctcgtgttgctctggatctcgtggtcgaccgtacggggacatcggtgttcgacccacgtcccccggtcctccctgcctgtcgtctcgtgggcgaggaggcccacatcaattcgtgacgaacgttccganaccgaagaacttcctactttccttaccctacaactaatacagacttacctaacgtaaagttcggtaaccagacgtaacgaaaccnggaacccaccctacgttaacgttacncttacgttacgnggtacncgttacgtggttacggaacgttccgggtccacgtccgtaattcgaaggtcgacgtacggcgggttcgagggtacacgttacgtaccncgtcctaccgtaactccgtacgtacgtcgaccttgaccgaggtactaacgaaggtatacggttacgtaccctttaacgtttacgtttaacggcgttaccggtataaacttaaggttaaacctttacgtaacccgtttacccgtttaaccgtaacgttttaccggtttacggaaccggttaaaccgggtactaccgggtacgtaccgggtaatacccgggttaaaccgtaacggacggttacgtcgggtacccgtaggaccccgtttaccctacggttccttaacccgg

SEQ ID NO: 232006 - DNA, 650 bp, Homo sapiens
  misc_feature: GYAE6OF02I4DCR.25.33.C11.1.454.CMB.1.raw
  modified_base (214)..(214): a, c, t, g, unknown or other
  misc_feature (214)..(214): n is a, c, g, or t
  modified_base (220)..(220): a, c, t, g, unknown or other
  misc_feature (220)..(220): n is a, c, g, or t
  modified_base (251)..(251): a, c, t, g, unknown or other
  misc_feature (251)..(251): n is a, c, g, or t
  modified_base (307)..(307): a, c, t, g, unknown or other
  misc_feature (307)..(307): n is a, c, g, or t
tcagactgtacagtcacgaccggtgctcgatttagagtgagctcgttgggtttggggggggtcacaagaggcagcgctctcgggacgtctccaccatggcctgggctctgctgctcctcactctcctcactcaggacacgagggtcctgggcccagtctgccgtgactcagcctgcctccgtgtctgggtcctccgtggacagtcgatccactntttccngcacgtgactcagcatgatgttgctaggttnttacttcgtctctcgtaccaacaacaccagacaaccgcccctaatatactatttancgacggacacgtaacgccgccctgaggtactttacgtaactcgtactttctcgtcgtcctaccagtcgtagctagctccggcctcctcgactactccgtagtcgtcctaccgaggtccgtaggacggacggacgtcgttactagtttacgttacgtacgtcctactcgtaatacgttcgaaccgtactaccttaactaacctaaacccgttcccgttaccggttacccgggaccgttaccgggtaacccgtacggggttaccctcccgggttaaccggtccggtaaccggtacccgaccccggaaccggtacccccgtaacccctacggttacctaaccccgg

SEQ ID NO: 232007 - DNA, 759 bp, Homo sapiens
  misc_feature: GYAE6OF02G0MZX.25.33.C11.1.454.CMB.1.raw
tcagactgtacagtcacgaccggtgctcgatttagagtgagctcgttgggtttgggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcacctattttcctgctactggacctcgagcactgatgttgctaggtttattactttgtcctccgtagtaccaacaaccacccgaggacaaaccgaccccctaaaattactctaatttacgtaggacggaccctaacgtaaacggccggcccctacgtagggtaacgttttactaacgtccgtccttcgtccgtcggtaccttaccgtaacgttcgtggacacgacccgaccggtccctccgtacgactacttccgtcgtcgggaccctcgacggtcgtacgggaggaccggaggtcttaagttactttacgttacgtacgttacctaactacgtaacgttaacgtaccggtaaccaaacttaaccgttaccctaaaaccggtttaaaacccgttccccggtttaacccgttacccggggtacccgggttaccgggtaaccccggggttaaccgggttaccccggttaacccggttccggggttaccgggtacccgaacccgggaaccccgtaaccgggaaccccctaaaccccggtcgtaaccgttacccccg

SEQ ID NO: 232008 - DNA, 677 bp, Homo sapiens
  misc_feature: GYAE6OF02GE6N5.25.33.C11.1.454.CMB.1.raw
  modified_base (202)..(202): a, c, t, g, unknown or other
  misc_feature (202)..(202): n is a, c, g, or t
  modified_base (221)..(221): a, c, t, g, unknown or other
  misc_feature (221)..(221): n is a, c, g, or t
tcagactgtacagtcacgaccggtgctcgatttagagtgagctcgttgggtttggggggggtcacaagaggcagcgctctcgggacgtctccaccatggcctggctctgctgctctcactctctcactcaggacacacgggtcctgggccctagtctagccgttgactcagcctgcctcgtcgtctgggtcctccgtggacncgtcgactccactattccngctactggtactcagactactggactggtgacgtaggtttattacgtttcgtcttccgtacggttaaccaacgaacctacccgaaggacccaaaccggtccccctaaaattcgtaactacgttacgtacgaacggtacctaacgtacgcccggtaccctagtacggttaacgttactaacgtccgtacttctcgtcgtacctactaagtcgtgacgtacgccgtaccggcctccctagtactaacgtccgtacggtcggtcctacgtaccggtagtacgggacggtaacggtcgtcgttaattacgttttactacgtactaccgtatcgtaacgttacgtcgaactacgctaacaaccgtaccgtcgttaccgtaccggactcgggtaacccgtggtcccttaccgtccggttagaccaccggactaacccggacccctaccggttctcgtacccc

SEQ ID NO: 232009 - DNA, 814 bp, Homo sapiens
  misc_feature: GYAE6OF02GOR6A.25.33.C11.1.454.CMB.1.raw
  modified_base (328)..(328): a, c, t, g, unknown or other
  misc_feature (328)..(328): n is a, c, g, or t
tcagactgtacagtcacgaccggtgctcgatttagagtgagctcgttgggtttgggggaagaggaagactgacggtcctcccaggagttcaggtgctgggacaccttgggcacgggggaggtgtgtcacaagatttgggctctgggcaccgtggagtctgggggagcgtggtccagcctggaagtccctgagactctcctgtgtggcgcctagacctcaccttcagtagttatggccttcgtcgtcgggtcccgacctagtcgtaccgaggtcgaaggggctgggagtggctgggattacgttggtctgacagactaaatgatatacncgacggacggtacgtaccggtagggacggggtccctagttaccgacctacgttacccgtaccggaacgggtaacctaaacgtttacccggaaaacggtaacccgtaaacccccgttagttaacgttaccgttaacggaaactaaaacgtacgtaaaacctaaccgtttagaacgggtaacggtacggtaaacgggttaacgttaacccgggttaccgttttaaacgtttacccgttacgggtccggtaaccgtaaccccgttaggtaaccggtagggttacgggaaccgttaaaggggtaaaaacgttccgggtaacgttccgttaaccgtaacccgttttcccggtaccgtacccgttacgggtccggggaccgtacggtacccgacccgttacgggtcctaccgtccgtccgtaccgtaccgtcccgttaacccgacccgtaccgggtaccctacggttcccgtacccgttccccgcgtccccg

SEQ ID NO: 232010 - DNA, 828 bp, Homo sapiens
  misc_feature: GYAE6OF02HN2P8.25.33.C11.1.454.CMB.1.raw
tcagactgtacagtcacgaccggtgctcgatttagagtgagctcgttgggtttggggagctctgggagaggagccccagccctgagattcccaggcgtttccattcggtgatcagcactgaacacagagaacgcaccatggaggttggactgagcttgggttttccttgtttagtttttttaaaaggtgtcccagtgtgaagtgaggctggaggagtcgtgggggaggcgtggtacagggccggggggtccttagctctctagtaaagtctctggtattctaatttgatagtaatatactatgacacgttgggtccctcgacggtccgtcggaagggggtaccggttcgtaaggtagggttcggttcttaccgttacgtttaaagttaaaaggtttgggtaacgtttcgggtttaccgtaaggtttaactaacggttaacgttaacgtaggttaacgggtccttacggttaggtaacgggtaaaccggggtcccgttacttacccgaacccttaacgttccccgtaaccgaacggtaacaaccgaaaccgtaacggaaaccctaaaaaccctcccttaacgttactacgtacgaacgttaagtaccggaacgtacccgtggaacgtaacggtacggaaaccgtacgtaaccggacccaccgaaactttagttaacgtttaaggtaacgtttaaagggttaaaccggggtagggtttaaccgttttaaaccgggtaaacgtttccggttaaggtaaccggtaacggttaaccgttaacgtttttaccggttaaccggtaacggtaacgtaggttacccggtaaccgggg

SEQ ID NO: 232011 - DNA, 669 bp, Homo sapiens
  misc_feature: GYAE6OF02F6UYX.25.33.C11.1.454.CMB.1.raw
  modified_base (397)..(397): a, c, t, g, unknown or other
  misc_feature (397)..(397): n is a, c, g, or t
tcagactgtacagtcacgaccggtgctcgatttagagtgagctcgttgggtttggggagctctgggagaggagccccagcccctgagattccccaggcgtttccattcggtgatcagcactgaacacagagaacgcaccatggaggttggactgagctgggttttccttgtttgtttttttaaaaggtgcccagtgtgaagtgcggctggaggagtcgtgggggaggcgtggtacgaggccggggggtcccttagactctccgtgtaagtctctggattctattttgatgaatatatatgctacgtgggtccatcgaggcgtcgagggggacggtcgtaggaggtggttctctacttaataagttggagttgttcagtatagactagtgtagtcttntggtagacgggccgtcttacaccagttccacgtaggacgtaacccaaactaacgaacctaaaaacccgttcccctaacgttacctacgttacgaactaaacgttacggaaccgtacccgtaggacggtaagaacggtaacgtaacgacgaccgtacccaacgttaattaacgtttacgttagtaaaggttaaagggacggttacgtttaacgggtaactcgttacggaaggtacgaacgtttagtttaccgtttacgacggtctagttacgg

SEQ ID NO: 232012 - DNA, 689 bp, Homo sapiens
  misc_feature: GYAE6OF02FKW8D.25.33.C11.1.454.CMB.1.raw
  modified_base (180)..(180): a, c, t, g, unknown or other
  misc_feature (180)..(180): n is a, c, g, or t
  modified_base (186)..(186): a, c, t, g, unknown or other
  misc_feature (186)..(186): n is a, c, g, or t
  modified_base (188)..(188): a, c, t, g, unknown or other
  misc_feature (188)..(188): n is a, c, g, or t
  modified_base (193)..(193): a, c, t, g, unknown or other
  misc_feature (193)..(193): n is a, c, g, or t
  modified_base (195)..(195): a, c, t, g, unknown or other
  misc_feature (195)..(195): n is a, c, g, or t
  modified_base (200)..(200): a, c, t, g, unknown or other
  misc_feature (200)..(200): n is a, c, g, or t
  modified_base (205)..(205): a, c, t, g, unknown or other
  misc_feature (205)..(205): n is a, c, g, or t
  modified_base (219)..(219): a, c, t, g, unknown or other
  misc_feature (219)..(219): n is a, c, g, or t
  modified_base (264)..(264): a, c, t, g, unknown or other
  misc_feature (264)..(264): n is a, c, g, or t
  modified_base (294)..(294): a, c, t, g, unknown or other
  misc_feature (294)..(294): n is a, c, g, or t
  modified_base (386)..(386): a, c, t, g, unknown or other
  misc_feature (386)..(386): n is a, c, g, or t
tcagactgtacagtcacgaccggtgctcgatttagagtgagctcgttgggttttggggagctctgggagaggagcccccagccctgagattccccaggcgtttccattcggtgatcagcactgaacacagagaacgcaccatggaggttggactgagcggtgtttcgtgttagtttaagngcagtntnagtgngntgagngtcgngggagcgtgtacgnggtccggggtcctagactctctagtaatctactgattacaatttnatgtaatacttactatgctacgtggtccgngtgcgtacgtagggacgtctaggtagtcggtcttctagttataacggttggacttggtacagttataccgtataacgtgtaggttcgtttanacggtacggtaacggacccgtttccgtaaccgttaaccgaccgttttcccaaccggtaaccgaaaccgtaacgaaacgaaacccggtaaaaccctaaaaacccttcccgtttaactaacgtaccttacgaaacttacgtaacggaacgcccgagaaaccgtaggtaacgaaaaggccgtacgaaccgtactaagttaagttaacgtttaagttaaacggagttaaacgggttagtacggtttaaacgtacttacgaacggtaagtaccgtaattacggttcttaacgacgagagtacgtacgg

SEQ ID NO: 232013 - DNA, 719 bp, Homo sapiens
  misc_feature: GYAE6OF02HKY2K.25.33.C11.1.454.CMB.1.raw
  modified_base (199)..(199): a, c, t, g, unknown or other
  misc_feature (199)..(199): n is a, c, g, or t
  modified_base (211)..(211): a, c, t, g, unknown or other
  misc_feature (211)..(211): n is a, c, g, or t
  modified_base (218)..(218): a, c, t, g, unknown or other
  misc_feature (218)..(218): n is a, c, g, or t
tcagactgtacagtcacgaccggtgctcgatttagagtgagctcgttgggtttgggggggggtcacaagaggcagcgctctcgggacgtctccaccatggcctgggctctgctgctcctcactctcctcactcaggacacgagggtcctgggcccagttctgccgtgactcagcctgcctcgtgtctggtctcgtgacngtcgatccactntttccgngccacgtgctcacgcactgagttcgtgacgtaggtttatttacgtttgtccttcgtacgtaccaactaaccaccgaaggaccaaaccgaaccccctaaatttactaccttaattttagacgacgtacccaacgtaccggaccgtaccctagtaacggttactttacgttactaccgttctttcgtcgttacggtcctaccgtaaggtccgtcggtacgacgtcccgaccgtccctacctacgtactacgtctcggtcggtactccgaggcgtacgggacggtaggacgtcgtagtagtttacgtttctacgccttactagtacgttaacgtcggtaacctactacgtaaccaaccgttaaacccgttcccgtttaacccggttccggtaccggttaccgggtaccgggtaaccggtacccggttacccggtcccggtacggggttaaccccaccggaaccccggtaccccgtaacccccgtaactcccgttacgtaacccg

SEQ ID NO: 232014 - DNA, 739 bp, Homo sapiens
  misc_feature: GYAE6OF02GSX4D.25.33.C11.1.454.CMB.1.raw
  modified_base (220)..(220): a, c, t, g, unknown or other
  misc_feature (220)..(220): n is a, c, g, or t
  modified_base (730)..(730): a, c, t, g, unknown or other
  misc_feature (730)..(730): n is a, c, g, or t
tcagactgtacagtcacgaccggtgctcgatttagagtgagctcggttggggtttggggggggtcacaagaggcagcgctctcgggacgtctccaccatggcctgggctctgctgctcctcactctcctcactcaggacacagggtcctgggcccagtctgccgtgactcagcctgcctccgtgtctgggtctccgtggacagtcgatcacctatttccngcacgtggactcagcactgtactgttcgacgtaggtttactttacgtttggtcccttcggtacggtaaccaaccaaccacccgaggaccaaaaccgaccccccgtaaaatttacttacctaagttttaacgcggtaacgggacccctaaacgttaaacggcccggttaccccttacggaagggtttaacgttttaccgtaaacgttcccggtaccttttaccgtacgtccgggttaccttacccgtaaacggttccgtacggtaccgtaccggacctaacccgggtccccttacccgtacgtaactaacgttccgttaccgtcgggaccttccggacgtcgtacgggacggtaccggtaggttacgttagtactttaactccgtacgtacttactaccagttagtacggtacacctacttacgaaactacgtcccgttacgtaccggtacgtcgggacgtacggtacctaccgtcgtacggtccgacgtaccgaaccggtacccaccctnacgttaccg

SEQ ID NO: 232015 - DNA, 605 bp, Homo sapiens
  misc_feature: GYAE6OF02FSUAC.25.33.C11.1.454.CMB.1.raw
  modified_base (144)..(144): a, c, t, g, unknown or other
  misc_feature (144)..(144): n is a, c, g, or t
  modified_base (265)..(265): a, c, t, g, unknown or other
  misc_feature (265)..(265): n is a, c, g, or t
tcagactgtacagtcacgaccggtgctcgatttagagtgagctcgttgggtttgggggaggcgtggtacagccggggggtcccttagactctcctgtaaagtctctggatttagtttcagtggttctggcatgcactgggtccnccaggctccaggcaaggggtcggagtggttggcagttatagcacatgatggaagttctgaatattatgcagactccggtgaagggccgattcgaccatcctccagagacaattcccggaanttgtagtacttggaaatggtcaagtcctgagagtcgaggactcggctctgtacttactgtgcgtagatcgggaggtgtagtagttatcggcgcatgactgggccaggggaccctggcacccggtctcccgtcgacgcccgtccgaacccgaacgggcccgtacgtccgggtccctttcccccgtcgggcccgtcccgtcgaccctccgacggacgcctacccgtccgacgacgcacgagccggcccgtgggccctcggccttcggtaccaacggaccttacctaccgaccgttcgtaccgtacgtcgtacgacggtcggcgtcggccaagggccagtacg

SEQ ID NO: 232016 - DNA, 807 bp, Homo sapiens
  misc_feature: GYAE6OF02IUJL0.25.33.C11.1.454.CMB.1.raw
  modified_base (678)..(678): a, c, t, g, unknown or other
  misc_feature (678)..(678): n is a, c, g, or t
  modified_base (704)..(704): a, c, t, g, unknown or other
  misc_feature (704)..(704): n is a, c, g, or t
tcagactgtacagtcacgaccggtgctcgatttagagtgagctcgttgggtttgggggagctctgggagaggagccccagccctgagattcccaggcgtttccattcggtgatcagcactgaacacagagaacgcaccatggaggttggactgagtcgttggttttcctttgttttagtttttttaaaggtgtcctagttgtgaagtgacaacgtggtggagtcggtggggacgccggtggtacgacgggtcccggggggtccctaggagtaccttctccgttggtcggtacgtccttcgtcggtattcgtagttggtttacgtagttagtatttagtcgcctagtcgcctacggttcgggtcccgtacggtaaccgggggtaccgggggtaagggtcggttacgggtagggttcgggttaccctttcgttacgtttacggtacggttacgggttaggggtacggtaggggtaaacggaaaccgtaaccttaacgtagtacgaccgtaacgtaccgttcggttaggtaacggtaacgggttaccgtaccgtttacccgaacccgtaccgtaccgaagtaaccgaaacctaaacgtacttaaaccgaaaccgttaccccttaccgtagtaacttcgtaaacgaacgtaacgtcgacgtacgtacgtacctacttaacgntaaccgccgtacctcccgttaagttntttaacgtttggttggtaaggttacggaagggtttcgttggttaaggcggttaagtcggtacccgtaacccggtaccccgggtaacccgtcggtacctaacgg

SEQ ID NO: 232017 - DNA, 627 bp, Homo sapiens
  misc_feature: GYAE6OF02FPQDW.25.33.C11.1.454.CMB.1.raw
  modified_base (219)..(219): a, c, t, g, unknown or other
  misc_feature (219)..(219): n is a, c, g, or t
  modified_base (371)..(371): a, c, t, g, unknown or other
  misc_feature (371)..(371): n is a, c, g, or t
  modified_base (460)..(460): a, c, t, g, unknown or other
  misc_feature (460)..(460): n is a, c, g, or t
tcagactgtacagtcacgaccggtgctcgatttagagtgagctcgttgggtttgggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcacctatttcccngcacgtggactcagcactgatgtgctaggttattactttgtctcctggtaccaacaacaccagcaaacgccccaaattactcatttatgacggaccaactaagccgtaccctcgaggtacgtttctaatcgactttctctcggctccagtcnggcagcacgcctccagactactctacgtcggcctccgaggtctaggtacggacgacgggtcttagtatttacgttactgtacttacctntaacgtacgtggaaccaccgtaattaccaaaccttaaaccgttccccgttaccgtttaccgggtacccggttaccggggaaccgtaccggggtaccttacccggttccggttcggtacccgacggacccccgaacggacccccaacccggttacctcggtaaccccg

SEQ ID NO: 232018 - DNA, 493 bp, Homo sapiens
  misc_feature: GYAE6OF01AHYXL.5.27.C05.1.454.CMB.1.raw
  modified_base (171)..(171): a, c, t, g, unknown or other
  misc_feature (171)..(171): n is a, c, g, or t
  modified_base (174)..(177): a, c, t, g, unknown or other
  misc_feature (174)..(177): n is a, c, g, or t
  modified_base (180)..(180): a, c, t, g, unknown or other
  misc_feature (180)..(180): n is a, c, g, or t
  modified_base (182)..(182): a, c, t, g, unknown or other
  misc_feature (182)..(182): n is a, c, g, or t
  modified_base (273)..(273): a, c, t, g, unknown or other
  misc_feature (273)..(273): n is a, c, g, or t
  modified_base (330)..(330): a, c, t, g, unknown or other
  misc_feature (330)..(330): n is a, c, g, or t
  modified_base (340)..(340): a, c, t, g, unknown or other
  misc_feature (340)..(340): n is a, c, g, or t
  modified_base (363)..(363): a, c, t, g, unknown or other
  misc_feature (363)..(363): n is a, c, g, or t
  modified_base (394)..(394): a, c, t, g, unknown or other
  misc_feature (394)..(394): n is a, c, g, or t
  modified_base (396)..(396): a, c, t, g, unknown or other
  misc_feature (396)..(396): n is a, c, g, or t
  modified_base (398)..(398): a, c, t, g, unknown or other
  misc_feature (398)..(398): n is a, c, g, or t
  modified_base (403)..(403): a, c, t, g, unknown or other
  misc_feature (403)..(403): n is a, c, g, or t
  modified_base (405)..(405): a, c, t, g, unknown or other
  misc_feature (405)..(405): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatgggtaggttggctgaggctggttctaggtgcattaagngcnnnngtncngtgtgagtctgggactgcagcctggggtcctgagctctcctgtgtagcctctgcgttcaccgtcagtgcaattacatgcgctggtccgccnggctccaggtaagggcgtggagtgggtctcagttattatagcgagtggaaccgcacncttcgcagcncgcgagggcgagatcacatctcngagacactacacgaactaccttactcttcanananacacncngagacgacgacgtacgtcgcgtctctactctgtgagagcgtcgacgtcgtcgtgtcgtcgacgtacggtcggtccggtcccggtcggg

SEQ ID NO: 232019 - DNA, 521 bp, Homo sapiens
  misc_feature: GYAE6OF01AMW6G.5.27.C05.1.454.CMB.1.raw
  modified_base (386)..(386): a, c, t, g, unknown or other
  misc_feature (386)..(386): n is a, c, g, or t
  modified_base (479)..(479): a, c, t, g, unknown or other
  misc_feature (479)..(479): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagcctggggggtccctgagactctcctgtgtagcctctgcgttcaccgtcagtagcaattacatgagctggtccgccaggctccaggtaaggggctggagtgggtctcagtttatttatagcgatcggaaccgcacacttcgcagactcgcgaggggcagnttcaccatctcagagacaattccaagaacctaccctttatcttcagatgaacagcctgagagccgaggctcggctgtctattactgtgcgagngtcacgtggctggtccagcaggtggttccgccccgtcggggg

SEQ ID NO: 232020 - DNA, 263 bp, Homo sapiens
  misc_feature: GYAE6OF01A2NQQ.5.27.C05.1.454.CMB.1.raw
  modified_base (258)..(263): a, c, t, g, unknown or other
  misc_feature (258)..(263): n is a, c, g, or t
tcagatcagacacgcacgaccggtgctcgatttagacgcgatcgaagggtttgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccgccctcctccgtgtctgatctgagcgggctggcaaggcgcatagnnnnnn

SEQ ID NO: 232021 - DNA, 520 bp, Homo sapiens
  misc_feature: GYAE6OF01BM871.5.27.C05.1.454.CMB.1.raw
  modified_base (152)..(152): a, c, t, g, unknown or other
  misc_feature (152)..(152): n is a, c, g, or t
  modified_base (387)..(387): a, c, t, g, unknown or other
  misc_feature (387)..(387): n is a, c, g, or t
  modified_base (393)..(393): a, c, t, g, unknown or other
  misc_feature (393)..(393): n is a, c, g, or t
  modified_base (402)..(402): a, c, t, g, unknown or other
  misc_feature (402)..(402): n is a, c, g, or t
  modified_base (416)..(416): a, c, t, g, unknown or other
  misc_feature (416)..(416): n is a, c, g, or t
  modified_base (418)..(418): a, c, t, g, unknown or other
  misc_feature (418)..(418): n is a, c, g, or t
  modified_base (420)..(420): a, c, t, g, unknown or other
  misc_feature (420)..(420): n is a, c, g, or t
  modified_base (422)..(422): a, c, t, g, unknown or other
  misc_feature (422)..(422): n is a, c, g, or t
  modified_base (427)..(427): a, c, t, g, unknown or other
  misc_feature (427)..(427): n is a, c, g, or t
  modified_base (429)..(429): a, c, t, g, unknown or other
  misc_feature (429)..(429): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcggngtttcgtctaggcgtatttaaagtgtcagtgtgaggtgcagttggtggagtctgggggaaccttggtccagcctgggggtccctgagctctcctgtgtagcctctgcgttcaccgtcagtagcaattacatgagctgggtccgccaggctccaggtaaggggctggagtgggtctcagttattatagcgagtggaaccgcacacttcgcagctccgcgagggcagattcacatcnccaganacatacaanactaccttatctananananacacncngagacgacgacgacgcgctctctatactcgtgtcgagtacgtactacgtcgtcgtcgtcgtacgacgtaggtcggtccggtcccggtcggg

SEQ ID NO: 232022 - DNA, 517 bp, Homo sapiens
  misc_feature: GYAE6OF01DQBQN.5.27.C05.1.454.CMB.1.raw
  modified_base (342)..(342): a, c, t, g, unknown or other
  misc_feature (342)..(342): n is a, c, g, or t
  modified_base (421)..(421): a, c, t, g, unknown or other
  misc_feature (421)..(421): n is a, c, g, or t
  modified_base (435)..(435): a, c, t, g, unknown or other
  misc_feature (435)..(435): n is a, c, g, or t
  modified_base (476)..(476): a, c, t, g, unknown or other
  misc_feature (476)..(476): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagcctggggggtccctgagactctcctgtgtagcctctgcgttcaccgtcagtagcaattacatgagctgggtccgcaggctccaggtaagggctggagtgggtctcagttatttanagcgatggaaccgcacacttcgcagactcgcgagggcagattcacatctccagagacaattccaaagaacaccctttancttacagatgaacngcctgagagccgagactcggctgtctattactgtcgcgagngtcactggctaggccagcaggttcggtccgccccgtagggg

SEQ ID NO: 232023 - DNA, 593 bp, Homo sapiens
  misc_feature: GYAE6OF01AT81M.5.27.C05.1.454.CMB.1.raw
  modified_base (196)..(196): a, c, t, g, unknown or other
  misc_feature (196)..(196): n is a, c, g, or t
  modified_base (262)..(262): a, c, t, g, unknown or other
  misc_feature (262)..(262): n is a, c, g, or t
  modified_base (275)..(275): a, c, t, g, unknown or other
  misc_feature (275)..(275): n is a, c, g, or t
  modified_base (331)..(331): a, c, t, g, unknown or other
  misc_feature (331)..(331): n is a, c, g, or t
  modified_base (393)..(393): a, c, t, g, unknown or other
  misc_feature (393)..(393): n is a, c, g, or t
  modified_base (406)..(406): a, c, t, g, unknown or other
  misc_feature (406)..(406): n is a, c, g, or t
  modified_base (451)..(451): a, c, t, g, unknown or other
  misc_feature (451)..(451): n is a, c, g, or t
  modified_base (509)..(509): a, c, t, g, unknown or other
  misc_feature (509)..(509): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcggtggtttcgtcgtaggcgtactttaaaaggtgtcagtgtgaggtgnagttggtggagtctgggggaaccttggtccagccgtgggggtccctgagctctcctgtgtagcctntgcgttcaccgtnagtagcaattacatgagctggccgccaggctccgaggtacgggctggagtggtctntagttattagtgcgtagtcggaaccgcacgtaccttgcagactcgcgagggccaagtctacncctatcaccaganacataccgaaagtacctacctttatccttacagtaatacggaacncggtacctggaacgacgaccccggaagtccgtcggtcttggttaccttagtttaccgngtacgacgtacggtacgttcgacggtcggtccgttacggaccgtacggtacggtagggttcccggtaccccggcccgggtcggg

SEQ ID NO: 232024 - DNA, 520 bp, Homo sapiens
  misc_feature: GYAE6OF01CQUTT.5.27.C05.1.454.CMB.1.raw
  modified_base (479)..(479): a, c, t, g, unknown or other
  misc_feature (479)..(479): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagcctggggggtccctgagactctcctgtgtagcctctgcgttcaccgtcagtagcaattacatgagctgggtccgccaggctccaggtaaggggctggagtgggtctcagttattatagcgatggaaccgcacacttcgcagactccgcgaggggcagattcacatctccagagacaattccaagaaccaccctttatcttacagatgaacagcctgagagccgaggactcggctgtctattactgtgcgagngtcactggctggtccagcgaggtcggtccggcccgtcgggg

SEQ ID NO: 232025 - DNA, 578 bp, Homo sapiens
  misc_feature: GYAE6OF01CGVEU.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttcctgttgctattttaaaaggtgtccagtgtgaggtgcagttggtggagtctgggggaaccttggtccagccgtggggggtccctgagactctcctgtgtagcctctgcgttcaccgtcagtagcaattacatgagctgggtccgcaggctccaggtaaggggctggagtgggtctcagttattatagcgatcggaaccgcacacttcgacagactccgcgaggggcagatcaccatctaccagtacgaactaacttaccaagtaacctaccctttatccttacagtatacgaacagcctgaagtacgccgaggtacctcggcttggtactacgttacgtgtcgtcgaaggtcgttccaacgtcggggccttcgggtacccgaggtccgtagggttcgggttcccgacccccggtcgggggg

SEQ ID NO: 232026 - DNA, 261 bp, Homo sapiens
  misc_feature: GYAE6OF01EUTGY.5.27.C05.1.454.CMB.1.raw
  modified_base (258)..(261): a, c, t, g, unknown or other
  misc_feature (258)..(261): n is a, c, g, or t
tcagatcagacacgcacgaccggtgctcgatttagacgcgatcgaagggtttgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccaccctcctccgtgtctgatctgagcgggctggcaaggcgcatagnnnn

SEQ ID NO: 232027 - DNA, 260 bp, Homo sapiens
  misc_feature: GYAE6OF01BYG7Q.5.27.C05.1.454.CMB.1.raw
  modified_base (258)..(260): a, c, t, g, unknown or other
  misc_feature (258)..(260): n is a, c, g, or t
tcagatcagacacgcacgaccggtgctcgatttagacgcgatcgaagggtttgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccaccctcctccgtgtctgatctgagcgggctggcaaggcgcatagnnn

SEQ ID NO: 232028 - DNA, 578 bp, Homo sapiens
  misc_feature: GYAE6OF01D2ZAV.5.27.C05.1.454.CMB.1.raw
  modified_base (345)..(345): a, c, t, g, unknown or other
  misc_feature (345)..(345): n is a, c, g, or t
  modified_base (362)..(362): a, c, t, g, unknown or other
  misc_feature (362)..(362): n is a, c, g, or t
  modified_base (372)..(372): a, c, t, g, unknown or other
  misc_feature (372)..(372): n is a, c, g, or t
  modified_base (398)..(398): a, c, t, g, unknown or other
  misc_feature (398)..(398): n is a, c, g, or t
  modified_base (458)..(458): a, c, t, g, unknown or other
  misc_feature (458)..(458): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcgtgggtttcctgttgctatttaaagtgtccagtgtgaggtgcagttggtggagtctgggggaaccttggtccagccgtgggggtccctgagactctcctgtgtagcctcgtgcgttcaccgtcagtagacaattacatgagctgggtccgccaggcctccgaggtaagggctggagtgggtctagagttagtttanagcgagtacggaaccgnactactcgcngactcggcgagggtcagatcaaccancctacagacgacaattaccaaagactaaaccctttagtacttaccgagaatcggaaaacngtaccagagacgccggaacggtacttcgggccttgcctttaaagtgttcgaggacgaggtacgttacaccggttggacctggtacccgagcgaagggttcgttcccggaacccgtcgggg

SEQ ID NO: 232029 - DNA, 261 bp, Homo sapiens
  misc_feature: GYAE6OF01BK3UL.5.27.C05.1.454.CMB.1.raw
  modified_base (259)..(261): a, c, t, g, unknown or other
  misc_feature (259)..(261): n is a, c, g, or t
tcagatcagacacgcacgaccggtgctcgatttagacgcgatcgaagggtttgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctcgttcccgccctcctccgtgtctgatctgagcgggctggcaaggcgcatagnnn

SEQ ID NO: 232030 - DNA, 572 bp, Homo sapiens
  misc_feature: GYAE6OF01EZN4M.5.27.C05.1.454.CMB.1.raw
  modified_base (181)..(181): a, c, t, g, unknown or other
  misc_feature (181)..(181): n is a, c, g, or t
  modified_base (184)..(184): a, c, t, g, unknown or other
  misc_feature (184)..(184): n is a, c, g, or t
  modified_base (187)..(187): a, c, t, g, unknown or other
  misc_feature (187)..(187): n is a, c, g, or t
  modified_base (189)..(190): a, c, t, g, unknown or other
  misc_feature (189)..(190): n is a, c, g, or t
  modified_base (194)..(194): a, c, t, g, unknown or other
  misc_feature (194)..(194): n is a, c, g, or t
  modified_base (196)..(196): a, c, t, g, unknown or other
  misc_feature (196)..(196): n is a, c, g, or t
  modified_base (198)..(198): a, c, t, g, unknown or other
  misc_feature (198)..(198): n is a, c, g, or t
  modified_base (206)..(207): a, c, t, g, unknown or other
  misc_feature (206)..(207): n is a, c, g, or t
  modified_base (209)..(209): a, c, t, g, unknown or other
  misc_feature (209)..(209): n is a, c, g, or t
  modified_base (214)..(214): a, c, t, g, unknown or other
  misc_feature (214)..(214): n is a, c, g, or t
  modified_base (216)..(218): a, c, t, g, unknown or other
  misc_feature (216)..(218): n is a, c, g, or t
  modified_base (220)..(221): a, c, t, g, unknown or other
  misc_feature (220)..(221): n is a, c, g, or t
  modified_base (223)..(223): a, c, t, g, unknown or other
  misc_feature (223)..(223): n is a, c, g, or t
  modified_base (242)..(243): a, c, t, g, unknown or other
  misc_feature (242)..(243): n is a, c, g, or t
  modified_base (246)..(246): a, c, t, g, unknown or other
  misc_feature (246)..(246): n is a, c, g, or t
  modified_base (261)..(261): a, c, t, g, unknown or other
  misc_feature (261)..(261): n is a, c, g, or t
  modified_base (273)..(273): a, c, t, g, unknown or other
  misc_feature (273)..(273): n is a, c, g, or t
  modified_base (275)..(275): a, c, t, g, unknown or other
  misc_feature (275)..(275): n is a, c, g, or t
  modified_base (277)..(277): a, c, t, g, unknown or other
  misc_feature (277)..(277): n is a, c, g, or t
tcagatcagacacgcacgaccggtgctcgatttagacgcgatcgaagggtttggggctgggagaggagccccagcactgggattccgaggtgtttccattcagtgatctgcactgaacacagaggactcgccatggagtttgggctgagcggcgttcgtctaggcgtcttaaagtagcagngtnagngnngtgngntnggactgcnncngggcnannncnngngctctgctcacgtcagtannatngtgcgcgtggcgcgngcgcgaggaggngngngtggtcgtcgtagttattagtagacgacgtacgaccgacgactacgtacgacgacgacgtccgcggacgggacgacgtacgtactacctactctaccgacgacgtactaactaaccaacgtaaacctaacccttacttaccttactaacgtacgtaacgtaacgacgaccgtacgtaacggaacggaccggacggtacgtacgtcgtcgttacgttacgttacgtacgtcgtagtacgtcgtacgtacgtcgtcgtcgtacgtacgacgtacggtcggtcccggtcccggtccgg

SEQ ID NO: 232031 - DNA, 592 bp, Homo sapiens
  misc_feature: GYAE6OF01CMK34.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtcgtgggggaaccttggtccagccgtggggggtccctgagactctcctgtgtagcctctgcgttcaccgtcagtagcaattacatgagctgggtccgccaggctccgaggtaagggctggagtgggtctcgagtttattagtagcgatggaaccgcacacttcgcagactccgcgagggcagatcaccatctcagagacaacttaccaagaacctacctttatacttacagtatacgaacagcctagaacgacggaccggaacggaccgtccgggcttacggtcttaacgttaccgtggtacggtcggaaggtacgtacgacgttgggccgttcgggtacccaggacgtaggggttcggttcccgggacccccggttaccgggggg

SEQ ID NO: 232032 - DNA, 294 bp, Homo sapiens
  misc_feature: GYAE6OF01A6HNY.5.27.C05.1.454.CMB.1.raw
  modified_base (284)..(294): a, c, t, g, unknown or other
  misc_feature (284)..(294): n is a, c, g, or t
tcagatcagacacgcacgaccggtgctcgatttagacgcgatcgaagggtttgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttccccgccctcccgtcgtctcgtagtacttcgtaggacgggccgggtcgtcggacggaacgggccgactagtagnnnnnnnnnnn

SEQ ID NO: 232033 - DNA, 521 bp, Homo sapiens
  misc_feature: GYAE6OF01ES4GL.5.27.C05.1.454.CMB.1.raw
  modified_base (426)..(426): a, c, t, g, unknown or other
  misc_feature (426)..(426): n is a, c, g, or t
  modified_base (480)..(480): a, c, t, g, unknown or other
  misc_feature (480)..(480): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagcctggggggtccctgagactctcctgtgtagcctctgcgttcaccgtcagtagcaattacatgagctgggtccgccaggctccgaggtaaggggctggagtgggtctcagttatttatagcgatggaaccgcacacttcgcagactccgcgaggggcagattcaccatctccagagacaattccaagaacaccctttancttcagatgaacagcctgagagccgaggactcggctgtctattactgtgcgagngtcactggctggtccagcaggtcggttccgccccgtcgggg

SEQ ID NO: 232034 - DNA, 263 bp, Homo sapiens
  misc_feature: GYAE6OF01EBVAO.5.27.C05.1.454.CMB.1.raw
  modified_base (259)..(263): a, c, t, g, unknown or other
  misc_feature (259)..(263): n is a, c, g, or t
tcagatcagacacgcacgaccggtgctcgatttagacgcgatcgaagggtttgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttccccgccctcctccgtgtctgatctgagcgggctggcaaggcgcatagnnnnn

SEQ ID NO: 232035 - DNA, 529 bp, Homo sapiens
  misc_feature: GYAE6OF01CKSZE.5.27.C05.1.454.CMB.1.raw
  modified_base (401)..(401): a, c, t, g, unknown or other
  misc_feature (401)..(401): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagcctggggggtccctgagactctcctgtgtagcctctgcgttcaccgtcagtagcaattacatgagctgggtccgccaggctccgaggtaggggctggagtgggtctcagttattatagcgatggaaccgcacacttcgcagactccgcgaggggcagattcaccatctccaganacaatccaagaacctaccctttatcttacagatgaacagcctagacgagccgaggacgtcggctgtctattctgtgcgagtacgtcacgtggcgtggtccagcgagggtcggtccgacccggtcgggg

SEQ ID NO: 232036 - DNA, 258 bp, Homo sapiens
  misc_feature: GYAE6OF01A3YE4.5.27.C05.1.454.CMB.1.raw
  modified_base (258)..(258): a, c, t, g, unknown or other
  misc_feature (258)..(258): n is a, c, g, or t
tcagatcagacacgcacgaccggtgctcgatttagacgcgatcgaagggtttgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccaccctcctccgtgtctgatctgagcgggctggcaaggcgcatagn

SEQ ID NO: 232037 - DNA, 540 bp, Homo sapiens
  misc_feature: GYAE6OF01D6MWZ.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggtttcctgttgctatttaaaaggttagtccagtgtgaggtgcagttggtggagtctgggggaaccgttggtccagcctggggggtcccgtcgagactctcctgtgtagcctctgcgttcaccgtcagtagcaattacatgagctggtccgccaggctccaggtaaggggctggagtgggtctcagttatttatagcgagtggaaccgcacacttcgcagactccgcgaggggcagattcacatctcccagagacaattccaagaacacccctttatcttcaagactgaaacagcctgagacgccgagctcggctgtctattacctgtcgcgagacgttcacgtggctggttacccaggcagggttcggttccgacccccggtcggggg

SEQ ID NO: 232038 - DNA, 607 bp, Homo sapiens
  misc_feature: GYAE6OF01E0ZCU.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttcctgttgctatttaaaggtagtccagtgtgaggtgcagttggtggagtcgtgggggaaccttggtccagccgtgggggtccctgagactctcctgtgtagcctctgcgttcaccgtcagtagcaattacatgagcgtgggtcccgccagggcctccgagggtaaggggctgggaggtgggtctcgtagtttatttataggcgatggaaccgcactacgttcgcagacctccggcggacggggcagattccacctatcctccagacgaactaacttaccaaacgtaacctaacccctttatccttacagacttacgaactagcccgtagaacgacgcccggaagggtaccgtcggtctacggtacttacgttacgtcggtcgacggagtacgtccacggtcggcgttggtaccgtaggcgtagggttccggttcccggccccggtcggggg

SEQ ID NO: 232039 - DNA, 575 bp, Homo sapiens
  misc_feature: GYAE6OF01B7KKR.5.27.C05.1.454.CMB.1.raw
  modified_base (368)..(368): a, c, t, g, unknown or other
  misc_feature (368)..(368): n is a, c, g, or t
  modified_base (469)..(469): a, c, t, g, unknown or other
  misc_feature (469)..(469): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtcgtgggggaaccttggtccagccgtgggggtccctgagactctcctgtgtagcctctgcgttcaccgtcagtagctaattacatgagctgggtccgcaggctccgaggtaaggggctgggagtgggtctcgtagtttattagtagcgtaatcgggaaaccncgaactacttcgcaacgaccgtccggacggaggggcagagttccaccgtatcctacagacgacaactaccaagaaccctaccttatcttacagatagaacngacctggacgacgccgaaggcctcggctgtactagttactgtcgacgtagcgtcacgtcggacgttcggccgagccgtagggtcggttcccggccccggtacgggg

SEQ ID NO: 232040 - DNA, 659 bp, Homo sapiens
  misc_feature: GYAE6OF01D43TL.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggtttcctgttgctatttaaaaggtgtccagtgtgaggtgcagttggtggagtcgtgggggaaccttggtccagccgtgggggtccctgagactctcctgtgtagcctctgcgttcaccgtcagtagcaattacatgagcgtgggtcccgccaggcctccgagggtaaggggctgggaggtgggtctcgtagtttattatagcgtagtacggaaccgcaacaccttcgacaaggacctccggacggacgggggcaaggtacttccaaccctattcctacccgaagaacgtaaactaaacgtttacccgaaaacgtaaacccttaaccccttttaattacctttaccgaagtaacttaccggaaactacggtacccttaggaacggaccggacccggaagggtacccgttccggtacgttcgttacttaacgttacgtggtcggacggagtacggtccacggtggccgttggacccaggcgtagggtcggttcccgcccgggtacgggg

SEQ ID NO: 232041 - DNA, 540 bp, Homo sapiens
  misc_feature: GYAE6OF01AOTPB.5.27.C05.1.454.CMB.1.raw
  modified_base (394)..(394): a, c, t, g, unknown or other
  misc_feature (394)..(394): n is a, c, g, or t
  modified_base (402)..(402): a, c, t, g, unknown or other
  misc_feature (402)..(402): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagcctggggggtccctgagactctcctgtgtagcctctgcgttcaccgtcagtagcaattacatgagctgggtcccgccaggctccaggtaaggggctgggagtgggtctcagttattataggcgatggaaccgcacacttcgcagactccgcgaggggcagatcaccntctcaganacaatccaagaacctaccctttatccttcagatgaacagcctgagacgccgaggactcggctggtctattactgtgcgtagacgtccacgtcggcgtggtccgagtcgtagggttcgggttcccgccccggtcggggg

SEQ ID NO: 232042 - DNA, 619 bp, Homo sapiens
  misc_feature: GYAE6OF01CGPF0.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgcttattttaaaaggtgtccagtgtgaggtgcagttggtggagtcgtgggggaaccttggtccagccgtggggggtccctgagactctcctgtgtagcctctgcgttcaccgtcagtagcaattacatgagcgtgggtcccgccgaggcctccgaagggtaagggctgggagtgggtctcgtagtttatttagagcgagtcggaaccgcacacttcgacacgacctccggcggaggggcaggtacttccaccatcctacagaacgaacaattaccaagaaacctaccctttatcttacatatagaaacagccctaggaacgtacggacccggaaagggtcctacggtctacgttacttaagttccgttagtggaccgtagtacgtcgtacgtcgggtacgtacggtacccagggtacgtacggggttacggttcccggaccccggtaccgggggg

SEQ ID NO: 232043 - DNA, 540 bp, Homo sapiens
  misc_feature: GYAE6OF01CX3IY.5.27.C05.1.454.CMB.1.raw
  modified_base (354)..(354): a, c, t, g, unknown or other
  misc_feature (354)..(354): n is a, c, g, or t
  modified_base (369)..(369): a, c, t, g, unknown or other
  misc_feature (369)..(369): n is a, c, g, or t
  modified_base (398)..(398): a, c, t, g, unknown or other
  misc_feature (398)..(398): n is a, c, g, or t
  modified_base (460)..(460): a, c, t, g, unknown or other
  misc_feature (460)..(460): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcgtggtttcgtgtagctatttaaagtgtcagtgtgaggtgcagttggtggagtctgggggaaccttggtccagccgtggggggtccctgagactctcctgtgtagcctctgcgttcaccgtcagtagcaattacatgagctgggtccgccgaggcctccgaggtaagggctggagtgggtctgagttattatagcgatggaaccgnacacttcgacagacncgcgagggcagtatcaccatctccagaanactaatacaacaactaccttatctacatatacgaacacgctagacgacgcgaggtactcgtntcgtactattacgtgtagagagtacgtctacgtggtcgtcgtaccgtacgcggtaggttcggtcccggtcccgggtcggg

SEQ ID NO: 232044 - DNA, 580 bp, Homo sapiens
  misc_feature: GYAE6OF01C651V.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaggtgtcagtgtgaggtgcagttggtggagtcgtgggggaaccttggtccagccgtggggggtccctgagactctcctgtgtagcctctgcgttcaccgtcagtagcaattacatgagcgtgggtcccgccacggctccgagggtaacggggctgggaggtgggtctctaagtttattagagcgatcggaaccgcacacttcgcacgactccggcggaggggcagacttcaccactctccaagacgaacaacttaccaaacgtaacctaccctttatcttacagtactagaacacgaccgtgaagacgccggaggtaccgtcggcttagtcttaattcgtgtcgcgaaggtactcacgtcgggctggtccacggtacgtagggtcggttccggacccgggtcgggg

SEQ ID NO: 232045 - DNA, 576 bp, Homo sapiens
  misc_feature: GYAE6OF01COBYR.5.27.C05.1.454.CMB.1.raw
  modified_base (304)..(304): a, c, t, g, unknown or other
  misc_feature (304)..(304): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtcgtgggggaaccttggtccagccgtggggggtccctgagactctcctgtgtagcctctgcgttcaccgtcagtagcaattacatgagctgggtcccncaggctccgaggtaagggctggagtgggtctcagtttattagtagcgatcggaaccgcacacttcgcagactccgcgaggggcagactcacagtctacagagacaacttccaaagaaccaccttatcttacagatagtaacagcctagacgaacgccgaaggtaccgtcggacgttcgtccgtaacttacgtcgtgtaccgacgtagtccaactgggtcctcggtacccgtacggacgtagggttccggtccggtaccccggtacccggggg

SEQ ID NO: 232046 - DNA, 520 bp, Homo sapiens
  misc_feature: GYAE6OF01BJOOG.5.27.C05.1.454.CMB.1.raw
  modified_base (431)..(431): a, c, t, g, unknown or other
  misc_feature (431)..(431): n is a, c, g, or t
  modified_base (441)..(441): a, c, t, g, unknown or other
  misc_feature (441)..(441): n is a, c, g, or t
  modified_base (496)..(496): a, c, t, g, unknown or other
  misc_feature (496)..(496): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagcctggggggtccctgagactctcctgtgtagcctctgcgttcaccgtcagtagcaattacatgagctgggtccgccaggctccgagggtaaggggctggagtgggtctcagttatttatagcgatggaaccgcacacttcgcagactccgcgaggggcagattcacatctcagagacaattccaagaaccacctttatccttanagatcgaacngcctagagagccgagactcgctgtactatactgtgcgagagtcagtggctggccngcagggttcgtccgcccgtcgggg

SEQ ID NO: 232047 - DNA, 519 bp, Homo sapiens
  misc_feature: GYAE6OF01A2FDL.5.27.C05.1.454.CMB.1.raw
  modified_base (480)..(480): a, c, t, g, unknown or other
  misc_feature (480)..(480): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagcctggggggtccctgagactctcctgtgtagcctctgcgttcaccgtcagtagcaattacatgagctgggtccgccaggctccgaggtaaggggctggagtgggtctcagttattatagcgatggaaccgcacacttcgcagactccgcgaggggcagattcaccatctcagagacaattccaagaacctaccctttatcttcagatgaacagcctgagagccgagactcggctgtctattacgtgtgcgagngtcacgtggctggtccagcaggtcgtccgcccgtcgggg

SEQ ID NO: 232048 - DNA, 623 bp, Homo sapiens
  misc_feature: GYAE6OF01CY2A9.5.27.C05.1.454.CMB.1.raw
  modified_base (435)..(435): a, c, t, g, unknown or other
  misc_feature (435)..(435): n is a, c, g, or t
  modified_base (453)..(453): a, c, t, g, unknown or other
  misc_feature (453)..(453): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcttgggttttccttgttgcttaattttaaaaggtgtccagtgtgaggtgcagttggtggagtcgtgggggaccttggtccaggccgtgggggtccctgagactctcctgtgtacgcctcgtgtccgttccaccgttcaaggtacgactaaattacagtaggacgtccgtcggggtccccgccgacggtcctaccgaaggggtaacgggggcgtggggtaggtcgggtctcgtaaggtttatttagacgcgtagtacggaaccgcactacttcgcacgaccgtccggnggacgggcagtactcacntcctcagacgaacaactacaacgaacctaccttactcttacagatacgaacacgctagacgagaccgacgtacgcgtctcgtctacgttacgtcgtcgcgagtacgtcgagtccccccgtgtccggtcgtacgacggtacgggtcggttcccggtcccgggtacccgggg

SEQ ID NO: 232049 - DNA, 730 bp, Homo sapiens
  misc_feature: GYAE6OF01DJLUP.5.27.C05.1.454.CMB.1.raw
  modified_base (374)..(374): a, c, t, g, unknown or other
  misc_feature (374)..(374): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcttgggttttccttgttgctattttaaaaggtgtccagtgtgaggtgcagttggtggagtcgtggggaaccttggtccaggccgtgggggtccctgagtacctctccgtgtcgtacgcctcgtgtccgttccaccgtcagtagactaaattacagtgagccgtgggtcccgccacggtcctccgagggtaacggggctgggtaggttgggtctcgtagtttattanagcgagtacggaaccgcactactcgacacgacctcggacggacgggcaacgtacttaccgaacctactcctaccgaagaacgtaacctaaacttacccaaacgtaaccccttaacccgtttactccttaccgaagtaactacggaaacacgtacccaggaacgaccggacccggtaaggtaccgtccgggtacttacggttacctttaaacgttacggttcggtacggtaccggttaaaggtaaccgttacgtaacgggttaccgggtaccggttcgggtaaccccgtaagggtacccggttacggggtttacccggggtttacccccggggtacccccggggttacccggggggg

SEQ ID NO: 232050 - DNA, 696 bp, Homo sapiens
  misc_feature: GYAE6OF01DCBQC.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtcgtgggggaaccttggtccagccgtgggggtccctgagactctcctgtgtacgcctctgcgttcaccgtcagtagctaattacatgagcgtcgggtcccgaccgaggcctccgaaggggtaacggggcgtgggaggtggggtactacgtaagtttattagtagcgagtcggaaccgcaactacgttcgacacgaccgtccgcggagggcaagtacttacaccatcctaccgaagaacgaactaacttaccaaacgtaacctaccctttataccttacgaagtactacgaaacacgacctaggaacggacgacccggaagggtaccgtccgggtacttacggttaccttaagtttaccgtggttaccggaccggtaaggtaaccggttaccgaaccggttcggggtacccgttacgggtacccgtaaggggtacccggttaggggtttacccgggttaccccgggtacccccgggttaacccgggggggg

SEQ ID NO: 232051 - DNA, 540 bp, Homo sapiens
  misc_feature: GYAE6OF01AF7TU.5.27.C05.1.454.CMB.1.raw
  modified_base (438)..(438): a, c, t, g, unknown or other
  misc_feature (438)..(438): n is a, c, g, or t
tcagatcagacacgcacgaccggtgctcgatttagacgcgatcgaagggtttgggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagcctggggggtccctgagactctcctgtgtagcctctgcgttcaccgtcagtagcaattacatgagctgggtccgccaggctccgaggtaaggggctgggagtgggtctcgagttatttatagcgtatggaaccgcacacttcgcagactcgcgagggcagattcaccatcctccagagacaattccaagaacctaccctttatcttacanatacgaacagcctgagacgccggaggacctcggctgtactattctgtgcgagcgtcacgtggctggcctaggcgtagggttcggtccggccccggtcggggg

SEQ ID NO: 232052 - DNA, 654 bp, Homo sapiens
  misc_feature: GYAE6OF01AKWSC.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtcgtgggggaaccttggtccagccgtggggggtccctgagactctcctgtgtagcctctgcgttcaccgtcagtagcaattacatgagcgtgggtcccgcaggcctccgagggtaaggggctggagtgggtctcgagtttattatagcgagtcggaaccgcacacttcggcacgaccgtccggcggacggggcaggacttccacctatcctccagacgacaacttccaaagtaacctaaccctttatccttacaacgtatacgaaacacgtaccctaggaacggaacggtacccggaacgggtaaccgttccggtcttacggttaccttaacgttaccgtggtacgtaccggtaacggtacggttacctaaccggttggtacccgttcggtacccgtacggtccgtaaggggtttcccggttcccggtacccccgggttaccgggggg

SEQ ID NO: 232053 - DNA, 518 bp, Homo sapiens
  misc_feature: GYAE6OF01ALUDG.5.27.C05.1.454.CMB.1.raw
  modified_base (301)..(301): a, c, t, g, unknown or other
  misc_feature (301)..(301): n is a, c, g, or t
  modified_base (389)..(389): a, c, t, g, unknown or other
  misc_feature (389)..(389): n is a, c, g, or t
  modified_base (470)..(470): a, c, t, g, unknown or other
  misc_feature (470)..(470): n is a, c, g, or t
  modified_base (474)..(474): a, c, t, g, unknown or other
  misc_feature (474)..(474): n is a, c, g, or t
  modified_base (478)..(478): a, c, t, g, unknown or other
  misc_feature (478)..(478): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagcctggggggtccctgagactctcctgtgtagcctctgcgttcaccgtcagtagcaattacatgagctgggtccncaggctccaggtaaggggctggagtgggtctcgagttattatagcgatggaaccgcacacttcgcagactcgcgagggcagattcacntctccagagacaattccaagaacctacctttatcttcagatcgaacagcctagaacgagccgaggctcggctgtctattcngtgngagngtcatggacctggtccagcagggtcgtccgacccggtggg

SEQ ID NO: 232054 - DNA, 538 bp, Homo sapiens
  misc_feature: GYAE6OF01D0UIK.5.27.C05.1.454.CMB.1.raw
  modified_base (464)..(464): a, c, t, g, unknown or other
  misc_feature (464)..(464): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctatttaaaggtgtccagtgtgaggtgcagttggtggagtcgtgggggaaccttggtccagccgtggggggtccctgagactctcctgtgtagcctctgcgttcaccgtcagtagcaattacatgagctgggtccgccaggctccagggtaaggggctgggagtgggtctcagttatttatagcgatggaaccgcacacttcgcagactccgcgaggggcagattcaccatctccagagacaattccaagaacctaccctttatcttcagatagaacagcctagagagccgaggtaccncggctgtcttattactgtgcgagtcgtcacgtggctggtccaggtcgagggttcggttcccgccccgtcggggg

SEQ ID NO: 232055 - DNA, 552 bp, Homo sapiens
  misc_feature: GYAE6OF01DK4QV.5.27.C05.1.454.CMB.1.raw
  modified_base (387)..(387): a, c, t, g, unknown or other
  misc_feature (387)..(387): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtcgtgggggaaccttggtccagccgtggggggtccctgagactctcctgtgtagcctctgcgttcaccgtcagtagcaattacatgagctgggtccgccaggctccgagggtaagggctgggagtgggtctcagttattatagcgatggaaccgcacacttcgcagctccgcgagggcagnttcacatcctccagacgacaattccaaagtaacctaccctttatcttcagatagaacacgcctaggaacgagacccggaggtactcggcttgtcttattactgcgcgagtacgtcacgttcggcttcggtccaggctagggttcggttcccgccccggtcggggg

SEQ ID NO: 232056 - DNA, 626 bp, Homo sapiens
  misc_feature: GYAE6OF01ECUCT.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttcctgttgctattttaaaaggtgtccagtgtgaggtgcagttggtggagtcgtgggggaaccttggtccagccgtgggggtccctgagactctcctgtgtagcctctgcgttcaccgtcagtagcaattacatgagcgtcgggtcccgcgaggcctccgagggtaacggggcgtggaggtgggtctcgtagtttatttagagcgagtacggaaccgcacctacgttcgacacgtaccgtccggacggaggggcaagtacttaccaacctactccgtaccaagaacgaacctaaacgttacccaaacgtaacccttaaccctttatacccttacaagtactacgaaactcgtaccgtagacggacgaccggacggtaccgtcggtcttcgtacttagttcgtgtcgacgtagtacgtcacggtcggcgttcggaccgtagtacgtagggttcggtcccgcccggtacgggg

SEQ ID NO: 232057 - DNA, 670 bp, Homo sapiens
  misc_feature: GYAE6OF01BX31A.5.27.C05.1.454.CMB.1.raw
  modified_base (389)..(389): a, c, t, g, unknown or other
  misc_feature (389)..(389): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcgtggtttcgtgtagctatttaaagtgtccagtgtgaggtgcagttggtggagtctgggggaaccttggtccagccgtgggggtccctgagactctcctgtgtagcctctgcgttcaccgtcagtagactaattacatgagctcgggtccgccaggctccgaggtaaggggctaggaggtgggtctcgtagtttatttagagcgatcggaaccgcaacctacttcgacagaccgtcccggnggaggggcctaaggtcttacacctagtcctacccaagacgaactaaacttaaccaaacgtaaacccttacccgttttactactttaccaagtacttaacgaaacacgaccgtagaacgacggacccggtaacgggaccgtacggtccgttaggttacttaaacgttaccgtggtacggtaaccggtaggtaccgttacgacggttcgggtaccgttcgggtacccggtagtacgggtaaccgggtttccgggttaccccggtaccccggggtacccggggg

SEQ ID NO: 232058 - DNA, 599 bp, Homo sapiens
  misc_feature: GYAE6OF01DVTYC.5.27.C05.1.454.CMB.1.raw
  modified_base (263)..(263): a, c, t, g, unknown or other
  misc_feature (263)..(263): n is a, c, g, or t
  modified_base (302)..(302): a, c, t, g, unknown or other
  misc_feature (302)..(302): n is a, c, g, or t
  modified_base (334)..(334): a, c, t, g, unknown or other
  misc_feature (334)..(334): n is a, c, g, or t
  modified_base (343)..(343): a, c, t, g, unknown or other
  misc_feature (343)..(343): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctatttaaaggtgtccagtgtgaggtgcaggttggtggagtcgtgggggaaccttggtccaggccgtgggggtccctgagactctcctgtgtagcctntgcgttcaccgtcagtagcaattacatgagctgggtccnccaggctccgaggtagggctggagtgggtctnagttattangcgatggaaccgcacacttcgcagacctccgcggaggggcagtacttcaccagtcctaccaagacgaacctaaatttccaaaagtaacctacccctttaatcctttacgaagtatacgaacagccctaggaacgtacgaccggaggaccgtcggcttcgtacgttagttaaccgtggtcgacggacgtacggtccacggttggaccttgggtacccaggtacgtagggttcgggttcccgccccgggtaccggggg

SEQ ID NO: 232059 - DNA, 701 bp, Homo sapiens
  misc_feature: GYAE6OF01A716C.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtcgtgggggaaccttggtccagccgtgggggtccctgagactctcctgtgtagcctctgcgttcaccgtcagtagcaattacatgagtctgggtccgcaggctccgaggtacggggctggagtgggtctctagttatttatagcgagtcggaaccgcacacttcgcacggactccggcggagggggcagtacgttccaacctactccgtacccgaaggtaacgaacctaaactttacccgaaagtaaaccctaaccccttttaactaccttacgaacgtaagtacgaaaccgacgtacccgtaggaacggacggaccccgggaagggtaccgttaccggggtcttacgggttaccttaagtttaccgtggttacggaccggttaaggtaccgttacctaaccggttcggggtaccgttaccggggttccccgtaagggttacccgtaacgggggtttccggtttaccccgggaaccccccgggttacccgggggg

SEQ ID NO: 232060 - DNA, 632 bp, Homo sapiens
  misc_feature: GYAE6OF01E1H55.5.27.C05.1.454.CMB.1.raw
  modified_base (256)..(256): a, c, t, g, unknown or other
  misc_feature (256)..(256): n is a, c, g, or t
  modified_base (374)..(374): a, c, t, g, unknown or other
  misc_feature (374)..(374): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcgtggtttcgtgtgctatttaaagtgtcagtgtgaggtgcagttggtggagtcgtgggggaaccttggtccagccgtgggggtccctggagctctcctgtgtagcctntgcgttcaccgtcagtagctaattacatgagtcgtggggtcccgccaggtcctaccgagggtaacggggctgggtaggtgggtctcgtaagtttatttacgagcgtagtacggaaccncactactcggctagacctcggacgggagggcaggtacttccacctatcctaccaaggtacaactaaacttccaaaacgtacctacccttttatccttacaagtatacgaaactacggtcctaggacgaacgccgaagggtacccttcggattcgtacttagtacgtgtaggaccgtagtaccgtacgtaccgtggccggttacggaccctaggtcccgttaaggggtttccgggtaacccgtccccgggtaacggggg

SEQ ID NO: 232061 - DNA, 587 bp, Homo sapiens
  misc_feature: GYAE6OF01CYBCW.5.27.C05.1.454.CMB.1.raw
  modified_base (307)..(307): a, c, t, g, unknown or other
  misc_feature (307)..(307): n is a, c, g, or t
  modified_base (349)..(349): a, c, t, g, unknown or other
  misc_feature (349)..(349): n is a, c, g, or t
  modified_base (362)..(362): a, c, t, g, unknown or other
  misc_feature (362)..(362): n is a, c, g, or t
  modified_base (460)..(460): a, c, t, g, unknown or other
  misc_feature (460)..(460): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtcgtgggggaaccttggtccagccgtgggggtccctgagactctcctgtgtagcctctgcgttcacgtcagtagctaattacatgagcgtcggtccgccgnggctccgagggtaaggggctgggagtgggtctcagttattanagcgatggaaccncacacttcgacgagacctcgcggagggcagtacttacgacactctaccagaagaactaacttaccgaaagtaaccctaccctttagccttacaagtanacgtaacagtcctaggacgacgaccggaggcctcggctagtacttaatacgtgtcgacgtagtacgtctacgtgggaccgttcggaccgtagtcgtagggttcggtcccggccccgggtaccggggg

SEQ ID NO: 232062 - DNA, 680 bp, Homo sapiens
  misc_feature: GYAE6OF01DL2AK.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgcttattttaaaaggtgtccagtgtgaggtgcagttggtggagtcgtgggggaaccttggtccagccgtgggggtccctgagactctcctgtgtacgcctctgtcgttcaccgtcagtagctaattacatgagcgtcgggtccgcgaggtcctccggagggtaacggggctgggtaggttgggtctacgtagtttattagagtcgagtacggaaccgcacgtacttcgacacgaccgtccggcggtacggggcacgtacttaccaacctactacccgtaccgaaggtaacgtaaacctaaactttaacccgaaaacgtaacccttaacccttttagtaccctttacgaagtaacgtaacgaaccgtacgtacccgtaggaacggacggtacccggagggtaccgtcgggtcttacgttaccttaatttaccgtggacggtacgtagtacgtacgtacggtcggtcgtcggtacccgacggtacgtacgggttccggtcccggacccgggtccgggg

SEQ ID NO: 232063 - DNA, 686 bp, Homo sapiens
  misc_feature: GYAE6OF01AEGAV.5.27.C05.1.454.CMB.1.raw
tcagatcagacacgcacgaccggtgctcgatttagacgcgatcgaagggtttgggggctgggagaggagcccagcactgggattccgaggtgtttccattcagtgatctgcactgaacacagaggactcgccatggagtttgggctgagctgggttttcctgttgctattttaaaaggtgtccagtgtgaggtgcagttggtggagtcgtgggggaaccttgggtccaggccgtggggggtccctggacgactctcctgtgtacgcctctgcgttccaccgtcagtagactaacttacatgagtccgtcgggtcccgccgaggcctaccgagggtaacggggcgtagggaggtcgggtctacgtagttatttagagcgagtacggaaccgcactacgttcgacacgacctccggacggagggacagtacttccaacctctccaccagacgactaaacgttaccaaacgtaaccttaaccctttatcctttacgaatacgtacgaaacacgtacccgtaggaacggaccggaccggtaacggtacccggttccggtcttacggttaccttaacgttacggcgtacggacgtacggtacgttaccgtacggttgggacccttccgggtacccacgggtacggttaccggggtttaccggggtcccccgtaccccggggtaccgggggg

SEQ ID NO: 232064 - DNA, 610 bp, Homo sapiens
  misc_feature: GYAE6OF01DOST1.5.27.C05.1.454.CMB.1.raw
  modified_base (309)..(309): a, c, t, g, unknown or other
  misc_feature (309)..(309): n is a, c, g, or t
  modified_base (497)..(497): a, c, t, g, unknown or other
  misc_feature (497)..(497): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgcttattttaaaaggtgtccagtgtgaggtgcagttggtggagtcgtggggaaccttggtccagccgtgggggtccctgagactctccgtgtgtacgtcctcgtgtcgttcaccgtcagtagactaattacatgagcgtggtccnccgaggctccgagggtaacgggctaggagtgggtctgagtttattagtagcgagtcggaaccgcaacgtcttcgacaggacctcggacggaggggcaagactttccaacctacttcctccgtaagacgtaaacctaacttacccaaaagtaaccctacccgttttatcctttaccaagtactagaacngtcctgaacgacgccgaaggcctacggcttaggtcctaatttccgtgtcgagacgtaacgtcacggtgcgtggtacccgagtcggaggttccgggttccgcccgggtacgggg

SEQ ID NO: 232065 - DNA, 691 bp, Homo sapiens
  misc_feature: GYAE6OF01E26LH.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtcgtgggggaaccttggtccagccgtgggggtccctgagactctcctgtgtagcctctgtcgttcaccgtcagtagctaattacatgagcgtcgggtcccgccaggctccgagggtaaggggcgtggaggtgggtctcgtagtttatttagagcgagtacggaaccgcacgtacttcgcgacgaccgtccggacggtaggggcaaggtacttaccaccctacttcccgtaccaaggaacgaacctaaacttaaccccgaaaagtacccttaacccttttatccttacgagtactacgaaacctacgaccgtaggaacggaacgcccgggaacggtaccgttccgggtaccgttacgttacttaacgtttaccggtggttacggaccgaagggtaccgttaccgacggttcgggccttacggggaccctaaggggtaccgtaacgggggtttcccggttaccccgggcccccggggttaccggggg

SEQ ID NO: 232066 - DNA, 575 bp, Homo sapiens
  misc_feature: GYAE6OF01BQG54.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagccgtggggggtccctgagactctcctgtgtagcctctgtcgttcaccgtcagtagcaattacatgagcgtgggtcccgccagggctccgaggtaaggggctggagtgggtctcgagttattataggcgatggaaccgcactacttcgcagactccggcgaggggcagtattcacatctccaagacacaattaccaagaactaccctttatccttcaagatagaacagcccgtagaacggacgaccggacgggacgtccgggcttcgtacttagttacgttgtcggacggagagttcacggtggcgtcggtccgtacggcgtaggtcggttccgaccccggtacggggg

SEQ ID NO: 232067 - DNA, 677 bp, Homo sapiens
  misc_feature: GYAE6OF01B5SKA.5.27.C05.1.454.CMB.1.raw
  modified_base (306)..(306): a, c, t, g, unknown or other
  misc_feature (306)..(306): n is a, c, g, or t
  modified_base (369)..(369): a, c, t, g, unknown or other
  misc_feature (369)..(369): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcttgggttttccttgttgcttaattttaaaaggtgtccagtgtgaggtgcagttggtggagtcgtgggggaccttggtccagccgtgggggtccctgagctctcctgtgtagcctctgcgttcaccgtcagtagcaattacatgagcgtggtccacgnggctcgagggtaaggggctggaggtgggtctcgtagtttattagtagcgtagtacggaacccncaccacgttcgacacgaccgtccggacggacggggcagtacttccacctattccctaccgaagaacgtaacctaaacttacccgaaacgtaaccctaaccctttaatccctttacgaagtaactagaaacctacgacccgtaggaacggacggaacccgggacggtacccgtcgggtaccttcgttaccgttaactttacgtggtacggacggtaaggtcgttacccgacggttcgggaccgttccgggtacccgagggtaccgttacggggttccgggttccccgggaacccccggggtccgggggg

SEQ ID NO: 232068 - DNA, 654 bp, Homo sapiens
  misc_feature: GYAE6OF01BIU7C.5.27.C05.1.454.CMB.1.raw
  modified_base (546)..(546): a, c, t, g, unknown or other
  misc_feature (546)..(546): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtcgtgggggaaccttggtccagccgtgggggtccctgacgactctcctgtgtacgcctctgcgttcaccgtcagtacgctaattacatgagcgtcgggtccgccaggcctccgagggtaaggggctgggaggtgggtctcgtagtttattagtaggcgagtacggaaccgcacacttcgacacgtaccgtccggacggagggcagtacttaccacctatcctacgaagacgaactaacttacccgaaagtaacccttacctttactccttacagtactacgaacacgccgtaggaacgacgaccggaggaccgttcggcgttacgttacgttagttacgnggtacggacgtaggtacgttcgaacggttcgggtaccgttccgggacccgtacgggtaccggttaacggggtttcccgggttacccccggtaccccggggtccggggg

SEQ ID NO: 232069 - DNA, 560 bp, Homo sapiens
  misc_feature: GYAE6OF01A63DT.5.27.C05.1.454.CMB.1.raw
  modified_base (464)..(464): a, c, t, g, unknown or other
  misc_feature (464)..(464): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagccgtggggggtccctgagactctcctgtgtagcctctgcgttcaccgtcagtagcaattacatgagcgtgggtccgccaggctccgaggtaaggggctggagtgggtctcgagtttattatagcgatcggaaccgcacacttcgcagacctccggcggaggggcagtacttccaccatcctaccagacgactaacttaccaaagtaacctaccctttatccttacagtactagaacncgacctagaacgacgccgacggtacgtcggctgtactattcgtgtcgcgagtcgtacacgtggcgtggtccagcgtaggtcgtccgcccgtcgggg

SEQ ID NO: 232070 - DNA, 616 bp, Homo sapiens
  misc_feature: GYAE6OF01BRZM8.5.27.C05.1.454.CMB.1.raw
  modified_base (446)..(446): a, c, t, g, unknown or other
  misc_feature (446)..(446): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttcctgttgctatttaaaggtgtcagtgtgaggtgcagttggtggagtctgggggaaccttggtccagccgtggggggtccctgagactctcctgtgtagcctctgcgttcaccgtcagtagctaattacatgagcgtgggtcccgccgaggcctccgagggtaggggcgtgggagtgggtctcgtagtttatttagtagcgagtcggaaccgcacacttcgcagacctcggcggagggcagactcacactctcagacgactaataccaagaacctaccctttatccttanagtatagaacagcctaggacgacggaccggacggtaccgtacgggtcctaggttaccttagtttaccgttggtaccgtagggagtacgttcccgagttcgggtccgttcgggacccgtacggccgggttaacgggttcgggttccccgggtaccccgggtacccgggggg

SEQ ID NO: 232071 - DNA, 569 bp, Homo sapiens
  misc_feature: GYAE6OF01BJWXP.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagccgtggggggtccctgagactctcctgtgtagcctctgcgttcaccgtcagtagcaattacatgagctgggtccgcaggctccgaggtaggggctggagtgggtctcagttatttatagcgatggaaccgcacacttcgcagacctccgcggaggggcaggacttcacctatcctaccagacgacaacttaccaaagtaacctaccctttatccttacagatagaacagccctaggacgacgaccggaggtaccgtcggcttgttactaagttactggtcgacgaggtacgtacacgtgggctcggtccagcgagggttcggttcccggccccggtcggggg

SEQ ID NO: 232072 - DNA, 749 bp, Homo sapiens
  misc_feature: GYAE6OF01CYL68.5.27.C05.1.454.CMB.1.raw
  modified_base (256)..(256): a, c, t, g, unknown or other
  misc_feature (256)..(256): n is a, c, g, or t
  modified_base (270)..(270): a, c, t, g, unknown or other
  misc_feature (270)..(270): n is a, c, g, or t
  modified_base (384)..(384): a, c, t, g, unknown or other
  misc_feature (384)..(384): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcgtggtttcgtgtagctatttaaagtgtcagtgtgagtgctgttggtggagtcgtggggaaccttggccaggtccgtgggggtccctgacgtactctctgtgtagctntcgcgttcaccgtnagtagactaattacagtgagcgtggggtcccacgaggtctccgaagggttaacggggctagggtacgtcgggtactgaaggtttattaagtaagcggtaattcgggaaaccccncgtaactaccgtacgaccgtaccgtaccgtccgggacggtacgggactaagtacctacctaaccgtactaccgtacgtaacgtaacgtaaacctaaacgtaaccgaaacgtaaccctttaacccttagttaccttaacgtaacgtaacgtaacgtaaccgtacgtaccgtaacggaacggtaccggtaccgggtaacgggtaccgtaccgggttacttaccgttacgttaaccgttacggttaggtaccggtaacggtaaggtaccggttacggtaccggtacggtacccgtacgggtacggtaacggttaccggggttaccgggttaaccccggggttcccgggtaacccccgggggtacgggg

SEQ ID NO: 232073 - DNA, 627 bp, Homo sapiens
  misc_feature: GYAE6OF01EPLK9.5.27.C05.1.454.CMB.1.raw
  modified_base (488)..(488): a, c, t, g, unknown or other
  misc_feature (488)..(488): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaggtgtccagtgtgaggtgcagttggtggagtcgtgggggaaccttggtccagccgtgggggtccctgagactctcctgtgtagcctctgcgttcaccgtcagtagcaattacatgagctgggtccgccaggctccgagggtaggggctggaggtgggtctcagtttatttatagcgatacggaaccgcaccacttcgacaggacctccggacggaggggcagacttccaccatcctccagacgaactaacttaccaaagaaccctaccctttatacctttaccaagtactacgaacacgcccgttggggaacncccgggaaggtaccgtcgggacttcggtacttacgttacgtggtacggccgaaggtagtccgagttcgggccgttcggggacccaacgggtcgtaacggggttcgggtttaccccggccccgggtgggggtacccccgg

SEQ ID NO: 232074 - DNA, 720 bp, Homo sapiens
  misc_feature: GYAE6OF01COCG4.5.27.C05.1.454.CMB.1.raw
  modified_base (349)..(349): a, c, t, g, unknown or other
  misc_feature (349)..(349): n is a, c, g, or t
  modified_base (637)..(637): a, c, t, g, unknown or other
  misc_feature (637)..(637): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagtcgttgggttttccttgttgcttaagttttaaaaggtgtcctagtgtgaggtgctaggttggtggagtcggtacgggggtaaccttggtccgaggtccggtcggggggtcccctggacgtaccttcctccgttggtcgtacgtcctcgtgtccgttccaccgtcgaagttagactaattacagtgacgtcgtcgggtcccncgacggtctacggtaagggtagggcgtgggtaggtcggttctacgttaagtttagttaagtaggcgtacgtacggaaccgactaccgtaccgttacgacgtacgtaaccgtccggacggagggactaagtaccttaccaaccgtactcccgtaacgaagaaccgtaaacttaaacctaaccgaaacgtaaacccttcccttttaacgtaccttaacgaagtactacgaaacgtctacgaaggaacgacgtaccggaacggtcttccggattacgttacttaacgttgnggtacgacgtagtacgtctaccggtgtccgtacggtacctcggtacggttacgggttcccgtccccggtaccgggtaccgggg

SEQ ID NO: 232075 - DNA, 644 bp, Homo sapiens
  misc_feature: GYAE6OF01CZTJR.5.27.C05.1.454.CMB.1.raw
  modified_base (356)..(356): a, c, t, g, unknown or other
  misc_feature (356)..(356): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagccgtggggggtccctgagactctcctgtgtagcctctgcgttcaccgtcagtagcaattacatgagcgtggtccgcaggctccgagggtagggctggagtggtctctagttattatagcgagtggaccncacacttcgcacgacctccggacggacggggcagtacttccgacctactcctaccaagaacgtaacctaacttacccaaagtaaccctaacccttttatacctttacgaagtatacgaactacgaccgtaggaacgacggacccggaagggtaccgtccgggtcttcggttaccttacttaccgtaggtcggaccggtaagtacggttaccacggttcggccgttacgggtacccgacggtacgggtaacggggtttcgggttccccgggacccccgggtccgggggg

SEQ ID NO: 232076 - DNA, 656 bp, Homo sapiens
  misc_feature: GYAE6OF01EDW5I.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtcgtgggggaaccttggtccagccgtgggggtccctgagactctcctgtgtagcctctgcgttcaccgtcagtagcaattacatgagctgggtccgccaggctccgagggtaaggggctggaggtgggtctcgagttatttagtagcgatcggaaccgcgaacacttcgcaagacctccgcgaggggcagattcacatctacagagactaatccgaagaacctaccctttatcttacaagtatacgaacagccctaggaacgtaacggcccggaacgggaccgttccgggtacttcggttaccttaaagtttaacccgtgggttacggaccggtaacgggtacggttacccaaacgggtttgggacccgttacgggggtacccctaaggggtacccgttaaggggggttcccgggttttaccccgggaccccccgggttaccgggggggg

SEQ ID NO: 232077 - DNA, 819 bp, Homo sapiens
  misc_feature: GYAE6OF01D3QYB.5.27.C05.1.454.CMB.1.raw
  modified_base (180)..(180): a, c, t, g, unknown or other
  misc_feature (180)..(180): n is a, c, g, or t
  modified_base (194)..(194): a, c, t, g, unknown or other
  misc_feature (194)..(194): n is a, c, g, or t
  modified_base (314)..(314): a, c, t, g, unknown or other
  misc_feature (314)..(314): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagtcgttggtttcctgttgcttaatttaaaggtntccagtgtgaggtncagttggtggagtcgtggggaaccttggtccagtccgtgggggtaccctgacgtctctctgtgtacgcctgtcgcgttcaaccgtcagtacgactaattacagtgagtcgtcgggtcccncgaggcctaccggaggtaacggggctgggtagttcgggtcttacgtaagtttatttaacgacggcggtaagtacgggaaacccgtcaaccttacccgttaccggaccgaacggtacccgttaccccgggcggggaaacggggcctaaacggttacctttaccggaacccgttaactacccgtaacccgaaaggaaccgtaaacccttaaaccgttaaccgtaaaaacgtaaaccctttaacccccctttttagtaacccttaccgtaaaaccgtaagttaaccggaaacccgtacgtacccggttaaggaaaccgggtaaccgaacccgggtaacgggtaacccggttccgggtacgtttaccggtacctttaacgttaccggtcgtaccgaccgggtaagtaccggttaacccgcgggttccggaaccggttacccggtccggtaacgggttaccggttaccgggggttacccggtttccccggaccccgggggtacccggggg

SEQ ID NO: 232078 - DNA, 610 bp, Homo sapiens
  misc_feature: GYAE6OF01A5VQO.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagccgtggggggtccctgacgactctcctgtgtagcctctgcgttcaccgtcagtagcaattacatgagcgtcgggtccgccgaggctccgagggtaaggggctgggagtgggtctcagtttatttatagcgatacggaaccgcactacgttcgcacgactcccgcggaggggcagacttccgacctatctaccagacgaacaacttaccaaagtaaccctaaccctttatacctttaccagtatacgaaacacgcctagacgacgacccggaggccgtacggtcttagtacttacgttacgtggtacgcggaggtacgtcacggtggaccgttcggtcccgaaggtccgtagggttccggttcccggaccccgggtaccggggg

SEQ ID NO: 232079 - DNA, 709 bp, Homo sapiens
  misc_feature: GYAE6OF01DQTL9.5.27.C05.1.454.CMB.1.raw
  modified_base (312)..(312): a, c, t, g, unknown or other
  misc_feature (312)..(312): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcttgggttttccttgttgcttattttaaaaggtgtccagtgtgaggtgcagttggtggagtcgtgggggaaccttggtccaggccgtgggggtccctgacgactctcctgtgtacgcctctgtcgttccaccgtcagtagctaattacatgagcgtgggtcccncgaggctaccgagggtaacgggctgggaggtcgggtctctaggtttatttaagtagcgtagtacggaaccgcaacgtacttcgacaacgcccgtacccgggcggtagggggccaaggtaacttccgaacctattccctaccgaagaacgaacctaaaactttacccaaaacgtaaaccttaacccccgttttattacctttaccgaaagtacgttacgaaacacgtacccgtagaacggtacggacccggtacggtaccgtcgggtccttacggttacttacttaccggtaggttccgacggtaacgtcgttaccgtacgtcggggtaccgttcggtaacccgtacggtacggttagggtttcccgggtttccccggacccccgggttaccgggggg

SEQ ID NO: 232080 - DNA, 715 bp, Homo sapiens
  misc_feature: GYAE6OF01EJN0M.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttggctgagtcttgggttttccttgttgtcttaattttaaaaggtgtccagtgtgaggtgcgtaggttggtggagtcggtcgggggtaaccttgggtccgaggtcccggtggggggtcccctggacgtaccttccgtccgtggtcgtacgtccctcgtcgtccgttccaccgtcagtacgactaattacagtgacgtcgtcgggtcccgcgacggccgtaccgaagggtaagggcgtggacggtggtctacgtagtttatttagacggtcgtagtacggaaccgtcaacgtaccgttcgacgacgtaccgtccggacggaacggggacaaggtacgttaccacctaactacccgtaccgaagaaccaactaaactaacccgaaacgtaacccttaaccctttactacttacgagtataacgaacgacgtacctagacgacgaccggtacggtaccgttcggtacttcgtacgttaacgttacgtggtacggacgtacggtacgtacgtacgtcggtcgttacggacccgtagggtaccggtagggtttcccggtcccggtacccgggtacccggggg

SEQ ID NO: 232081 - DNA, 549 bp, Homo sapiens
  misc_feature: GYAE6OF01A3YDE.5.27.C05.1.454.CMB.1.raw
  modified_base (431)..(431): a, c, t, g, unknown or other
  misc_feature (431)..(431): n is a, c, g, or t
  modified_base (461)..(461): a, c, t, g, unknown or other
  misc_feature (461)..(461): n is a, c, g, or t
  modified_base (498)..(498): a, c, t, g, unknown or other
  misc_feature (498)..(498): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagccgtggggggtccctgagactctcctgtgtagcctctgcgttcaccgtcagtagcaattacatgagctgggtcccgccgaggctccgaggtaacggggctgggagtgggtcctcgagtttatttatagcgagtcggaaccgcaacacttcgcagactccggcgaggggcagacttcaccatcctccagacgacaacttaccaanaacctaccctttatcttacagtatagaacngcctagacgagccgaggtaccgtcggctgtctattcngtgcgagcgtcacgtggctggtaccagcgaggtcgtccggcccggtcgggg

SEQ ID NO: 232082 - DNA, 695 bp, Homo sapiens
  misc_feature: GYAE6OF01AZOIS.5.27.C05.1.454.CMB.1.raw
  modified_base (278)..(278): a, c, t, g, unknown or other
  misc_feature (278)..(278): n is a, c, g, or t
  modified_base (306)..(306): a, c, t, g, unknown or other
  misc_feature (306)..(306): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtcgtgggggaaccttggtccagccgtggggggtccctgagactctcctgtgtacgcctctgcgttcaccgtnagtagctaattacatgagctcgggtccnccgaggctccgaggtaagggctggaggtgggtctcgagttattagagcgagtcggaaccgcacacgttcgcagacctccgcggagggccagtacttaccgaccatcctaccgagtacgaactaacttaccaacgtaaacctacccttttagtaccttacgagtaactacgaactacgacccgttaggaacgtacggacccggaaggggtaccgttaccgggtacgttacgttaccgtttaactttaccggttaggtaccggtaaccgggtaaggtacggttaccgtaaccgggttcgggtaccgttcggggttaaccccgaagggttacccgggttaaggggtttcccggggtttcccccgggtaaccccccggggttacccggggggg

SEQ ID NO: 232083 - DNA, 545 bp, Homo sapiens
  misc_feature: GYAE6OF01E0KU2.5.27.C05.1.454.CMB.1.raw
tcagatcagacacgcacgaccggtgctcgatttagacgcgatcgaagggtttgggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagcctggggggtccctgagactctcctgtgtagcctctgcgttcaccgtcagtagcaattacatgagctgggtccgccaggcctccgagggtaagggggctgggagtggggtctcgagtttattatagcgatggaaccgcacacttcgcagactccgcggagggcagattcaccatcctccagagactaattaccaagaacctaccctttatcttacagtatagaacacgcctgagacggccgaggactcggctgtactatactgtgcgagtgtcacgtggctgggtcccagcgagggtcggttccggcccgtcggggg

SEQ ID NO: 232084 - DNA, 587 bp, Homo sapiens
  misc_feature: GYAE6OF01EB8MO.5.27.C05.1.454.CMB.1.raw
  modified_base (342)..(342): a, c, t, g, unknown or other
  misc_feature (342)..(342): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttcctgttgctattttaaaaggtgtccagtgtgaggtgcagttggtggagtcgtgggggaaccttggtccagccgtggggggtccctgagactctcctgtgtagcctctgcgttcaccgtcagtagcaattacatgagctgggtccgcaggctcgagggtagggctggagtggtctcagttatttanagcgatggaaccgcacacttcgcagacctccgcgaggggccagtacttcaccatcctccagaacgactaaacttcccaaagaacctaaccccgttttatcctttacagtactagaacagccctagaacgacgacccggaggacctcggtctcgtactattacgtgtcgacggagtcgtacacggttcgggccttacggtcccgacggtccggtagggttcgggttcccggccccggtaccggggg

SEQ ID NO: 232085 - DNA, 702 bp, Homo sapiens
  misc_feature: GYAE6OF01B8MH8.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcttgggttttccttgttgcttaattttaaaaggtgtccagtgtgaggtgcagttggtggagtcgtgggggaaccttggtccagccgtggggggtccctgacgactctcctgtgtacgcctcgtgtccgttcaccgtcagtagactaattacatgacgcgtcgggtcccgccgaggcctaccggaagggtaaggggctagggaggtcgggtctcgtagtttattagtagacgtagtacggaaccgctaactacgttcgacgacgaccgtccggacgggacggggactaacgtacttaccgaacctacttccgtaccgaagtaacgaacctaaacgttaaccaaaccgtaaacccgtttaccctttaatccttaagaacgtactacgaaacctacgacctaggaaccgacggaccggaacggtccgtcggtacttacgttacttaacgttcggtgtacggacggtaacggtacgtaccgacggttcggtaccgttacgggtaccgtacggtaccggtagggtttcccggtacccgggtaccccgggtaaccggggg

SEQ ID NO: 232086 - DNA, 833 bp, Homo sapiens
  misc_feature: GYAE6OF01BADNP.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagtcgttgggttttccttgttgtcttaattttaaaaggtgtccagtgtgaggtgctagttggtggaggtcgtgggggaaccttggtccaggtccggtcgggggtccctggacgtcctccgtcctgtgtacgcctcgtcgccgttccaccgtcagtagctaattacagtgacgcgtcgggtccgccgaggcctacgagggtacgggcgtagggtggtacgggtctacgtagtttaacgtttagtacggtacggtaacggtacggaacccggacctaacccgtaacggtttaccgacccggtaaaccgggtacccgttaccccggggacggggtaaaccggggggcccgtaaaacggtacccgtttacccgaaacccgtaaccgttacccgtaaacccgtaacggaaacgtaaacccgtaaaccctttaaacccgaaaaccgttaaacccctttaaccccgttttaacttaccgtttaaccggaacgtaaccgttaacgaaaccgttacgaccgttaacggaacggtaccggacccggtaacgggtaccgtaccggttcgttacgtaccgttaacgttaccgtggtaccgagggtaccggtacgtacgtaccggttacgggcgttaccgggtaccgacggtaccgggtagggtttccccgggtacccgggtccccgggtaacccggggg

SEQ ID NO: 232087 - DNA, 581 bp, Homo sapiens
  misc_feature: GYAE6OF01BGKB0.5.27.C05.1.454.CMB.1.raw
  modified_base (440)..(440): a, c, t, g, unknown or other
  misc_feature (440)..(440): n is a, c, g, or t
  modified_base (456)..(456): a, c, t, g, unknown or other
  misc_feature (456)..(456): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagcctggggggtccctgagactctcctgtgtagcctctgcgttcaccgtcagtagcaattacatgagctgggtccgcaggctccgaggtaaggggctggagtgggtctcgtagttatttatagcgtagtggaaccgcacacttcgcacgactccgcgacggggcagacttacaccatctaccgagacgacaattaccaaagaacctaccctttancttacagtactgaacngcctagacgacgccgaggacctcggctgtactagttactgtcggacgtaggtacgtcgtacgtgggacttagggtccctagggccgttaggggttcccgggttcccgggccccggtaccgggggg

SEQ ID NO: 232088 - DNA, 709 bp, Homo sapiens
  misc_feature: GYAE6OF01BU7Y9.5.27.C05.1.454.CMB.1.raw
  modified_base (596)..(596): a, c, t, g, unknown or other
  misc_feature (596)..(596): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcttgggttttccttgttgcttattttaaaaggtgtccagtgtgaggtgcaggttggtggagtcgtgggggaaccttggtccaggccgtggggggtccctgagactctcctgtgtagcctctgcgttcaccgtcagtagactaattacagtagacgtcgtcgggtcccgccgacggccgtaccggagggtaacgggcgtagggtaggtcggtctacgtagtttatttagtagcgtacgtacggaacccgcaactaccgttcgacgaacgtacccgtccggacgggacgggacaacgtacttacccaacctacgttcccgtaccgaacggtaacgaaactaaaccttaacccgaaaacgtaacccttaaccccttttaatcccttaacgaacgtaactaacgaaacgtacgtaccgtaggaacggacggacccggacgggtacctcggtnttacgttacttacgttacgtgtcggaacgtagtacgttaccgacggttcggccgttacggtaccgagggtccgtagggttcccgggttaaccccggccccggggtaccggggg

SEQ ID NO: 232089 - DNA, 551 bp, Homo sapiens
  misc_feature: GYAE6OF01EY59N.5.27.C05.1.454.CMB.1.raw
  modified_base (449)..(449): a, c, t, g, unknown or other
  misc_feature (449)..(449): n is a, c, g, or t
tcagatcagacacgcacgaccggtgctcgatttagacgcgatcgaagggtttggggctgggagaggagccccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagcctggggggtccctgagactctcctgtgtagcctctgcgttcaccgtcagtagcaattacatgagctgggtccgccaggctccgagggtaaggggctggagtgggtctcgtagttatttagagcgatggaaccgcacacttcgcagacctcgcggagggcagattcaccatctccagagactaattccaagtaacctaccctttatcttacagtatgaacngcctgagacgccggagacgtcggctgtactagtcgtgtgcgtagacgtcacgtggccgtggtaccgaggccgtagggttcggttcccgaccccggtcggggg

SEQ ID NO: 232090 - DNA, 788 bp, Homo sapiens
  misc_feature: GYAE6OF01DNI9Y.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgcttaattttaaaaggtgtccagtgtgaggtgcgaggttggtggagtcgtgggggaaccttggtccgaggccggttcggggggtcccctggacgtacctcgtccgtggtgtacgtcctcgtcgtccgttcaccgtcagtagactaattacagtgagcgtagggtcccgcgaggcctaccggaagggtaaggggtcgtgggtacggtcgggtctcgtaagttttaattagacgtcggtagtaccggaaccgcaacctaccgttcgacgaacgtaccgtacccggaggacgggggtctaaacggtacttacccgaacccgtattacccgtacccgaaggtaaacgaacccttaaaattaccccgaaaaacggttaacccccttaacccttttaacgtaccctttaacgaaacggtaccttaacgggaaccctaggtaccccgtaaggagaacccgggtccccggaaagggtcccgtaccgggtacgttcggttaccgttaacgtttacgtcgggttacgaccggttaagggtaccgttacgtaccggttcgggaccgttcccggaacgtaccgggtcggtaaccggggtttcccggttccccggtaaacccccggggtcccggggg

SEQ ID NO: 232091 - DNA, 725 bp, Homo sapiens
  misc_feature: GYAE6OF01DFM9V.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagtcgttgggttttccttgttgtcttaattttaaaaggtgtccagtgtgaggtgctaggttggtggagtcgtgggggtaaccttggtccgaggtccggtcgggggtccctgagacctctcctgtgtacgtcctcgtgtccgttcaccgtcagtacgactaattacagtgacgtcgtcgggtcccgccgaacggcctaccggaagggtaacggggctagggtaggttcgggttactagtagtttaattaagtacgacgtagtacggaaccgactaacgtacgttcgacacgaccgtaccggacggacgggacaagtacgttaccaacctacgttacccaccgaaagtaaccgaaacttaaacgttaaccccgaaaaacgttaaaccctttaaccctttaatcctttaacgaaaggtaactaacgaaacgtacgtccgtaaggaacgacggacccgtagggtacctcgggtactagttaccttaagttaccgtaggtcggaacgacggtacgtacccgagttcgggactacgggaccctaggtaccggtagggttccggttaccccgcccgggtaacgggg

SEQ ID NO: 232092 - DNA, 755 bp, Homo sapiens
  misc_feature: GYAE6OF01EFMDO.5.27.C05.1.454.CMB.1.raw
  modified_base (311)..(311): a, c, t, g, unknown or other
  misc_feature (311)..(311): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgcttattttaaaaggtgtccagtgtgaggtgcaggttggtggagtcgtgggggaaccttggtccagccgtgggggtccctgagactctcctgtgtacgcctcgtcgcgttcaccgtcagtagcaattacatgagtcgtcgggtcccnccgaggctccgaggtaagggctggagtcgggtctacgtagtttattagagacgtagtacggaaccgtcaaccgtacttccgacgaacggaccgttcccggaccgggaacggggacctacggtaacgttacccaacccgtactacccgttacccgaaggaaccgtaaaccgtaaacgtttaacccaaaacggtaaacccttaaccccttttaattcccgtttaacgaaacgttaacgtaaccggtaaaacctaacggtccgtaaacggacggtaaacccggacccgggaaaccgggttacctaccggggtacttacggttaaccctttaagttacgtggtacggaacggtaagtaccgttcgaacgttcgggaccgttacgggtaccctacggtaccggttaacgggttcccgggttaccccggaaccccgggtaacccgggggg

SEQ ID NO: 232093 - DNA, 730 bp, Homo sapiens
  misc_feature: GYAE6OF01CIRV0.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaggtgtccagtgtgaggtgctagttggtggagtcgtgggggaaccttggtccaggccgtggggggtccctgagactctcctgtgtacgcctctgcgttcaccgtcagtagcaattacatgagcgtgggtccgccgaggctccgagggtaaggggctgggagtcgggtctcgtagttatttagagcgtagtcggaaccgcacgaccttcgacacggtacctccggcggtaggggcagtacttccacctatcctaccgagaagaacctaaacttacccaaacgtaaacccttacccgttttactccctttacgaacgtaacttaacggaaaccgtacggtacccgttaaggaaccgggaacccggacccgggtaacgggtacccgttaccgggtaccgtttaggttaccctttaaagtttacccgttagggtaccggtaccgggtaaggttaaccggttccctaacggttccgggtaccgttacggggtaccccgaagggttacccggttaaggggtttccccggggttcccgggtaaccccccgggttacggggggg

SEQ ID NO: 232094 - DNA, 732 bp, Homo sapiens
  misc_feature: GYAE6OF01C1FJ7.5.27.C05.1.454.CMB.1.raw
  modified_base (418)..(418): a, c, t, g, unknown or other
  misc_feature (418)..(418): n is a, c, g, or t
  modified_base (431)..(431): a, c, t, g, unknown or other
  misc_feature (431)..(431): n is a, c, g, or t
  modified_base (442)..(442): a, c, t, g, unknown or other
  misc_feature (442)..(442): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatgggagtttgggctgagtcttgggttttccttgttgtacttaagttttaaaaggtgtccagtgtgaggtgctagttgggtggagtcggtaggggtaaccttggtccgacggccggtcggggggtccctaggacgtaccgtcctccgtggtgtacgcctcgtgtccgttccaccgtcagtacgactaattacagtgacgtcgtcgggtcccgaccgacggtcctaccggagggtaacgggcgtggtaggtcggtactcgtaagtttattagagcgagttcggaaccncactacgttcganacgcgtccggnggacgggacagtacttaccacgtactccgtaccgaagacgtaactaacttaaccaaactaacccttacctttaactccttaacagtataccgaacacgaccgtaggaacgaccggtaccggtaggaccgttacgggcttaccggttacttaacgttacgtacggtacggtaaccggtaaggtacggtaccgtacggttccgggtccgtttaaccgggaccgtaaccggggtaccggttacgggggttttaaccccgggtcccccgggtaacccggggttaaccccggggg

SEQ ID NO: 232095 - DNA, 616 bp, Homo sapiens
  misc_feature: GYAE6OF01D1MB6.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccgttgttgtctattttaaaaggtgtccagtgtgaggtgcagttggtggagtcgtgggggaaccgttggtccaggccgtggggggtccctgagactctcctgtgtacgcctctgcgttcaccgtcagtagcaattacatgagctgggtccgccaggctccgagggtaaggggctggagtgggtctctagttatttagtagcgtagtcggaaccgcaacaccgttcgacagacgtccgacggaggggctaagacttcaccatcctaccagacgacaacttccaaagtaacctaccctttatacttacaagtactacgaactacgccgtaggaacggacgccgaacgggtactcggcttagtcttaacgttacgtgtcggacgaggtacgtcgtaacgttcgggaccgttcggtaccgtaggtccgtaggggttccgggttccggacccccggtacggggg

SEQ ID NO: 232096 - DNA, 990 bp, Homo sapiens
  misc_feature: GYAE6OF01CACMF.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccagtggtagtttggctggagtcgttcgggtttttccttgttgtactttaagttttaaaaggtgtccagtgtgaggtgcgtaggttggtggtagtcggtagggggtaacctttggtccacggtccggttcggggggtcccctggacgtaccttccgtccgttggtcgtacgtcctcgttcgtcgttccaccgtgtacgtacgactaattacgacgtgacggtcggttcgggtcccgaccgacggtccctaccggaaggggtaacggggcgttgggtacggttcggttactacgtaaggttttattagacggtacgtaagtacggaacccgctaaccgtaccgttcgacgtaacgtacccgtccggacgggacggggtactaacggttaccttacccgaacccgtaagttaccccgtaaccgaaacggtaaaccgtaaacccgtttaaacccgtttaaaacccgaaaaccggttaaccccctttttaaacccccgttttaacgtttaccccgtttaaaccgaaacgttaacgttaacccgggtaaaacgtacccgggttacccgttaacgggaaaccgggttaaacccgggtaacccccggggtaaacgggttaccccggttaccgggttacccgtttttaacgggttaacccctttttaaaccggttttacccggttaccggggtaaaccggggtacccgttaaaacgggttcccgggtttaaaccgtacccgggttttaccggggtacccggtttacccggggtaacccggttaaaccggggttccgggtttaaaccgggggttttcccccggggtttaaccccggggtaacccccccgggggtttaaccccgggggggg

SEQ ID NO: 232097 - DNA, 631 bp, Homo sapiens
  misc_feature: GYAE6OF01D41MG.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcttgggttttccttgttgcttaattttaaaaggtgtccagtgtgaggtgcagttggtggagtcgtgggggaaccttggtccagccgtggggggtccctgagactctcctgtgtacgcctctgcgttcaccgtcagtagctaattacatgagcgtggggtccgcgaggctccgagggtaaggggctgggagtgggtctcgtagtttatttagtagcgagtcggaaccgcaacacgttcgcagaccgtccgacggacggggcagtacttccacctatcctaccgagaacgtaactaaacttaccaaagtaaccttaccctttataccttacagtatacgaaacacgtacctaggaacgacggacccggaaggtaccgtcgggtcttacggttaccttaagttacgtggtcgacggtaggtacgtccacgtcggtcgtcggaccgtacggtccgtagggttccgggtcccgtacccgggtccgggg

SEQ ID NO: 232098 - DNA, 711 bp, Homo sapiens
  misc_feature: GYAE6OF01BQK3Y.5.27.C05.1.454.CMB.1.raw
tcagatcagacacgcacgaccggtgctcgatttagacgcgatcgaaggggtttgggggctgggagaggagcccagcactgggattccgaggtgtttccattcagtgatctgcactgaacacagaggactcgccatggagtttgggctgagcttgggttttccttgttgcttaattttaaaaggtgtccagtgtgaggtgcagttggtggagtcgtgggggaaccttggtccagccgtgggggtccctgacgactctcctgtgtagcctctgtcgttcaccgtcagtagactaattacagtgagtcgtcgggtcccgcgacggctaccgagggtaaggggctagggaggtggtctcgtagtttattatagcgacgtacggaaccgcacgtactcgacacgtacgtccggcggagggcagacttcaccatcctacgagaacgaactaactacccgaaacgtaaacccttaaccctttatacccttacgaagtactaacgaaccgtacgtacccgtaggaacgggaaccggtacccgggtaacgggtacccgtaccgggttacgttcggttaaccttaaacgtttacgttggggtaccgtaaccggtaacggtaaccgttcccggacggttccgggaccgttacccgggacctacggggaccggttaaccggggtttcccgggttacccccgggtaaccccgggtaccgggggg

SEQ ID NO: 232099 - DNA, 571 bp, Homo sapiens
  misc_feature: GYAE6OF01BVQ2J.5.27.C05.1.454.CMB.1.raw
  modified_base (524)..(524): a, c, t, g, unknown or other
  misc_feature (524)..(524): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaagtgtccagtgtgaggtgcagttggtggagtctgggggaaccttggtccagccgtggggggtccctgagactctcctgtgtagcctctgcgttcaccgtcagtagcaattacatgagctgggtccgccaggcctccagggtaaggggctgggaggtgggtctcgagttatttatagcgatggaaccgcaacacttcgcagactccgcggagggcagacttcaccatctacagagactaattaccaacgtaaccacccttttactccttacaacgtatacgaacacgtccctagaacgacggacccggaaggtaccgtcggctcgttactattacgtgtgcgtagacgtnacgtcggctggacctaggcgagggttcggtcccgcccggtacggggg

SEQ ID NO: 232100 - DNA, 562 bp, Homo sapiens
  misc_feature: GYAE6OF01BBNWS.5.27.C05.1.454.CMB.1.raw
  modified_base (277)..(277): a, c, t, g, unknown or other
  misc_feature (277)..(277): n is a, c, g, or t
tcagatcagacacgcacgaccggtgctcgatttagacgcgatcgaagggtttggggctgggagaggagcccagcactgggattccgaggtgtttccattcagtgatctgccactgaacacagaggactcgccatggagtttgggctgagctgggtttcctgttgctattttaaaaggtgtccagtgtgaggtgcagttggtggagtctgggggaaccttggtccagcccgtggggggtccctgagactctcctgtgtagcctctgcgttcacccgtnagtagcaattacatgagctgggtccgcaggctccgaggtaaggggctgggagtgggtctcgtagttatttagtagcgtatggaacccgcacacgttcgcaggacctcgcggagggcagattccacatctaccagagactaacttccaagtaaccgaccctttacgcttcagatagaactacgcctagacgacggccgaggtactcggctggtcttagttagtcgtgacgagacgtcacgtcggcctggtacccaggacctagggtcgttccgaccccggtcgggg

SEQ ID NO: 232101 - DNA, 661 bp, Homo sapiens
  misc_feature: GYAE6OF01C34OF.5.27.C05.1.454.CMB.1.raw
  modified_base (320)..(320): a, c, t, g, unknown or other
  misc_feature (320)..(320): n is a, c, g, or t
  modified_base (337)..(337): a, c, t, g, unknown or other
  misc_feature (337)..(337): n is a, c, g, or t
  modified_base (531)..(531): a, c, t, g, unknown or other
  misc_feature (531)..(531): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagtcgttgggttttccttgttgtcttaagttttaaaaggtcgtccgagtggtgaggtgcgtagttggtggagtcggtgggggtaaccgttggtccaggtccggtcgggggtccctggacgactctccgtggtcgtacgcctcgtcgccgttcgaccgtcagtagactaattacngtgagtcgtcgggtccnccgagcctcgagggtaagggcgtgggagtgggtctacgtagtttattagacggacgtagtacggttaaccactaccgtacgttcgaaccgtacggacccgtccgggagggaccggggacctaacggtactccgaactacgtcctacgaagtacgaactaacttaccgaaacgtaacccttacctttatccgtanagtacacaacgacgtcctaggacgacggccgaggtaccgtcgcttagacttagtgtgacggagacgtacgtccgtagtcggcgtacggtcgacggtcgtaggggttccggtccccgtaccgggtccgggg

SEQ ID NO: 232102 - DNA, 711 bp, Homo sapiens
  misc_feature: GYAE6OF01EUFYE.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgtcatggagtttgggctgagctgggttttccttgttgcttaattttaaaaggtgtccagtgtgaggtgcagttggtggagtcgtgggggaaccttggtccagccgtgggggtccctgagactctcctgtgtagcctctgcgttcaccgtcagtagctaattacatgagtcgtcgggtcccgccgaggcctccgaaggggtaaggggctaggggaggtgggtctcgtagtttaatttaagaggtacgagtacggaaccgcacgtacttcgacaacgcctccggacggaggggcaaggtacttccaacctatccctaccgaagaacgaacctaaacttaacccgaaacgtaaccctaaccccgttttatcctttacaagtatacgaaccgtacgcctaaggacgacggtacccggaaggtacccgtcgggtaccttacgttacctttaagttacccgttaggtaccggtaccggtaaggtaccgttaacccgacggttcggggacccgtttacgggaccccgtaagggtacccggttaacgggggtttaccgggttcccccggaacccccgggttaccggggggg

SEQ ID NO: 232103 - DNA, 638 bp, Homo sapiens
  misc_feature: GYAE6OF01DHOKZ.5.27.C05.1.454.CMB.1.raw
  modified_base (308)..(308): a, c, t, g, unknown or other
  misc_feature (308)..(308): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtcgtgggggaaccttggtccagccgtggggggtccctgagactctcctgtgtagcctctgtccgttcaccgtcagtagctaattacatgagcgtcgggtccnccgaggctccgagggtaggggctgggagtgggtctctagtttattatagcgtagtcggaaccgcaacaccttcgacagtaccgtccggacgggagggcagtactcacctatcctaccaagacgaacaacttaccgaaacgtaaaccttaccctttaatccttaacgaagtatacggaaacacgtcccgtaggaacgtacggaccgggtacgtaccgtcgggtcttcgtacttacgttacgtgtcggacggagtacggttacgacggtggccgttcggacccgtagggaccgtaggggtttaccggtccccggtaccccgggtaccggggg

SEQ ID NO: 232104 - DNA, 696 bp, Homo sapiens
  misc_feature: GYAE6OF01D1X1N.5.27.C05.1.454.CMB.1.raw
  modified_base (254)..(254): a, c, t, g, unknown or other
  misc_feature (254)..(254): n is a, c, g, or t
  modified_base (267)..(267): a, c, t, g, unknown or other
  misc_feature (267)..(267): n is a, c, g, or t
  modified_base (329)..(329): a, c, t, g, unknown or other
  misc_feature (329)..(329): n is a, c, g, or t
tcagatcagacacgcacgaccggtgctcgatttagacgcgatcgaagggtttgggcgtgggagaggagcccagcactgggattccgaggtgtttccattcagtgatctgcactgaacacagaggactcgccatggagtttggctgagcttgggttttccttgttgtcttaattttaaaaggtgtccagtgtgaggtgcagttggtggagtcgtgggactgtcagcgtcggggtcctgagctctctgtgagcctntcgtctcaccgtnagtagactaatacagtgacgtcgtcgggtcccgccgacggcctacgagggtagggtcgtggnggtcggtctacgtagtttattagaggactacgttacggaacctcacctcgttacgacgtaacggacctccgggacgggacgggtaccaggttacttccaacccgtactacctacgaacgaacgtaaccaacgttaaccgaaacttaaccctaccctttacgtacttcgaagtacgttaacgaactaacgtccgaaggtacggacgtaccgggaccgtaacgtccggtattaccgtcgtttaacttaaccgtggtacggaaccgaggttaccgttacccggaacggtcgggtaccgttaccgggaccggtaaccggtacgtagggggtttcccggtttacccccggacccccgggttacccggggggg

SEQ ID NO: 232105 - DNA, 538 bp, Homo sapiens
  misc_feature: GYAE6OF01AQOX4.5.27.C05.1.454.CMB.1.raw
  modified_base (436)..(436): a, c, t, g, unknown or other
  misc_feature (436)..(436): n is a, c, g, or t
  modified_base (440)..(440): a, c, t, g, unknown or other
  misc_feature (440)..(440): n is a, c, g, or t
  modified_base (446)..(446): a, c, t, g, unknown or other
  misc_feature (446)..(446): n is a, c, g, or t
  modified_base (473)..(473): a, c, t, g, unknown or other
  misc_feature (473)..(473): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagccgtggggggtccctgagactctcctgtgtagcctctgcgtttcaccgtcagttagcaattacatgagctgggtccgccaggctccaggtaaggggctgggagtggggtctcagtttatttatagcgatggaaccgcacacttcgcagactccgcgaggggcagattcaccatctccagagacaattccaagaactaccctttatcttnagangaaacngacctggagagacccgaggacgtccgntgtactattactgtgcgagtagtcacgtggctcgccgagcgaggtcggttccgccccggtcgggg

SEQ ID NO: 232106 - DNA, 712 bp, Homo sapiens
  misc_feature: GYAE6OF01CUNRL.5.27.C05.1.454.CMB.1.raw
  modified_base (324)..(324): a, c, t, g, unknown or other
  misc_feature (324)..(324): n is a, c, g, or t
  modified_base (442)..(442): a, c, t, g, unknown or other
  misc_feature (442)..(442): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatgggtagtttgggctgagcgttgggttttccttgttgcttaattttaaaaggtgtcctagtgtgaggtgctagttggtggagtcgtgggggtaaccttggtccaggccgtcgggggtccctggacgtctctccgtgtgtacgcctcgtgtcgtcaccgtcagtagactaatacagtgtagtcgtgggtcccnccgacggtccgtaccgaagggtaacgggtcgtagggtacgtgggtctagtagttattagtacgcgtagtacgaaccgcaacgtaccttcgaccgtagacctcccggggagacgggggnaacggtactccgaaccgtactccgttaacccgaagaacgtaaacctaacttaaacccgtaaacgtaaacccttaaccttttaacgtctttaacgacgtaactacggtaaactcggtacctacggaacgaccggaaccggtaccgggtaccgttacgggaccgttaggttaccctaacgttacgtcgggtacgtacggacggtacgtacgtacggtcggtcggtacgtacgtaacggcggttaggtcggtaccccgtccgggtacccgggg

SEQ ID NO: 232107 - DNA, 541 bp, Homo sapiens
  misc_feature: GYAE6OF01CD4Y6.5.27.C05.1.454.CMB.1.raw
  modified_base (382)..(382): a, c, t, g, unknown or other
  misc_feature (382)..(382): n is a, c, g, or t
  modified_base (446)..(446): a, c, t, g, unknown or other
  misc_feature (446)..(446): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttcctgttgctattttaaaaggtgtccagtgtgaggtgcagttggtggagtctgggggaaccttggtccagccgtggggggtccctgagactctcctgtgtagcctctgcgttcaccgtcagtagcaattacatgagctgggtccgccaggctccgaggtaagggctgggagtgggtctcgagtttattaatagcgatcggaaaccgcaacacttcgcagactccgngagggcagatcacatctccagagacaattccaaagtaaccacctttatcttacagtatgaaacngacctgagacgccgagacctacggctgtcctaattacctgtgtcgagtcgtcacgtggactggtcccagcagggttcgttcggccccgtacgggg

SEQ ID NO: 232108 - DNA, 949 bp, Homo sapiens
  misc_feature: GYAE6OF01CM9DD.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagtcgttgggttttccttgttgtcttaattttaaaaggtgtccagtgtgaggtgcagttggtggagtcgtggggtaaccttggtccaggtccggtcgggggtcctgacgactctccgtgtgtacgcctctgtcgttcaccgtcagtacgactaacttacagtgacgtcgtcgggtacccgccgacggtcctaccggaaggggtaacggggtctggggtacggttcgggtcttcgtaagttttattaacgtacggtacgtaacggtacggaaacccgtacctacgttaaccgttccgaccgtaacggtacccggtaccggggaccggggtaaacggggtaacctaacggttaacccgtttacccaaacccgttaccgttaacccgttaacccgtaaaacggtaaacgtaaaacccgttaaaacccgtttaaacccccggtaaaaaccgttaaaaacccccttttaaccccgttttttaacgttaaaccccgttttaccgtaaaacggttaaaccgttaaacgtaaaacccggttaccggtaaccggttaaagggaacccggtaaacccgggtaacccgggtaacccgggttaacccgggttacccggttaccgtttaccggttaccgttttaaaccgttttaccggtacggggtaccggttaaccggaacgggtttaacgttccccggtaaacggttcccgggtacccggttacggttaccccccggtaagggttaccccgggttaaccgggggttttaccccgggttaacccccgggtacccccgggggttaaccccgggggg

SEQ ID NO: 232109 - DNA, 796 bp, Homo sapiens
  misc_feature: GYAE6OF01CJMWO.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggtttccttgttgctatttaaaaggtgtccagtgtgaggtgcaggttggtggagtcgtgggggaaccttggtccagccgtgggggtccctggagacctctcctgtgtagcctcgtgccgttcaccgtcagtagctaattacatgagcgtgggcccgcgacggcctccgaggtaagggctggagtgggtctacgtagtttattagtacgacgagtcggaaccgctacgaccttcgacacgaccgtccggacggacggggacaacggtacttccgaaccctacgtcccgtacccgaaggtaacgtaaccgtaaaacctttacccgaaaaacggtaaacccttaaccccgttttaactccgtttaaccaaacggtaacgttaaccggaaaccgtaccggtacccgtaagggtaaccggtaaaccgggtaccccgggaacggggttaacccggttaccggggtaccctttacgggttaccctttaaacggtttaaccgttcgggtacgggtaaccggtaacgggtaaccgggtttacccgaaccgggttccggggtaccccggttccggttaacccggaacgggttcccggttaacggggggtttcccggtttaacccccggggacccccgggttaaccccgggggggg

SEQ ID NO: 232110 - DNA, 621 bp, Homo sapiens
  misc_feature: GYAE6OF01EDCW0.5.27.C05.1.454.CMB.1.raw
  modified_base (317)..(317): a, c, t, g, unknown or other
  misc_feature (317)..(317): n is a, c, g, or t
  modified_base (531)..(531): a, c, t, g, unknown or other
  misc_feature (531)..(531): n is a, c, g, or t
  modified_base (551)..(551): a, c, t, g, unknown or other
  misc_feature (551)..(551): n is a, c, g, or t
  modified_base (563)..(563): a, c, t, g, unknown or other
  misc_feature (563)..(563): n is a, c, g, or t
  modified_base (569)..(569): a, c, t, g, unknown or other
  misc_feature (569)..(569): n is a, c, g, or t
  modified_base (577)..(577): a, c, t, g, unknown or other
  misc_feature (577)..(577): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcttgggttttccttgttgcttaattttaaaggtgtccagtgtgaggtgcagttggtggagtcgtggggtaccttggtccagccgtgggggtccctgagtactctcctgtgtacgtcctcgtgtccgttcaccgtcagtagactaagttacagtgacgtcgtcgggtccnccgaggtcctaccggaagggtaaggggtccgtagggtacggttcgggtctacgtagtttatttaagtacggacgtagtaccggaacctcgtaactacgttccgacacggtaccgtccggacgggtacggggacctagtacgttaccaactacgtcctaccgaagtacgaactaacgtaacaacgtacctaccctttatctacgagatacgaacngcctgagacgcgagctcgtntctctacttagntcgagngtcgtacngttcgcgtacgtcaggtactcgggtcgttcccggccgtacgggg

SEQ ID NO: 232111 - DNA, 666 bp, Homo sapiens
  misc_feature: GYAE6OF01EFGVB.5.27.C05.1.454.CMB.1.raw
  modified_base (314)..(314): a, c, t, g, unknown or other
  misc_feature (314)..(314): n is a, c, g, or t
tcagatcagacacgcacgaccggtgctcgatttagacgcgatcgaagggtttggggctgggagaggagcccagcactgggattccgaggtgtttccattcagtgatctgcactgaacacagagactcgccatggagtttggctgagctgggttttccttgttgcttaagttttaaaaggtgtccagtgtgaggtgcgtagttggtggagtcgtgggggtaaccttggtccagccgtgggggtccctgagactctctgtgtacgcctcgtgtcgttcaccgtcagtagactaaattacatgagcgtcgggtcccnccgaggtccgtaccggagggtaacggggcctagggtaggttgggttctacgtaagttttagtttaagtacgcgtaagtcggaaaccgctaactacgttcgacaacggaccgtcggaccgggacgggactacgtacttaccaccgtaatccgtacccaaggtaacgtaactaaacttaccgaaaacgtaaacccttaacccttttactcttaacgagtatacgaaactcgtctaacggagtaacgccggaacgtacctcgggacttcggtacttagtacgtgtacgagtagtaacgtcgacgtcggaccgttcggacgtggtacctagggttcggtacccgcccgggtacggg

SEQ ID NO: 232112 - DNA, 608 bp, Homo sapiens
  misc_feature: GYAE6OF01EABLC.5.27.C05.1.454.CMB.1.raw
  modified_base (306)..(306): a, c, t, g, unknown or other
  misc_feature (306)..(306): n is a, c, g, or t
  modified_base (375)..(375): a, c, t, g, unknown or other
  misc_feature (375)..(375): n is a, c, g, or t
  modified_base (542)..(542): a, c, t, g, unknown or other
  misc_feature (542)..(542): n is a, c, g, or t
  modified_base (573)..(573): a, c, t, g, unknown or other
  misc_feature (573)..(573): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtcgtgggggaaccttggtccagccgtgggggtccctgagctctcctgtgtagcctctgcgttcaccgtcagtagactaattacatgagcgtcgggtcccncgaggcctaccgagggtaacggggctgggaggtgggtctacgtagtttatttagagcgagtcggaaccncacacgttcgacagacctccggcggacgggcagtactcaccatcctaccaagacgaactaacttaccaaagtaccttaccctttatccttacagtactacgaacacggtctagaacgacggaccggaaggaccgttacggcttacgttacttacgttactgggtacncggtagacgtacgcggtggtctcggtaccgnggtacgtagggttccggtcccggcccggtacgggg

SEQ ID NO: 232113 - DNA, 715 bp, Homo sapiens
  misc_feature: GYAE6OF01BJ8M9.5.27.C05.1.454.CMB.1.raw
  modified_base (280)..(280): a, c, t, g, unknown or other
  misc_feature (280)..(280): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcttgggttttccttgttgcttattttaaaaggtgtccagtgtgaggtgcaggttggtggagtcgtgggggaaccttggtccagccgtgggggtccctgagactctcctgtgtagcctctgcgttcaaccgtnagtagacaattacatgagcgtgggtcccgcgacggcctaccgagggtaagggcgtggaggtcgggtctacgtagtttacttagagcgagtacggaccgcactacgtcgacacgacctccggacggagggcagacttcacctatcctaccagacgaactaacgttaaccaaagtaaccttaccctttattacctttacgaaacgtacttacgaaaccgtacggtacctaacggaacggacggtacccggtaacgggtaacccgttccggggttaccttacgggttaccttaacgttttaccggtaggttaccgggacgttaaacggtacggttaccgtaacggttcccggggaccttaccggggtacccctaaggggtacccggttaggggtttacccggggttaacccccggtaccccccggggtaaccgggggg

SEQ ID NO: 232114 - DNA, 569 bp, Homo sapiens
  misc_feature: GYAE6OF01A4Z5W.5.27.C05.1.454.CMB.1.raw
  modified_base (261)..(261): a, c, t, g, unknown or other
  misc_feature (261)..(261): n is a, c, g, or t
  modified_base (301)..(301): a, c, t, g, unknown or other
  misc_feature (301)..(301): n is a, c, g, or t
  modified_base (448)..(448): a, c, t, g, unknown or other
  misc_feature (448)..(448): n is a, c, g, or t
  modified_base (465)..(465): a, c, t, g, unknown or other
  misc_feature (465)..(465): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttttgctattttaaaggtgtcagtgtgaggtgcagttggtggagtcgtgggggaaccttggtccagccgtggggggtccctgagactctcctgtgtagcctntgcgttcaccgtcagtagcaattacatgagcgtgggtccncaggctccagggtagggctgggagtgggtctcgagtttatttagagcgtatcggaaccgcaacgtacgttcgcacgacctccggcggaggggcagtacttccaccatcctccagacgactaacttcccaaagaaccctaccctttanccttacagtatcgaacngtacctgacgacgccgaggtacctcggcttagtactagttctgtgcgagacgtcgagtcggtctcggtcagtccggaggttcggtcccgcccggtgggacccgg

SEQ ID NO: 232115 - DNA, 657 bp, Homo sapiens
  misc_feature: GYAE6OF01BDZAS.5.27.C05.1.454.CMB.1.raw
  modified_base (619)..(619): a, c, t, g, unknown or other
  misc_feature (619)..(619): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctatttaaaaggtgtccagtgtgaggtgcagttggtggagtcgtgggggaaccttggtccaggccgtgggggtccctgagactctcctgtgtacgcctcgtcgtcgttccaccgtcagtagctaattacatgagtcgtggtccgcaggctcgaggtagggctggagtggtctcagttattagtagcgagtacggtaaccgctaacgtacgttcgacgaacgtaccgtccggacggtacggggactaaggtacttaccaccctacttacctacccgaagacggtaaacctaacgttaacccgaaaacggtaaacccttaaccccttttaagttacctttacgaacgtacgtacgaaaccgtagccctaggacgaacggacccggaaggtaccgtaccggtctagttacctaattcggtgtacgaccgtaggtcgtacgacgtggcctacggtccnggtaccgtacgggttccgttcccggaccccggtcgggg

SEQ ID NO: 232116 - DNA, 748 bp, Homo sapiens
  misc_feature: GYAE6OF01CHU1J.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagtcgttgggttttccttgttgtacttaattttaaaaggtgtccagtgtgaggtgcagttggtggagtcgtggggaaccttggtccaggccgtgggggtccctgagactctcctgtgtacgcctctgtccgttcaccgtcagtagactaattacatgagtcgtcgggtcccgccgaggtcctaccggaaggggtaacggggccgttaggggtaggttcggggttaccttacggttaagtttaagttttaagtacggacggtaagtaccgggaaacccgctaaccgtacgttccgacgtacgacccgtccgggacgggaggggaccaaggtaccttacccgtaacctacttacccgtacccgaagaacgtaaacctaaacgttaaccgaaaccgtaaacccttacccgtttataccttacaagtactacgaaacgtcgaccgtaggaagtaccggacccggtaacggtaccgtcggtacttacggttacttaacgtttacgtcggtacgacggtacgtacgtacaccggttcggtaccgttcgggtaccgtacggtacgggttcgggttacccgggttccccgggaacccggtacccgggggg

SEQ ID NO: 232117 - DNA, 714 bp, Homo sapiens
  misc_feature: GYAE6OF01BU64D.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcttgggttttccttgttgcttaattttaaaaggtgtccagtgtgaggtgcagttggtggagtcgtggggaaccttggtccagccgtgggggtccctgagactctcctgtgtacgcctcgtgtccgttccaccgtcgagtagactaaattacagtcgacgtcgtcggggtcccgaccgtagggccttaccggaaggggtaaagggggccgtggggtaggttcggggtactcgttaagttttatttaagtaggcgtacgttacgggaacccgactaaccgtaaccgttccgacgaacggaccgtacccgggacggaacgggggcaaggtactttacccaaccctacgttccctacccgtaaggaacctaacgtaaacttaccccgaaaactaaacccttaaccccttttattaccttacaagtactacgaaacacgtaccgagaacgacgccggacggtcgtcggtactacgtactaacgttcgtaggtgacggtagtacgtccgtacgtcggtccgtacggtaccgaggacgttacgggtaccggttcccggacccggtacccgggg

SEQ ID NO: 232118 - DNA, 723 bp, Homo sapiens
  misc_feature: GYAE6OF01DBTT2.5.27.C05.1.454.CMB.1.raw
  modified_base (393)..(393): a, c, t, g, unknown or other
  misc_feature (393)..(393): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtcgtgggggaaccttggtccaggccgtgggggtccctgacgactctcctgtgtacgtcctctgtcgttcaccgtcagtagctaattacagtgagcgtcgggtcccgccgacggtcctaccgaaggggtaacggggctggggtaggtgggtctactagtttatttagtacgcgtagtacggaaacccncaactaccccccgttgacaacgaccgtcccggacgggtaggggacaaggtacttacccaccgtaactccctaccgaacgaacgaactaaacttaccgaaacgtaaaccctaccccgttttataccttaccgaagtacttacgaaacgacgtaccgtaacggaacggaaccggacccggaacgggtaccgtccgggtcttacggttacttaacgtttaccgtggtaccgacggtaaggtacggtaccgaacggttcgggtccgttacgggtacccgacggttaccgggtagggtttacccgggttccccggtaaccccgggtaccgggggg

SEQ ID NO: 232119 - DNA, 596 bp, Homo sapiens
  misc_feature: GYAE6OF01AVUU8.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtcgtgggggaaccttggtccagccgtggggggtccctgagactctcctgtgtagcctctgcgttcaccgtcagtagctaattacatgagctgggtccgccgaggctccgagggtaaggggctggaggtgggtctctagtttatttagtagcgtatcggaaccgcacacttcgcagacctccgcggagggcaggtattcaccattcctaccgagacgaactaacttaccaaacgtaaacctaccctttataccttacgagtatgaactcgccgtagagacggccggaagtcgtccggtctcgtacttacgttactgtcgacggtagcgtacgacgtcggaccgtcgggtccaggtacgagggttaccggttcccggtaccccggtacgggg

SEQ ID NO: 232120 - DNA, 868 bp, Homo sapiens
  misc_feature: GYAE6OF01CYCZP.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactagaacacaggaggactcgccatggagtttgggctgagtcgttgggttttccttgttcgtacttaagttttaaaaggtcgtaccgtaggtggtgtaggtgtacgtaggttgggtaggtacggtcggtacggggggtaacctttcgggaccgacgggtcccgggttcgggggggtcccctaggacgtaccttccgtccgtggttcgtacgtccttccgtcggttaccgttaccgtaccggtacgtaaggttacgtaaccttaaattaacgtagtacggtacggtccggttccggggtacccgtacccggacggtacccggtaacgggtaacgggggtaaacggggtccggtaggggtacgggttcgggttaccttaacggttagtttaagttagacggacgtaacgtacgggaaccctctaacgtaccgttcgaaccgtaaccggtcccgtaccgggacgggacgggtactagaccttacaccgttactaccgaccgaaggtaaccaacctaaacttacccgaaaacttaacccctttaacccgttataccttaacgaagtactaaccggaaactccgggcgtaaggaaaccggcgggaacccggtacggttacccgttcggtacgtttacctccgtttaaaaggttcggtcgaggtaaacggttaccgtacgaccttcgggtacggccgtttaccggacgtaacggggtacggtttaacccggggttcccggccccggtaaaccggggtacccggg

SEQ ID NO: 232121 - DNA, 804 bp, Homo sapiens
  misc_feature: GYAE6OF01A0X3B.5.27.C05.1.454.CMB.1.raw
tcagatcagacacgcacgaccggtgctcgatttagacgcgatcgaagggtttgggctgggagaggagcccagcactgggattccgaggtgtttccattcagtgatctgcactgaacacagaggactcgccatggagtttgggctgagctggtttcctgttgcttatttaaaaggtgtcctagtgtcgtaggtgcgagttggtggtagtcgtaggggtaaccttggtccgagtccgtgggggtccctggagactccgtcgtgtgtacgcctgtcgtcgttcaccgtcaagtacgactaagtttacacgtggacgtcgtcgggtcccgtcggtacggccttaccgagggttaacgggtcgtagggtacggtcggtcctacgtaggtttaacgttagtacgtacgtacggtaccggtaacccgtacgtaccgtaccgttaccgacgtaacgtaccgtccggacggtacgggtactaacggtacttacccgaacgtcttaccgtaaccgtaagtaccgtaacctaacgttacccgaaacggtaacccttaccccgtttagtacccgttacgtaacgtaccgtacgtaaaccgtacggtacccgttacggaaccggtaccgtacccgggtaacgggttaaccgttaccgggtaccgtttaaccgttaccggtttaaccgttacggttcgggttaaccgaccgggttaacgtaccgttacccggtaacgttccgggtaccgttaacggtacccggtaacggttcccgttaacggggttcccgttaaccccgggtacccggttacccgggg

SEQ ID NO: 232122 - DNA, 668 bp, Homo sapiens
  misc_feature: GYAE6OF01CQ2Q9.5.27.C05.1.454.CMB.1.raw
  modified_base (312)..(312): a, c, t, g, unknown or other
  misc_feature (312)..(312): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgcttattttaaaaggtgtccagtgtgaggtgcagttggtggagtcgtgggggaaccttggtccagccgtggggggtccctggagactctcctgtgtacgcctctgtcgttccaccgtcagtagctaattacatgagcgtggggtcccnccgaggcctccgagggtaagggcgtgggagtgggtctacgtagtttatttagtagcgagtcggaaccgcaactacttcgcaacgaccgtcccggacggaggggcagtacttccacctatcctacagagactaacttacccaaagtaaccctaccctttataccttacaagtatacgaaaccgacgacccgtaggaacgtacggacccggaacggtacccgtcgggtaccttcggttacttaacgtttacgttacggtcggtacggtaacggtacggttcccacggttcgggcgttccgggtacccgacggtaccggtaggggtttccggttcccgggacccccggttaccgggggg

SEQ ID NO: 232123 - DNA, 562 bp, Homo sapiens
  misc_feature: GYAE6OF01EYW07.5.27.C05.1.454.CMB.1.raw
tcagatcagacacgcacgaccggtgctcgatttagacgcgatcgaagggtttgggggctgggagaggagccccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagccgtggggggtccctgagactctcctgtgtagcctctgcgttcaccgtcagtagcaattacatgagcgtgggtccgccaggctccgagggtaaggggctggagtgggtctcgagttattatagcgatcggaaccgcacacttcgcagactccgcgaggggcagattccaccatctaccagagactaattaccaaacgaactaccctttatcttacagatagaacacgcctagagacgccggaggtactcggctcgtactattactgtgacgagtacgtcacgtcggctcggtccgacgcggtaagggttcggttacccggccccggtcggggg

SEQ ID NO: 232124 - DNA, 727 bp, Homo sapiens
  misc_feature: GYAE6OF01DAXGU.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttcctgttgctattttaaagtgtccagtgtgaggtgcagttggtggagtcgtgggggaaccttggtccagcctggggggtccctgagactctcctgtgtagcctctgcgttcaccgtcagtagactaattacatgagctggggtccgccgaggctcccgagggtaacggggctggagtgggtctcagttattatagcgatcggaaccgcacgacttcgctacgactccggcgaggggcagtacttccaaccgtatccgtacccaagaacgtaaccaactttaccgaaagtaaccctacccccttttaatccctttaaccaagtaacgttacggaaacctacgcccgtagggtaaccgacggtacccgggaagtacccgtcggggtacccgtttcggttactttaactttacggtacggttaccgggtaccggtaaggtaaccggtttaacccgtaccggtttacgggggtacccgtttagggggttaccccccgtaaagggccggtttaaacgggggggtttcccggtttaaccccgggggtacccccccccggggtttaacgggggggggg

SEQ ID NO: 232125 - DNA, 801 bp, Homo sapiens
  misc_feature: GYAE6OF01DRCKL.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcttgggttttccttgttgtcttaattttaaaaggtgtccagtgtgaggtgctagttggtggagtcgtgggggtaaccttggtccagccggtcggggggtccctgacgactctcctgtgtacgcctcgtgtcgttcaccgtcagtagctaaattacatcggagtccggtcgggtaccgccgacggccgtaccggaaggggtaacgggggcgtagggtaggttcgggttaccttacgtaggtttatttagtacggtcggaagttaccggaacccgtacgaaccgtaccgttaccggacctaaccggtacccgtacccgggacggggaacgggggaccgtaacgggttaactttacccggaacccttacgtaccctaaccgaaggtaaccgaaaacccttaaacttaacccgaaaacgtaaaccccttaaccccttttaacgtccttaacgaagtaactaaccggaactaccggtctaacgggaacgtaaccggacccgggtaacggtaccgttaccgggtcgttaggttaccttaacgttaaccggtggtaccggtagaacgggttacgttaccggtacggttcggtaccggtcgttaaccgcggttaccggggtacgggtttcccgggtcccgggtacccccgggtaccggggg

SEQ ID NO: 232126 - DNA, 667 bp, Homo sapiens
  misc_feature: GYAE6OF01APISZ.5.27.C05.1.454.CMB.1.raw
  modified_base (425)..(425): a, c, t, g, unknown or other
  misc_feature (425)..(425): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtcgtgggggaaccttggtccagccgtggggggtccctgagactctcctgtgtacgcctcgtgcgttcaccgtcagtagcaattacatgagctgggtcccgccgaggcctccgagggtaaggggcgtgggaggtcgggtctcgtagtttatttagtagcgtatacggaaccgcactaccgttcgacacgaccgtccggcggaggggcaggacttcaccgnttccaccgagaacgaccaacttaccgaaagtaacctacccttttatcctttacgagtactacgaacacgtcctaggaacgacggccggtaaggaccgttacgggtctacggttaccttacgttacgtcggtcggtaccgtaggtaaccgtacgtacggttcgggccgttaccgggtaccgtacgggtaccgggttaacggggtttccggttacccccgggtaccccggggttacccgggggg

SEQ ID NO: 232127 - DNA, 753 bp, Homo sapiens
  misc_feature: GYAE6OF01DRFG6.5.27.C05.1.454.CMB.1.raw
  modified_base (278)..(278): a, c, t, g, unknown or other
  misc_feature (278)..(278): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcttgggtttttccttgttgcttattttaaaaggtgtccagtgtgaggtgcagttggtggagtcgtggggaaccttggccaggccgtgggggtccctgagactctcctgtgtagcctctgcgttcaccgtnagtagctaattacatgacgcgttcgggtcccgccgaggtcctccggaaggggtaacggggtccgtgggaggttcgggtcttacgtagtttaagtttagtaggacgtagtacggaacccgtctacctacgttcgacagtacccgtccggcggacggggcaagtacttacacctacgtccctacccgtaagacgtaaacctaaactttacccgaaaacgtaaaccccttacccttttaacttacccgtttaccaaacgtacttaaccggaaaactacggtacccgtaaggtaacggaaccggacccggtaaccggggtaccgtaccgggtctttacggtcctttaaagtttccgtaggtaccggtaccggtaaggtaccgttccgaacggttcgggacccggttagggtaccccgaaacgggttcccggtaagggggttttcccggttccccgggaacccccccgggttacgggggg

SEQ ID NO: 232128 - DNA, 623 bp, Homo sapiens
  misc_feature: GYAE6OF01ELHIW.5.27.C05.1.454.CMB.1.raw
  modified_base (309)..(309): a, c, t, g, unknown or other
  misc_feature (309)..(309): n is a, c, g, or t
  modified_base (329)..(329): a, c, t, g, unknown or other
  misc_feature (329)..(329): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctaattttaaaaggtgtccagtgtgaggtgcagttggtggagtcgtgggggtaaccttggtccaggccgtgggggtccctgagactctcctgtgtagcctctgcgttcaccgtcagtagaccaattacatgagcgtcgggtccnccgaggcctcgaggtagggntggagtggtctctagttattagagcgtatacggaaccgcacgtacttcgacgtaacgaccgtcgacggtagggacacgtctacctacgactacctaccaagacgtaactaacttaccgaaactaacccttaccctttatccttaacgacgtaataccgaataccgcgtaaggagaccggaccgaggtaccgttcggacttggttaccttagtccgagtcggacgtagtacttacgaggttcggtcgtacggtacacggtcgtagggttcccggcccggtcccgggtaaccgggg

SEQ ID NO: 232129 - DNA, 622 bp, Homo sapiens
  misc_feature: GYAE6OF01CPPHL.5.27.C05.1.454.CMB.1.raw
  modified_base (180)..(180): a, c, t, g, unknown or other
  misc_feature (180)..(180): n is a, c, g, or t
  modified_base (186)..(187): a, c, t, g, unknown or other
  misc_feature (186)..(187): n is a, c, g, or t
  modified_base (193)..(193): a, c, t, g, unknown or other
  misc_feature (193)..(193): n is a, c, g, or t
  modified_base (197)..(197): a, c, t, g, unknown or other
  misc_feature (197)..(197): n is a, c, g, or t
  modified_base (226)..(226): a, c, t, g, unknown or other
  misc_feature (226)..(226): n is a, c, g, or t
  modified_base (237)..(237): a, c, t, g, unknown or other
  misc_feature (237)..(237): n is a, c, g, or t
  modified_base (242)..(242): a, c, t, g, unknown or other
  misc_feature (242)..(242): n is a, c, g, or t
  modified_base (380)..(380): a, c, t, g, unknown or other
  misc_feature (380)..(380): n is a, c, g, or t
  modified_base (450)..(450): a, c, t, g, unknown or other
  misc_feature (450)..(450): n is a, c, g, or t
  modified_base (458)..(458): a, c, t, g, unknown or other
  misc_feature (458)..(458): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcgtggtttcgtgtagctattaaagtgtcagtngagtgnngtgtgngtgngggtacctgcagcgtggggcctgagtctntcgtgtagtcncctgngtacgttaccgccgtgagtacactaaattcagtgtagcggtcggtcccacgacgacctcgagggtaggctagggcgtggtactgtagtttattagcgtacgagtgaacccgctaacgaccttgaccacgacgtcccgnggagggacctagtactcacctattaccacgaacgagtaacccaacttaccgaaacgtaaccttacccttnttaccctnaaggttaccaacgaacgtactcgaacgtcggaccgtacccggagtaccgtgtacgtccgttagttaacgtccgttaggtacgaacgtacgtaacgttcgacgtcggtcggtacccgtacgacggaccggttaagggtcccgttcccgggacccggtacccgggg

SEQ ID NO: 232130 - DNA, 791 bp, Homo sapiens
  misc_feature: GYAE6OF01B5AIN.5.27.C05.1.454.CMB.1.raw
  modified_base (179)..(179): a, c, t, g, unknown or other
  misc_feature (179)..(179): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagttggctgagcttgggttttcttgtgtcttaattttaaaaggngtccagtgtgaggtgctaggttggtggagtcgtagggggaaccttggtccaggccgtcgggggtccctgacgactctcctgtgacgtcctcgtgtccgttaccaaccgtcaagtacgactaatttacagtagagcgtggggtcccaccgaggccttaccgaagggtaaaggggctaggacggtgggtcctgtaagttttaattaactagacgtaatacggaaccgctaacgtacttcgactaacgccgtaccgacgggacgggacaaggtacttaccaaccctatacccgtacgaagtaacgaactaaaccgtttaccaaaacgtaaaccccttacccttttaataccgtttaccgaagtacttaacggaaaccgtagtaccccgttgggaaacgacggggaccccgtaaaggggtaacccgttacccggtgttttaacggttaccctttaaagttaacccggttagggtaccggtacggttaaacgggtaacctaacgttaaacccgggtcgggttacccgtttacggggtaacccgtaacgggttacccggttaaaggggtttcccggggtttaaccccccgaaccccccgggggtttaacccggggggg

SEQ ID NO: 232131 - DNA, 599 bp, Homo sapiens
  misc_feature: GYAE6OF01DHVIT.5.27.C05.1.454.CMB.1.raw
tcagatcagacacgcacgaccggtgctcgatttagacgcgatcgaaggggtttgggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagccgtggggggtccctgagactctcctgtgtagcctctgcgttcaccgtcagtagactaattacatgagcgtgggtcccgccgaggctccgagggtaagggctgggagtgggtctcagttattagtgcgtatcggaaccgcactacgttcgcagaccgtccggcggaggggcaaggacttcaccactcctaccagacgaacaattaccaaagtaacctaccctttatcttacagtatacgaacacgccgtgaacgacgaccggaggtacgtcgacttgtcttagttaccgtgtacggtacaggacgtacgacgtggtccgttggtaccgacggacgtgggttaccggttcccggacccggtacccgggggg

SEQ ID NO: 232132 - DNA, 776 bp, Homo sapiens
  misc_feature: GYAE6OF01BLI2S.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccagtggagtttgggctgagtcgttggttttccttgttgtattaagttttaaaaggtgtccagtgtgaggtgcgtaggttggtggtaggtcggtaggggggtaacctttcgggtcccgacgggcccggttcgggggggtcccctggacggtaccttccgttccgtggtcggtacgtcctcgtcgtccgttccgaccgtcagtagactaattacagtgacgtcggtcgggtcccgccgtacgggcctccggtaaggggtaacggggcgtacgggtagggtcgggttctacgttaggtttatttagtaggacgtagtacggaaccgctaacgtacgttcgacgacgtaccgtccggacggacggggctaacgtacttacccgactacgtacctaccggaagtaaaccgtacgtaaacgtaaccctaaacgtaaaccctttaacccgtttaacgttaccttacgtaagtaactacgtaaactacggtacccgtaggtaaccgacgtaaccgggacggtaccgtacggttaccgtcggttactttacgttacggttacgtagtaccggaggtacgtacgtacggtcggtccggttacgtaccggacgtacgggtacgggttccggtccccgggtccgggtaaccccggggg

SEQ ID NO: 232133 - DNA, 746 bp, Homo sapiens
  misc_feature: GYAE6OF01CJOTC.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagtcgttgggttttccttgttgtcttaattttaaaaggtgtcctagtgtgaggtgctaggttgggtggtagtcggtagggggtaaccctttgggtaccgacggtccgggttcggggggtccctggacgtacctccgtccgttggtcgtacgccttcgtcgtccgttacctaccgtctagtacgtataacttacatggacgtcggtcgggtcccgacgacggtccgtaccgaaggggttagggcgtgggtacggttcgggtactcgtaagttttagttagtacggtacgtacggtacggaaccgtctaaccgtccgttacgacgtacgaccgtccggagggacgggtcaacggtactccaccgtatccaacgacgaactaactaacgttaaccgaaataacccgttaaccttcttcgaactacgattacgactacgtacgtaggaacgtaccggacgtacggtacgtccgtcgttataccgtttaagtacgttggtacgtaggtacgtaacgttcccgtagggttacggtcccgttaacggacgaccggttaccgggttacgggttcccggtaaaccccgggtccccgggtaacccggggg

SEQ ID NO: 232134 - DNA, 937 bp, Homo sapiens
  misc_feature: GYAE6OF01DLMIE.5.27.C05.1.454.CMB.1.raw
  modified_base (382)..(382): a, c, t, g, unknown or other
  misc_feature (382)..(382): n is a, c, g, or t
  modified_base (413)..(413): a, c, t, g, unknown or other
  misc_feature (413)..(413): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagtcgttggggtttttccttggttgtactttaatttttaaaaagggtcgtaccgaaggttggtggaaggttgcgtaggtttgggtggaagttcggtacggggggtaaaccttcgggtccacggccgggttcggggggttccctgacggtacctccttccgtggttgtacgtcctcgtggtccgtttaccaccggtcaaggttacgactaacttacagtgacgcgttcggggtcccncggaacggtcctccggaggggtaagggccgngggtacggtgggtcttacgtaggtttattagacgtacgagttaccggaaccgtactaccgtaccgtttcggacgtaacggtaccgtacccggggacggtacggggtactaaacggttacttaacccgaaaccgtacgttaaccccgtcgtaaaaccggttaagaaaacccgtttaaacccgttaaacccgtaaaaaccggttaaaccccctttaaccccgtttttaactttaaccccggttttaaacgaaaccggttaacgtaaaccggtaaaaccctaccgggttaccgttaaccggaagggtaacccgggtaaccgggtaaccgggttaccggtacccgggttacgtttaaccggttacgtttaaaccggttacggttaccgggttaacggtacgggttaaacggtaccggttacccggtaaaggttccggggttaccggacccgggtttaaccgacggggtccggttaacggggtttaccccgggtttaccccgggaaccccggggggttaaacccggggg

SEQ ID NO: 232135 - DNA, 648 bp, Homo sapiens
  misc_feature: GYAE6OF01BXX0L.5.27.C05.1.454.CMB.1.raw
tcagatcagacacgcacgaccggtgctcgatttagacgcgatcgaaggggtttggggctggggagaggagcccagcactgggattccgaggtgtttccattcagtgatctgcactgaacacagaggactcgccatggagtttgggctgagctgggttttccttgttgcttattttaaaaggtgtccagtgtgaggtgcagttggtggagtcgtgggggaaccttggtccgagccgtgggggtccctgagactctcctgtgtagcctctgcgttcaccgtcagtagctaattacagtagagcgtgggtccgcgaggtccgtaccgagggtaacggggctgggtgtcgggtctcgtagttagttagtagcgtagtcggaaccgcactacttcgacacgacctccggacggagggacagtatccaccatcctaccagacgaactaactaccaaacgtaacctaccctttatcttacagtactacgaactacgcccgtagacgaacggtaccgaagggtccgtacgggtacttacgtaccttaagttaccgtgtaccggtacgtacgtacgttaccgacccgttgggtaccctacgggtacccgacggtcggttaaggggttccggttaccccgcccggggtacccgggggg

SEQ ID NO: 232136 - DNA, 700 bp, Homo sapiens
  misc_feature: GYAE6OF01BIMAV.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtcgtgggggaaccttggtccagccgtggggggtccctgagactctcctgtgtacgcctctgcgttcaccgtcagtagcaattacatgacgcgtcgggtcccgccgacggcctccgaagggtaaggggtctagggtaggttgggtcctacgtaggtttactttaagtaggccgtattacggaaacccgcctaaccaccgtttccgacgtaacggtaccgtcccggacggacgggggctaacggtactttcccgaaacctactccgtacccgaaggtaacgtacctaaaacgttaacccgaaacggtaaaccccttaaccccttttacgtacctttaccaagtacttacggaaactacgcccttaaggacgaacgccggaacggtacctcggtcttacgtaccttattaccgtgttacgacggacgtacgtcgtacgtcggacgtggtaccctacgggacgtacgggtcgggttacccgtcccccggggtacgggg

SEQ ID NO: 232137 - DNA, 810 bp, Homo sapiens
  misc_feature: GYAE6OF01BG2KE.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagtcttgggttttccttgttgcttaattttaaaaggtgtccagtgtggaggtgctaggttggtggagtcgtgggggtaaccttggtccaggcccggtcggggggtcccctggacgtaccttccgtccgttggtcgtacgtcccttcgtcgtcgtttaccgacccggtctaagtagactaaattacagtacgacgtcgtcggggtcccgaccgaggtcccgtaccgaaggggtaaacggggtcgtaggggtaggttcggggtccttacgtaaggttttatttagaagtcgaagtacggaaccgtacaacgtccgttcgaccgaacgtacccgtccgggacgggtacggggacctaaggtactttaccacccgtactccgtaaccgaagtaacgtaacctaaacgtttaacccgaaaacgttaacccctttaaccccttttaacgttaccgttaacgtaacggtaaactacggaaaccgtacggacccgttaggaaacggtaccggaacccgggtacggtaaccgttccgggtaccttcgttaccgttaacgtttacgtacggttcggaaccggttagaaccgttccgtacggttcgggtccgttcggaaccgtagggtacccggttagggttccccgggttaacccggccccccggggtacgggg

SEQ ID NO: 232138 - DNA, 692 bp, Homo sapiens
  misc_feature: GYAE6OF01E5G0I.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttggctgagctgggttttccttgttgcttaattttaaaaggtgtccagtgtgaggtgctagttggtggagtcgtgggggtaaccttgggtccagccggtgggggtccctgagtacctctcctgtgtagccgtctgtcgtccaccgtcagtagactaattacagtgacgtcgtcggtcccgcgacggcctcgaggtaaggggtcgtaggtaggtgggtctagtagttttattagagtcgtagtacggtaaccgcaactaccgttcgacgaacggtaccgtccggacgggtacggggacaacggtattcccgaacctactcccgtaccaaggtaacgtaacctaaaaccgtttcccaaaaaccgtacccttaaaccccgttttattaccttaacgtaaacgattacccggaaactacggtccgtaggacggtacgggaccccggtagggtaccgttccggtacgtttacgtaccttaacgttcgtggtaccggacggtaagtcgtaacgcgtcggtctcggtccgagcgtaggttccggtcccgcccgggtacggg

SEQ ID NO: 232139 - DNA, 622 bp, Homo sapiens
  misc_feature: GYAE6OF01DGW07.5.27.C05.1.454.CMB.1.raw
  modified_base (285)..(285): a, c, t, g, unknown or other
  misc_feature (285)..(285): n is a, c, g, or t
  modified_base (329)..(329): a, c, t, g, unknown or other
  misc_feature (329)..(329): n is a, c, g, or t
  modified_base (394)..(394): a, c, t, g, unknown or other
  misc_feature (394)..(394): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttggctgagcttgggttttccttgttgcttaattttaaaaggtgtccagtgtgagtgcagttggtgagtcgtgggaaccttggtccagcccgtgggggtccctgacgctctcctggtgtacgcctcgtgtccgttacaccgtcagtnactaattacatgagcgtcggtcgccgagtccacgaggtagggcnggagtcggtcttcgagttattatagcgtaagtcggaaacgcaacacgttcgactacgacgtccgngggacgggctaagtacttccaacctagtcctaccgaagaacgaacctaaattccaaaacgtaacctaccgttaactcttacgagtaatcgaaaccgtcgtcctaagacggaacaccgggacgtacgtccggtactcgttacctagttacgtgtacgacgacgttacgcgtaggtcgtccgtaggtcctaggaccgtcggggttaacgtcccggtcccggttaacgggg

SEQ ID NO: 232140 - DNA, 617 bp, Homo sapiens
  misc_feature: GYAE6OF01DS3MM.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctatttaaaaggtgtcagtgtgaggtgcagttggtggagtcgtgggggaaccttggtccagccgtggggggtccctgagactctcctgtgtagcctctgcgttcaccgtcagtagcaattacatgagcgtgggtcccgccaggctccgagggtaagggctggaggtgggtctctagtttattatagcgagtggaaccgcacacttcgacacgacctccggcggacggggcagtacttccaacctacttcctaccaagacgaacctaaacttaccaaacgtaacctaccctttatcttacagtatacgaacacgcctaggaacgacggacccggaggtacctcggtcttacgttacttacttacgtggtcgacgtaggtacgtcgacgtcgggtacttcgggacctaggtacggtaaggggttcccggtacccggtcccccggtaccgggggg

SEQ ID NO: 232141 - DNA, 757 bp, Homo sapiens
  misc_feature: GYAE6OF01B2DNW.5.27.C05.1.454.CMB.1.raw
  modified_base (185)..(185): a, c, t, g, unknown or other
  misc_feature (185)..(185): n is a, c, g, or t
tcagatcagacacgcacgaccggtgctcgatttagacgcgatcgaagggtttgggctgggagaggagcccagcactgggattccgaggtgtttccattcagtgatctgcactgaacacagaggactcgccagtggagtttggctggagtcgttgggttttcctgttgtacttaattttaaaaggngtcctagtgtgaggtgtgtaggttggtggagtcggtagggggtaaccttgggtccaaggtccgggttggggggtcccctaggaacggtaccttcgtccgtaggtgtacgtccgtcgtacggtccgtttacccgaaccggttacgaagttaggaacctaaagttaacgagttaggacgtcggtacggggacccacccgaaggtccctaccggaagggtaacgggtcgagggtaaggtcgggtcctagtagtttaattagacggcgtagtacggaaccgtctaacgtacgtacgacgacgtaccgacggcggaagggtaccaagtacgtacaccgtataccgtacgaagacaactaaacttaccgaaactaacccttaccgttaatacccgttaacgaacgtagtaaccgaaaccgtagtacccgtaaggaacgaaccggccggtaaacggccgttacggcgtttaaggtacccttaagttacgtaggaccggagtaacgtcgtagacggttcggacgtcggtaacccgagtaaccgggaggttttaccggccccggttaccccgggtacgggg

SEQ ID NO: 232142 - DNA, 620 bp, Homo sapiens
  misc_feature: GYAE6OF01BTKO2.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggtttccttgttgctattttaaaggtgtccagtgtgaggtgcagttggtggagtcgtgggggaaccttggtccagccgtggggggtccctgagactctcctgtgtagcctctgcgttcaccgtcagtagcaattacatgagcgtggggtcccgccgaggctccgagggtaaggggctggagtgggtctcgtagtttattatagcgagtcggaaccgcacacttcgacacgctccggcggaggggcagacttccacctatcctcccgaagacgaacctaacttaccaaacgtaaacctaacccttttactaccttacagtatacgaaacacgtcctagaagacggaccggacgggactcgggacttcgtactatttacgtggtcgacgaggtacggtacctacggtcgggtcgtcggtaccgtaggaccggtaggggtttcggttccccggaccccgggttaccgggggg

SEQ ID NO: 232143 - DNA, 685 bp, Homo sapiens
  misc_feature: GYAE6OF01B4GOE.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcttgggttttccttgttgcttattttaaaaggtgtccagtgtgaggtgcagttggtggagtcgtgggggaaccttggtccagccgtgggggtcctgagactctctgtgtacgcctctgtcgttcaccgtcagtagactaattacatgacgcgtcgggtcccgaccgacggccgtccggaggggtaacgggggtcgtaggggtagggttcggggttcgtacgttaagttttaagtttagtaggacggtagttacgggaacccgcctaacgtaccgttacgaccgacgtaccgtcccgggacgggacggggacgaacgtacttaccacctactccctaccgaagaacgaacctaacttaaccgaaacgtaacccttacctttactactttacaagtactacgaacacgtccgtagacggtacgaccggtaggtccgtcgtactgttactagttcgtgacgtaggtagtacgtactacggtcggtccgtacggtcgacggtcggtacggggttccggtcccgggtcccgggtcccggggg

SEQ ID NO: 232144 - DNA, 265 bp, Homo sapiens
  misc_feature: GYAE6OF01BLLLV.5.27.C05.1.454.CMB.1.raw
  modified_base (261)..(265): a, c, t, g, unknown or other
  misc_feature (261)..(265): n is a, c, g, or t
tcagatcagacacgcacgaccggtgctcgatttagacgcgatcgaagggtttgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctcgttccccgccctcctccgtgtctgatctgacgcgggctggcaaggcgcatagnnnnn

SEQ ID NO: 232145 - DNA, 729 bp, Homo sapiens
  misc_feature: GYAE6OF01ADAET.5.27.C05.1.454.CMB.1.raw
  modified_base (381)..(381): a, c, t, g, unknown or other
  misc_feature (381)..(381): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcttgggttttccttgttgctattttaaaaggtgtccagtgtgaggtgcgtagttggtggagtcgtggggtaaccttggtccagccgtgggggtccctgagtactctccgtgtgtacgtcctcgtcgcgttccaccgtctagtagactaattacagtgagcgtcggtccgccaggctccgaggtacgggctgggagtcggtctcgtagtttattagtagcgtagtacggaaccncgtactaccgttcgctacgccgtccgacggtacggggcagtactttcccaacctcgtcctaccgaagtacgaactaacttacccgaaacgtaacccttacccgtttaacttacccgttacgaacgtactacgtaaaccgaggtcccgttaagacggaaccggtacccggtaacggtaccgttccggtcgttacgttaccgttaagtttacccggtggttaccggaacggtacggttaaccggttacccgttacggtccgggttaaccgtcccggttacccgggtaacgttacccgggtaagggtttccccggggttaccccggtaacccccggggttaccccgggggg

SEQ ID NO: 232146 - DNA, 797 bp, Homo sapiens
  misc_feature: GYAE6OF01D0MSE.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcgttgggttttccttgttgtcttaagttttaaaaggtgtccagtgtgaggtgcgtaggttggtggagttcggtacgggggtaaccgtttgggtaccgacggccgttcgggggggtccctagacgtaccgttcctccgtggtcgtacgtccgtcgtcgtccgttccgtaccgtacgtagtaacgtactaaattacagtggacgtccggtcgggtccgaccgacggtccgtaccggaggggtaacggggcgtagggtaggttcggtcttacgtaagttttattaagtacgtacggtacgtacggaaaccgtccgtaacctacgttcgacgtaaccgtacccgtccgggacgggacggggtactaacggtacttaccgaacccgtctacccgtacgaagtacgtaacctaaactaaccgaaacttaacccttacccgtttaacttaccgttaacgaagtaacgttacgaaaccgtacggtaccgtaaggaccggaaccgggtccggtaaaccgggtccggttccggttaacgtttccgttaacttaacgttaccgtggtcggtaacgtagtcgttacccgaggttccggtccgttcggaacccgtgggtacggtaccggggttcccggttcccggtacccggggtacccggg

SEQ ID NO: 232147 - DNA, 760 bp, Homo sapiens
  misc_feature: GYAE6OF01DINC8.5.27.C05.1.454.CMB.1.raw
  modified_base (589)..(589): a, c, t, g, unknown or other
  misc_feature (589)..(589): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttggctgagcgttgggttttccttgttgtcttaagttttaaaaggtgtccagtgtgaggtgcagttggtggagtcggtggggtaaccttggtccacggccggtgggggtccctgacgtactcctccgtgtgtacgcctctgtccgttccaccgtctagtacgactaattacagtgacgtcgtcgggtcccgccgacggtccgtaccggaaggggtaacggggtccgtaggggtacgggttcgggttacgttacgttaaggttttaagtttaagtacggtacgtaacggtaccggaacccgctaacccgtaccgttacgacgacgtacccgtcccggacgggacgggacaacgtaccttaccgaacctacgttcccacgaagaacgaacctaacgttaacccaaacgtaaacccttacccttttatcctaacgaagtacctacgaacgtacnccggtaaggacgaccggaccggacgggtccgtcggttacttcggttacttaagttccgtggtacggacggtaagttaccggttcctacggttcgggtacccgttcgggtaacccgagggtacccgggttacggggttttcccggtcccccgggacccggggtacccggggg

SEQ ID NO: 232148 - DNA, 732 bp, Homo sapiens
  misc_feature: GYAE6OF01EOUSB.5.27.C05.1.454.CMB.1.raw
  modified_base (215)..(215): a, c, t, g, unknown or other
  misc_feature (215)..(215): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccagtggtaggtttgggctgagtcgttggttttccttgttgtcttaagttttaaaaggtgtcctagtgtgaggtgcgtaggttggnggagtcggtaggggtaaccttggtccaggccggtcggggtcctgacgtcctcgtcctggtacgtacgtccgtcgtcgtccgttccgaccgtcgaagtacgataaacgttacagtggacgtccggtacggggtcccgtacgacggtccttaccggaaggggtacgggacgtggggtagtcgggtactacgtaagttttaagttagagtcgtaagtacggaactcacgtactacgcaacgccgtcggaggacggctagtactaccgaccctattcccacgaacgtacaaattaacccgtaaccgtaaactaaccttaaccctttagtaccgttactacgtaaggtaacaagtaccgcgtaacggagtaccgggaccgtaacggtcgtacggtaccttgtaactttaacgtcgttacggttacggacgtaaagtcccggttacacggttcggggaccttacgggaaccgttgtaaccgggtacgggtttcccggtccccgggacccggggttaacccggg

SEQ ID NO: 232149 - DNA, 965 bp, Homo sapiens
  misc_feature: GYAE6OF01BTSHQ.5.27.C05.1.454.CMB.1.raw
tcagatcagacacgcacgaccggtgctcgatttagacgcgatcgaagggtttggggctgggagaggagcccagcacgtgggattccgaggtgtttccattcagtgatctgcactgaacacagacggactcgccagtggtaggtttgggctggacgtcgtttgggttttcctttggttagtactttaagttttaaaaggtcgtacctaggttgtggtaggtgtcgtaggttgggtaggtacgttcgggttagggggtaacctttggtccgtacggtccgggtcgggggttccctgaaggtccttcctcgtggtacgtaccgtcgtcgtcgtaccgttccgaccgtacgtaagtaacgtacgttaaacgttaccgagttacgacggtccggtcggggtacccgtaccggtacgggtacccgtacgggtaaacggggtacgggtccggttaggggaggtttccggtacttaggttaagtttacgttaaggaccgtaggtacgtacgggaacctccgtaaacgttcgtacccgtaacgaccgtaccgacgggtcggaacgggtactaacggtactccgtaacctacgtacctacgtaacgtaacggtaactaaccgttaaaccgaaaccgtttaaacccttaaccccgttttaaagttcccgttaaggtaaaccgtaaccggtaactaaacccggttaacgggtaaacccgttacggtaaccgggaaacccgggtaacccggggttaagggttaaccccgtttacccggggtaacccttttaacggttaaccgtttaaaccgggttaccgttaccggttaacggtaaccgggtaaggtttaaaccccggtaccgggttacggttacccggggtaacccgttaccgggttaccggtaccgggtaaacccgggtttccgggggtttaaccccggttacccccggggtaccccccgggttaaacccgggggg

SEQ ID NO: 232150 - DNA, 694 bp, Homo sapiens
  misc_feature: GYAE6OF01DM0YC.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcgttgggttttccttgttgcttattttaaaaggtgtccagtgtgaggtgctagttggtggagtcgtggggaaccttggtccagccgtcgggggtccctgagactctcctgtcgtacgcctcgtcgtccgttccgtaccgtcgagtagactaattacagtgagtcgtcgggtcccgaccgacggccgtccggaagggtaacggggcgtaggggtagtgggttcgtacgtagtttaattagtagtcgacgtacggaccgactaccgtacgttaccgacacgtaccgtccggacggacgggacagtactaccactacttcctacgaagacgtaactaacttaaccgaacgtaacccttacctttaatccttacagtaactacgacacgtctacgagaaccggccgtaacggaccgtcggtactaggttacttacgttaccgtggtaccgacggtaggtaccgttacctacggttcgggccgttacggtacccggtacggtaccggtacgggtttcccgggttacccgggtacccggggtaccccggggg

SEQ ID NO: 232151 - DNA, 783 bp, Homo sapiens
  misc_feature: GYAE6OF01BN9IG.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccagtggtaggtttgggctggagtcgttgggtttttccttggttgtacttaagtttttaaaaaggtgtacctaggttggtgtagggtgtcgtaggttgggtgggtaggttcggtaggggggtaacctttgggtcccgaggtcccggttcggggggttcccctggtacgtacgttccgtccgttggtgtacgtcctcgtcgtcgttccgtaccgtctaagtacgtactaattacagtagtacgtcggtcgggtcccgccgtacggcctaccgggaaggggtaacggggtgtagggaggttcggtctacgtagtttaattagagtacgtagtacggtaccgactactacgtcgacacgtaccgtccggacgggtacgggactaagtacgttaccaacccgtatcccgtacaaggaacgtaaactaacgttaaccaaacgtaacccttacctttatcctaagaactagtaacgaactacgtaccgtaggaacgtacggaccggtaacggtaccgtccggtacgttgttaccttacgttacggtggtcggaacggtacggtacgttacggtaacgggttcggtacccgttacgggtacggtaacgggtccggttacgggggttacccggtaacccccgggtcccggggttaccggggg

SEQ ID NO: 232152 - DNA, 767 bp, Homo sapiens
  misc_feature: GYAE6OF01CW7MU.5.27.C05.1.454.CMB.1.raw
  modified_base (666)..(666): a, c, t, g, unknown or other
  misc_feature (666)..(666): n is a, c, g, or t
tcagatcagacacgcacgaccggtgctcgatttagacgcgatcgaagggtttgggctgggagaggagcccagcactgggattccgaggtgtttccattcagtgatctgcactgaacacagaggactcgccatggagtttgggctgagcgttggttttccttgttgcttaagttttaaaaggtgtccgaggttgtggaggtgcgtaggttggtaggtagtcgtagggggtaacctttggtccacggtccggtcggggggtccctggacgtactcgtccgtgtgtacgcctcgtgtccgttccgaccgtcgacggttacgactaattacgagtcggagtcggtcgggtcccgacgacggtaccgtccggtaaggggtaacggggtcgtaggggtaggtcgggttaccttagttaagtttatttagacggtagtaagttacggaaaccgtcaccgtacgttcgacgtacgccgtacccgggcggacggggcacggttacctccgacctacgttacctacgaagtaaccgaacctaaacttaccgaaacgtaaccctttaaccgtttacttaccgttaacgaacgtacgtacgtaaacgtacgtccgtagaacggacggtaccggtacgggtaccgtccggtcgttacctacgttaaccgttcgtacggnggtaaccggacgtacggtcgtaacggttccgggtaccgtacggtacccgtaggtacccgggttacgggttacggtaccccgggtacccggttaaccggggg

SEQ ID NO: 232153 - DNA, 691 bp, Homo sapiens
  misc_feature: GYAE6OF01A1EFX.5.27.C05.1.454.CMB.1.raw
  modified_base (350)..(350): a, c, t, g, unknown or other
  misc_feature (350)..(350): n is a, c, g, or t
  modified_base (384)..(384): a, c, t, g, unknown or other
  misc_feature (384)..(384): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttcctgttgctattttaaaaggtgtccagtgtgaggtgcagttggtggagtctgggggaaccttggtccagccgtggggggtccctgagactctcctgtgtagcctctgcgttcaccgtcagtagcaattacatgagctgggtcccgccaggctccgaggtaaggggctgggagtgggtctcgtagtttatttanagcgagtggaaccgcacacttcgcacgactccgnggagggcagacttacaccatcctaccagacgactaaacttaccgaaacgtaaccctacccttttaatccctttacgaagtaacgttacgaaaccgtacgtaccccgttaggaacggtaaccgggaccccggtaaagggtacccggttaccgggtacccgttaacggtttaccgtttaacgtttaccgttgggttaccggaccggtaagggtaccgttacccggtaacggttcggggtaccttcggggtaccgacgggtacgtagggggtttccgggttccccggtaaccccggggttacccgggggg

SEQ ID NO: 232154 - DNA, 778 bp, Homo sapiens
  misc_feature: GYAE6OF01CV9YS.5.27.C05.1.454.CMB.1.raw
  modified_base (323)..(323): a, c, t, g, unknown or other
  misc_feature (323)..(323): n is a, c, g, or t
  modified_base (610)..(610): a, c, t, g, unknown or other
  misc_feature (610)..(610): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagttggctgagctgggttttccttgttgcttattttaaaaggtgtccagtgtgaggtgcagttggtggagtcgtagggggaaccttggtccaggccgtggggggtccctgacgactctcctgtgtacgcctctgcgttcaccgttcagtagctaaattacagtgagcgtcgggtccgccgaaggtccnccgagggtaacggggctggggaggtcgggttctacgttaagtttatttaagtaggaccggtaattaccgggaaacccgtcgaaccgtacccgtttacggaccctaaacggtacccgttaccccgggacgggtaacggggggacccctaaaggtaccgtttacccaaccccgtaacgttcccctacccgaaacggtaaccgtaaacctaaacccgttttacccgaaaaacggtaaaccccttaccccctttttaagtaccctttacgaacgtaactaccggtaaaccncggtaccctaggaacgacggtaccccggaagggtacccttcgggcttagttccttaagtttccggtggttacgcggtaaacgtacggtacctacggtccggtacgttccggttaaccgacggtacggtacgggtttcccggttaccccggtccccgggtaaccggggg

SEQ ID NO: 232155 - DNA, 641 bp, Homo sapiens
  misc_feature: GYAE6OF01AN164.5.27.C05.1.454.CMB.1.raw
  modified_base (266)..(266): a, c, t, g, unknown or other
  misc_feature (266)..(266): n is a, c, g, or t
  modified_base (339)..(339): a, c, t, g, unknown or other
  misc_feature (339)..(339): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcaggttggtggagtcgtgggggaaccttggtccaggccgtggggggtccctgagactctcctgtgtagcctntcgcgttcaccgtcagtagcaattacatgacgtcgtcgggtccgccgaggcctccgagggtaaggggctaggngtgggtctcgtagtttattagtaggcgtagtacggaaccgcactacgtcgcacgacctccggcgaggggcacgacttccacctatccacaggacaactaactaccgaaacgtaacctaaccctttataccttacagtatacgaacacgcctagaacgacggaccggacggtaccgtcggtcttcgtaccttaacgttacgtcggtacgcggtaacggtcgttaccgacggtcgggtaccgttcgggtacccacgggtccgtaacggggttccgggttaccccgggaccccgggtaccggggg

SEQ ID NO: 232156 - DNA, 889 bp, Homo sapiens
  misc_feature: GYAE6OF01EQ8JB.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgcttaattttaaaaggtgtccagtgtgaggtgcagttggtggagtcgtgggggtaaccttggtccagtccgtgggggtccctgacgtactctcctgtgtacgcctcgtcgtcgttccaccgtcgagtagactaattacatggacgtcggtcgggtcccgacgacggtccgtccggaaggggtaacgggggcctaggggtacggttcgggttcctacgttaaggttttattttaagtacgtacggtaacgtacgggaaccccgctaaaccgtaccgtttacgacgtaaccggtaccgtccccgggtacggggaacgggggacctaacggttacttacccgaacccgtaacgttcccgtaacccgtaaacgggtaaccgtaaaccgttaaaaccctttaaaccccggaaaaaacgttaaaccccctttaacccccgtttttaacgttacccgttttaaccgaacgtaaacgtttaaccgaaacccgttaaccgtccccgttaaggggaaccggaaaccggggtaccccggtaacggggttaacccggttaccgggttaccgtttaaccggtttacccgtttaagtttaccggttcgggttacggaaccgggtacgttaccggttaccgtaaccggttcgggttaccggttaaccggacccggttagggacccggttaacggggttttccccggggaaccccgggttaccccccggggtaacgggggg

SEQ ID NO: 232157 - DNA, 788 bp, Homo sapiens
  misc_feature: GYAE6OF01CNQXJ.5.27.C05.1.454.CMB.1.raw
  modified_base (380)..(380): a, c, t, g, unknown or other
  misc_feature (380)..(380): n is a, c, g, or t
  modified_base (423)..(423): a, c, t, g, unknown or other
  misc_feature (423)..(423): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccagtggagtttgggctgagtcgttgggttttccttgttgacttaattttaaaggtgtaccgtagtgtgaggtgcgtaggttggtggacgtcgtagggggtaacccttggtaccgacggtccggttcgggggtccctaggacgtaccgttcctccgtggtcgtacgccttcgtcgtccgttaccaccgtactagtacgactaatacagtgacgtcgtcggtccgcgaggcctcggaagggtacggctgggnggtcggtctagttagtttattagacgacgtagtacggaacctnaactcgtccgactacgtaccgtcccgggacggtagggactaagtaccgttaccaacttacgtccgtaaccgaagactaaaccgtaacttaaccgaaacttaacccgttaccctttataccgttaacgagtaacgtaagaaccgtacgtaccggtaggaaaccgtccgggaaccggtacgggtaaccgttccggttgttacccggtttatttaaccggttacgttcgggtacggtaaccgggtaacggttaaccgttacccgggtacggttacgggtcccgttaacggtaacccggtacgggtaccccgggtttacggggggtttccccggttaacccccggggtccggggttaacccccgggggg

SEQ ID NO: 232158 - DNA, 643 bp, Homo sapiens
  misc_feature: GYAE6OF01DQHXS.5.27.C05.1.454.CMB.1.raw
  modified_base (383)..(383): a, c, t, g, unknown or other
  misc_feature (383)..(383): n is a, c, g, or t
  modified_base (397)..(397): a, c, t, g, unknown or other
  misc_feature (397)..(397): n is a, c, g, or t
  modified_base (419)..(419): a, c, t, g, unknown or other
  misc_feature (419)..(419): n is a, c, g, or t
  modified_base (485)..(485): a, c, t, g, unknown or other
  misc_feature (485)..(485): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcttgggttttccttgttgcttaattttaaaggtgtccagtgtgaggtgctaggttggtggagtcggtgggggtaaccttggtccaggccggtcggggggtccctgacgactctcctgtgtacgcctcgtgtccgttcaccgtcagtacgactaattacagtagagcgtcgggtcccgccgaggcctaccggagggtaacggggctggtaggtcgggtactgtaagtttattaagngcgagtcggaaccncactcgtcgcacgccgtccggnggacgggcagtacttaccactatccaccgaagacaactaactaccgaaactaaccttaccctttancctacagtactacgaacacgtccgtagaacgacggaccggaggtaccgtcggtcttacgttaccttaagttccgtggtcgacgaaggtcctcgtacgtcggtacccgtggtacccgaggtacggtagggttacccggtcccggtccccgggtacgggg

SEQ ID NO: 232159 - DNA, 826 bp, Homo sapiens
  misc_feature: GYAE6OF01BK9WD.5.27.C05.1.454.CMB.1.raw
  modified_base (523)..(523): a, c, t, g, unknown or other
  misc_feature (523)..(523): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctggagcgttgggtttttccttgttgtacttaagttttaaaaggtcgtccaggtggtggaggttgcgtaggtttgggtagggtaggttcggttacggggggtaacccgtttcgggtacccgacgggtcccggttcgggggggttacccctggacgtaccttccgttcccgttgggttacgtacgtcccttcgtcggtcccgtttaccgacccgttctaacggtacgactaaaactttacgatacggacggtcgttaccggggcccgccgaagggtcctacccggaggggtacggggccgtgggagggttcggtcctaggttagtttagttagtacgcgtagtacggaaccgctaccgacgttacgactacgcctccgggnggacgggtacaacggtctaccgacctactccgtaccgacgaacgtaactaacgtaaccaacgtaaccccttaacctttacttaccttacgaacgtactacgaaacctacgtaccgtagaacggtacggtaccggtacgggtacccgttacggtccgttacgttacgtttacttacggttcggtacgggtacggtaacggtcgttacccgttacgggtccgggtcgttacggtaaccccggtagggtacccggttaagggggtttcccggtttaccccggggacccccgggttaacccgggggg

SEQ ID NO: 232160 - DNA, 740 bp, Homo sapiens
  misc_feature: GYAE6OF01CB2LQ.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcttgggttttccttgttgtcttattttaaaaggtgtccagtgtgaggtgcagttggtggagtcgtggggaaccttggtccagccgtggggtccctgagactctctgtgtacgcctctgtccttcgaccgtcagtacgactaattacagtagacgtcgtcgggtcccgaccgacgggtccgtaccggaaggggtaaagggggcgttggggtaacgggttcggggttaccttacggtaagttttaagttttaagtacgggtccggtaaggttaccggaaacccggacctaaccgtaaccgttcgaaccgaacggtaaccgtcccgggacggtacggggacctaaggtacttaccgacctactccgtaccgaagaacgaacctaacttaaccgaacgtaaaccctacccttttactaccgttacgaagtaccgtaagaaccgaacgtccgtagaacggaacgccggtagtaccgtcggtccgttagtaccttagttaccgttggtacgtacggacgtaacggtcgacggtcggtaccggtcgtaccggtaacgccgggtagggttcccggtaaccgggtccccgggtaacggggg

SEQ ID NO: 232161 - DNA, 743 bp, Homo sapiens
  misc_feature: GYAE6OF01E4HCH.5.27.C05.1.454.CMB.1.raw
  modified_base (310)..(310): a, c, t, g, unknown or other
  misc_feature (310)..(310): n is a, c, g, or t
  modified_base (598)..(598): a, c, t, g, unknown or other
  misc_feature (598)..(598): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatgggagtttgggctgagcttgggttttccttgttgcttaattttaaaaggtgtccagtgtgaggtgcaggttggtggagtcggtgggggtaaccttggtccaggtccggttcggggggtccctggacgtacctccgtcctggtagtacgccttcgtcgtcgttccaccgtcgagtacnctaattacatggacgtcgtcgggtcccgcgacggcctaccggtaggggaacgggtcgtagggtacggttcgggttactacggttagttttaatttagtacggaccgtagtaccgggaacccgtactaaccgtacgtcgacctacgtacccggtccgggacgggaacgggtactaaggtaccttaccgaaccctacgtaccctacgaacggtaactaacctaaacttaacccgaaacgtaacccctttaacccgtttactacgttaaccaagttaacctaggtaaaccnccgtacgtacggaacggacggaccggtaacggtcgaccgtcttagtacttacgtcgtgacgaggtacgcgttagtacggtccggttacggtaccgtaccgtaacgggtggttacccggttcgggtccccggccccggtacggggg

SEQ ID NO: 232162 - DNA, 741 bp, Homo sapiens
  misc_feature: GYAE6OF01BBBYA.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtcgtggggggaaccttgggtccaggccgttggggggtccctgagactctcctgtgtagcctctgcgttccaccgtcagtagactaattacatgacgtcgtggtcccgcgacggcctaccgagggtaaggggccgtagggaggtgggtctcgtagtttacttagtagcgtagtacggaacccgcactacgttcgacgaacgtccgtccggacggacgggggcaggtacttaccgaacctacgtcccgtaccaggaacgtaaccaaactttaacccgaaacgtaaacccttaacccgttttaacttacctttacgaacgtaagtaccggtaaacgacgtacccgtaggtaacggaacggtaccccgggtaaggtacccgtaccgggttacttaccggtttacgttaaaccggttttcgtacggttcggacccgggttaaggtaccgggttacgtaacggttcgggtccgttacgggttaccgtacggaccgggttagggtttcccggggttccccggacccccgggttaccgggggg

SEQ ID NO: 232163 - DNA, 783 bp, Homo sapiens
  misc_feature: GYAE6OF01AVQSQ.5.27.C05.1.454.CMB.1.raw
  modified_base (732)..(732): a, c, t, g, unknown or other
  misc_feature (732)..(732): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccagtcggagtttggctgagcgttggttttccttgttgcttaagttttaaaaggtcgtccagtgtgaggtgcgtaggttgggtaggtacgtcggtacgggggtaaccttggtaccgacggtcccgggttcgggggtccctaggtacgtacctccgttccgtgttacgtacgtccgttcgtcgtccgttccgtaccgtcgaaggtagtaactaaacttaccgtagtacgtacgtccgggttaccgggtaccccgtaccgacgggtccgtaacccgggtaaggggtaaccggtcggtagggtacggttcgggtccttacgttaggtttaacttacgaacggtccgtaagtaaccggaccgctaacgtaccgttcgaaccgacggtaccgtccgggacggtaagggctacgtacgttaccgacgtacctcgaccgaagggtactaaactacccttaaaccggaaacttaccctacctttaactaccgtagaacgtaacgtacgaacacggtctaacggaaccgtcggtaacccggtcgtaaccgttaccgtcgttaacgactttaccggtatacggcgttaaacgggtctccggtatacccgggtntcccggtaacgccgaggtcgtaccgggttcccgtacccggccgtaccgggg

SEQ ID NO: 232164 - DNA, 626 bp, Homo sapiens
  misc_feature: GYAE6OF01DTZNO.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatgggagtttgggctgagcttgggttttccttgttgcttaattttaaaaggtgtccagtgtgaggtgctagttggtggagtcgtgggggaaccttggtccagccgtggggggtccctgagactctcctgtgtacgcctctgtcgttcaccgtcagtagctaattacatgagcgtcgggtccgccgaggcctaccgagggtaaggggctgggaggtgggtctcgtagtttattagtagcgagtcggaaccgcaacacgttcgactaagcctccggcggacggggcagtacttccactactcctccaagacgaacaacttaccaaagtaaccctaccctttactcttacagtactacgaacgacgccgtagaacggacgacccggtagggtaccttcgggtccttacgttcttaacttacgtcgagcgaagtacgttcacggtcggtccgtggacccgtaggccgtagggttccggtcccggccccggtaccggggg

SEQ ID NO: 232165 - DNA, 661 bp, Homo sapiens
  misc_feature: GYAE6OF01AT00T.5.27.C05.1.454.CMB.1.raw
  modified_base (283)..(283): a, c, t, g, unknown or other
  misc_feature (283)..(283): n is a, c, g, or t
  modified_base (383)..(383): a, c, t, g, unknown or other
  misc_feature (383)..(383): n is a, c, g, or t
  modified_base (422)..(422): a, c, t, g, unknown or other
  misc_feature (422)..(422): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtcgtgggggaaccttggtccaggccgtgggggtccctgagactctcctgtgtacgcctctgcttcaccgtcagtacnctaattacatgagccgtgggtcccgccgaggcctaccgagggtaacggggctgggaggtcggtctcgtagtttattagtagcgtagtcggaaccgcaacncgttcgactacgctccgcggagggcagtcttaccacctntacctaccgagacgtactaacgttaccaacgtaccttacccttactccttacgagtacgtacgaaccgtacgacccgtagaacgacggtaccggaacggtaccgttcggacctttaggtaccttaacgttccgtaggtaccggacgtaacggtcgttaccgacggttcggtaccgtccgggtaccgacgggtcgtaaccggggtttccgggttaccccggaccccggggttaccggggg

SEQ ID NO: 232166 - DNA, 961 bp, Homo sapiens
  misc_feature: GYAE6OF01D2LLP.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcttggttttccttgttgcttattttaaaaggtgtccagtgtgaggtgcgagttggtggagtcgtgggggaaccttggtccaggccgtggggggtccctgagacctctcctgtgtacgcctctgtcgttccaccgtcagtagacctaattacagtgacgccgttcggggtcccgccgacggtcctaccggaaggggtaagggggtctggggaggttcgggttcttacgttaaggttttaatttaacgtaggtacgtaacgttacgggaaacccgtcgtaacccgtaccgtttccggaccgtaacggtaacccggttcccgggaccgggggaaacgggggtaccgtaaacgggtaactttaccccgaaccccgttaacgttaccccgtaaccccggaaacgggtaacgtaaaaccccttaaaaccggttttaaccccccgaaaaaacggtttaaaaccccctttaaccccccgtttttttaacgtttacccgttttaacccgaaaacgggtttaaacgtttaaccggaaaaccccggtacggttacccccggttaaggggaaaccgggtaaccggggtaacccccgggtaaaggggttccccggtttaccgggtacccgttttacggtttaccgttttaaaccggtttaacccggtttagggttaccggtaaccgggtaacggttaaccggttcccgttaaacccgggtcggggttacccggtttcgggttaaaccccgcggggttaaccccggttaaggggggtttcccccgggtttaccccggggaaccccccggggtttaccccgggggggg

SEQ ID NO: 232167 - DNA, 749 bp, Homo sapiens
  misc_feature: GYAE6OF01ACGCC.5.27.C05.1.454.CMB.1.raw
  modified_base (177)..(177): a, c, t, g, unknown or other
  misc_feature (177)..(177): n is a, c, g, or t
tcagatcagacacgcacgaccggtgctcgatttagacgcgatcgaagggtttggggctgggagaggagcccagcactgggattccgaggtgtttccattcagtgatctgcacttgaacacagaggactcgccatggagtttgggctgagctgggtttcctgttgctattttaaaggngtccagtgtgaggtgcagttggtggagtcgtggggaaccttggtccagccgtcgggggtccctgagactctcctgtgtagcctctcgcgttccaccgtcacgtacgctaacttacattggacgtccgtcggggtcccgaccgaacgggtccctcccggaaggggttaacggggggtccttagggggtacggtttcgggggttcccttaccgttaacggttttagttttaacgtaacgggccggtaagttacgggaaccccgtcgtaaccgtacgtttaccggactaacggtaacccgtcccgggaccgggaggggggtaccaagggtacgtttacccgaaccgtacgttaccctacccgaaggaacgaacccttaaacgtttacccgaaaacggttaacccttaccccttttacgtaccttttacaagggtactacgaaacgacgtacctaggacgacggaccggacgggtacgtccggtacgtcgttaccgtacgttaccgtggtacgacgaggtacgtcgtacggtggtacgtcgtccgagtccgtagggtccgtccggcccggtcgggg

SEQ ID NO: 232168 - DNA, 667 bp, Homo sapiens
  misc_feature: GYAE6OF01BU626.5.27.C05.1.454.CMB.1.raw
  modified_base (614)..(614): a, c, t, g, unknown or other
  misc_feature (614)..(614): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcgttgggttttccttgttgcttaattttaaaaggtgtccagtgtgaggtgcgtagttggtggagtcgtggggaaccttggccagccgtcgggggtccctgacgtacctctcgtgtgtagcctctgtccgttcaccgtcagtacgactaattacagtaggagtcgtcggggtcccgaccgagggtcctaccggaagggtaaggggtcgtaggaggttcggggtcctacgtaagtttacttagtacggacgtaggtacggaacccgtcgaactacgttccggacaacggtacctcccggagggacgggacaaggtacttaccacgtatcctacgaagactaaacgtaactaccgaacgaaccttaaccctttatcctacgaagtatacgaaacacgtccgagaaccgtacgtaccggacgtccgtacggtctacgttagtacgttacgtggacgtacgagtacgtacnggtcggccgtagacccgaggtccgtaggtcggttacccgccggttaaccgggg

SEQ ID NO: 232169 - DNA, 809 bp, Homo sapiens
  misc_feature: GYAE6OF01A509C.5.27.C05.1.454.CMB.1.raw
  modified_base (623)..(623): a, c, t, g, unknown or other
  misc_feature (623)..(623): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggtagtttgggctgagtcttgggttttccttgttgtacttaattttaaaaggtgtccagtgtgaggtgctaggttggtggagtcgtagggggtaaccttggtccaggtccgttcggggggtccctaggacgtaccgtcctccgtggttacggtacgccttcgttacggtcgttacccgaccggttaccgaaggtaacgtacctaaaactttaacgaagttcggaaggtcccggttacggggtaccccgccgtaacggcccgttacccgggaaggggttaacggggcgttaggggaggtttcggggtactacggtaagttttaatttaacgtacggtacggaacgtacggaacccgtacaactaccgttacgaccgtaacggaccgtacccgggaacgggacgggtacctacgtacttacccactagtacccgtaacgaacgaacgaactaaccgttaaccgaaacgtaaccttaccctttaagtcctaanaagtactaagaaccgtacgccctagaaccggtacacccgggtaataccgtaccgtcgttaacgttacttaacgttcgacgttcggacgtaaacggtcgttaccgaaggttccgggtaccttaggggtaccctaagggttaccgggtaacggtttacccgggttcccggtaccccggggtaacgggg

SEQ ID NO: 232170 - DNA, 848 bp, Homo sapiens
  misc_feature: GYAE6OF01AWC3E.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccagtggtagtttgggctgagtcgttgggttttccgttgttgtacttaagttttaaaaggtgtcctagtgtggaggtgcgtaggttggtggtacggtcggtacgggggtaaccgtttcggtccgacggtcccggtcggggggtcccgtggacgtaccgttccgttccgtggtgtacgccttcgtcgtccgttacctacccgtacgtagtagactaacttacagtaggacgtcggtcggtcccgaccgacggtccgtaccggtaacggggtaacggggtccggttaggggtacgggttcggggttaccgttacggttaagttttaagtttaacgtacggtacgtacggttaaccggaacccgaacctaaccgtaccgttaccgaccgaacggtacccgtcccgggacgggaacggggtacgtacgtaccgttacccaaccgtacctcccgtaccggaagtaaccgtaaacctaaacgttaaccccgaaacggttaaccccttacccgtttaactccgttaacgaacgtaacgtaaccgaacgtaccgtacggtacgaaccgaccgggtaccggaacggtacccgttcgggtactttaggtaccttacgttacgttcggtaggtacgtacgttacgtaccgtaggttcccggtcgttaccggtacccgtaggttaacccgggtacggtttcccgggttacccggccccggggtacccgggg

SEQ ID NO: 232171 - DNA, 658 bp, Homo sapiens
  misc_feature: GYAE6OF01CKY17.5.27.C05.1.454.CMB.1.raw
  modified_base (539)..(539): a, c, t, g, unknown or other
  misc_feature (539)..(539): n is a, c, g, or t
  modified_base (607)..(607): a, c, t, g, unknown or other
  misc_feature (607)..(607): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagtcgttgggttttccttgttgtacttagttttaaaaggtgtcctagtgtgaggtgctaggttggtggagtcggtgggggtaaccgttggtaccgacggtccggttcggggggtcccctagacgtacctccgtccgttggtgtacgtccttcgtcgtccgttaccgaccgtcgaagtacgactaaattacagtacggacgtcgtcgggtccgccgacggccgtaccgtagggtaagggcgtggtaggtcggtactacgttagttattagacgtacgagtacggaaccgcacgtactcgacgacgaccgtacggcggacgggcgtagtactaccacctacgtcctaacgaagacaactaacgttaccaaacgtaaccttcctttataccgttanaagtcaagtacacggtcctaaggcgacggtaccgaggtacctcggtacttgtactaagttgtgacgtnacgtgtccaggtcgtctaggcacggtgtaggtcggtcccgacccgggtcgg

SEQ ID NO: 232172 - DNA, 882 bp, Homo sapiens
  misc_feature: GYAE6OF01BX7PU.5.27.C05.1.454.CMB.1.raw
  modified_base (763)..(763): a, c, t, g, unknown or other
  misc_feature (763)..(763): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcgttggttttctgttgctattttaaagtgtccagtgtgaggtgctaggttggtggagtcgtagggggaaccttggtccgacggccggttcggggggtccctggacgaccttccgttccgtggtgtacgcctcgtcgtccgttcaccgtcagtacgactaacttacaagtgacggtccgttcggggtcccaccggacggtacccgtaccggtaacgggggtaaacggggtcggtacgggtagggttcgggttacctttacgtaagttttaagtttaacgtaacggtaccggtaagtaccgggaaacccgtcctaaccgtaaccgtttaccgaccgtaaaccggtacccgtaccccggggtacggggtaacgggggtacctaaagggtacctttacccgaaccctacgttccccgtaaccgaaagggtaaccgtaaacttaaacccgttaacccgtaaaacgttaaacccccgttttaaacccttttactttaacccgttaaccgaaacggttaacgtaacccgtaaacgtccggtaccgtaacgggtaaccggacccggtaccgggtaacgggtacccgggttccggtaccgtttacgttacttaactttacgggnggttacggaaccggtaacgtccggtagttacccggtcgggtacccgttcgggaccgtaacgggtccgggttaacgggggtttccccggttcccgggacccccggggttaaacccggggg

SEQ ID NO: 232173 - DNA, 764 bp, Homo sapiens
  misc_feature: GYAE6OF01DI3QE.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagtcttgggttttccttgttgacttaattttaaaaggtgtccagtgtgaggtgctaggttggtggagtcgtggggtaaccttggtccagccgtgggggtccctgagactctccgtgtgtacgcctcgtgtccgttcgaccgtcagtacgactaactttaaccagtcgacgtcggtcggggtcccgtacccgacggtccgtacccggtaaggggtaaacgggggtccgttggggtaacggttggggttacccttagtaaaggttttactttaagttaggacgtaagtccggaaaccgctaaccgtacgtttccgacgtaaccggaccgttacccggcgggaacggggtcaacggttattacccgaaccaagttccctaaccgaagaacgaaccttaaactaccgaaaacgtaaacctaccccttttaagtccttaccgaagtactagtaaacgaccgtcgtaacggaagaccgtacccggaacgttccggtacggtacgtttcgacgtttaaccttggttacgtcgggtacgtaagtaccggttagtaccgttcgggtaccttcggtaccgaccggttagtacgggtttccgggtcccgtaccccgggtaacccggggg

SEQ ID NO: 232174 - DNA, 539 bp, Homo sapiens
  misc_feature: GYAE6OF01ELPYN.5.27.C05.1.454.CMB.1.raw
  modified_base (460)..(460): a, c, t, g, unknown or other
  misc_feature (460)..(460): n is a, c, g, or t
  modified_base (489)..(489): a, c, t, g, unknown or other
  misc_feature (489)..(489): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagcctggggggtccctgagactctcctgtgtagcctctgcgttcaccgtcagtagcaattacatgagctgggtcccgccaggctccgaggtaaggggctggagtgggtctcagttattatagcgatggaaccgcacacttcgcagactccgcgaggggcagattcaccatcctccagagacaattccaacgaacaccctttatcttcagatagaacagcctgagagccgaggacncggtctgtctattcgtgtgcgagtacgtnacgtggcctgggtcccgaggcagggtcggttccggacccccggtcggggg

SEQ ID NO: 232175 - DNA, 607 bp, Homo sapiens
  misc_feature: GYAE6OF01EF3VB.5.27.C05.1.454.CMB.1.raw
  modified_base (308)..(308): a, c, t, g, unknown or other
  misc_feature (308)..(308): n is a, c, g, or t
  modified_base (545)..(545): a, c, t, g, unknown or other
  misc_feature (545)..(545): n is a, c, g, or t
  modified_base (561)..(561): a, c, t, g, unknown or other
  misc_feature (561)..(561): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttcctgttgcttattttaaaaggtgtccagtgtgaggtgctagttggtggagtcgtgggggaaccttggtccagccgtggggggtccctgagactctcctgtgtagcctctgcgttcaccgtcagtagctaattacatgagtcgtgggtcccnccgaggcctaccgaggggtaaggggctgggagtgggtctcgtagttatttagagcgtagtacggaacccgcacgtacgttcgactaacgaccgtccgacggagggacaggtattccaacctatccctaccgagacgactaacttaccaaacgtaacctaccctttatcctttacgaagtatacgaactacgcctaaggacgagcccggagggtacctcggacttcgtacttattacnggtcgacgtagtcgtnacgtggcctgtccgagtcgtaggttcgggtcccgcccggtacgggg

SEQ ID NO: 232176 - DNA, 705 bp, Homo sapiens
  misc_feature: GYAE6OF01BPIBP.5.27.C05.1.454.CMB.1.raw
  modified_base (191)..(191): a, c, t, g, unknown or other
  misc_feature (191)..(191): n is a, c, g, or t
  modified_base (378)..(378): a, c, t, g, unknown or other
  misc_feature (378)..(378): n is a, c, g, or t
tcagatcagacacgcacgaccggtgctcgatttagacgcgatcgaagggtttggggctgggagaggagcccagcactgggattccgaggtgtttcctattcagtgatctgcactgaacacagaggactcgccatggaggtttgggcgtgagctgggttttccttgttgcttatttaaaggtgtcagtgtgnggtgcagttggtggagtctgggggaaccttgtcgagccgtgggggtcctgagctctcctgtgtacgcctctgtcgttcaccgtcagtagactaattacatagagtcgtgggtccgccgaggcctaccgaggggtaaggggctgggtaggtgggtctcgtagtttatttacagcgtagcggaacccgnaccgtacttcgcacgtaccgtcggacgggacggggcaagtacttaccaccactccgtaccgagtaacgaactaactacccaaagtaacccttaaccctttatccttacaagtagtacctaacgagtacccgtagaacggaacgtacccggaacgggtacccgttacggtccgttagttaccgttaacgtttaccgtacggttaggaccgtaacggtaacggttacccgacggttccggtacggttcccgggtaacctaaccgggtaccgggttaaggggtttccccggggtttaaaccccgggtacccccggggtaaccccgggggg

SEQ ID NO: 232177 - DNA, 608 bp, Homo sapiens
  misc_feature: GYAE6OF01EU1WM.5.27.C05.1.454.CMB.1.raw
  modified_base (473)..(473): a, c, t, g, unknown or other
  misc_feature (473)..(473): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctatttaaaggtgtccagtgtgaggtgcagttggtggagtcgtggggaaccttggtccagccgtggggggtccctggacgactctcctgtgtagcctcgtgcgttcaccgtcagtagctaattacatgagcgtcgggtcccgcaggccgtccggggtaaggggctggaggtcgggtctcgtagtttattgtagcgtagtggaaccgcactacttcgcacgacgtccggaggtaggggacaggtacttccaccgtatcctaccgagaacgacttaaactaccaaacgtaacctacctttacttctaganactacgaacacgcctagacgacgccgggagcgtcggcttacgtctacttacgtgtcgacgtagtacgtcgagtcggtccgttcgtaccgtacgtcggtacgggttcgttcccggaccccgggtcggggaacccgg

SEQ ID NO: 232178 - DNA, 913 bp, Homo sapiens
  misc_feature: GYAE6OF01BM0KN.5.27.C05.1.454.CMB.1.raw
tcagatcagacacgcacgaccggtgctcgatttagacgcgatcgaagggtttggggctgggagaggagcccagcacgtgggattccgaggtgtttccattcagtgatctgcactgaacacagaggactcgccagtggagtttggctgagtcgttcggttttccttgttgtacttaagttttaaaggtcgtaccagtggtgaggtgtcgtaggttggtcggtacggttcggtacgggggtaacctttggggtcccgtacgggtcccgggttcggggggtccccttagggtaaccgtaccgttccgttccgttggtcgtaccgtcccgttcgtcggttcccgttaccgtacccggtacgtaacggtacgtaactaacttacgtaatggacggtccggttcggtccccgaccggtacggtcctaccgggtaagggtaacggggtcgtaggggtacggtcgggttcctacggtttagttttaagttacgtaacggtcggtaacggttacccggaaccgaaccgtaccgttaaccgttaccggaaccgtaaccggtacccggttaccccgggacggggtaacgggacctaaccggtaaccttacccggaacctacgtaccgttaccgaaacgggtaacctaaaccgttaaacttaacccgaaacgttaaccccgtttacctttaccgtaacttacggtaagtaaccgtacgtaaccgcgttaaccggaacggacgggtaacccggtacgggaacccgttaccggttacccgtcgtttaccgttaacgtttacggtcccggttaggtaccccggttaggtaacgtaccgggttactaccgggtcggtccgttacgggtacccgtacggtccggttaccgggtttaccccgggttccccggacccggggttaacccgggg

SEQ ID NO: 232179 - DNA, 737 bp, Homo sapiens
  misc_feature: GYAE6OF01ECI9L.5.27.C05.1.454.CMB.1.raw
  modified_base (270)..(270): a, c, t, g, unknown or other
  misc_feature (270)..(270): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcttggttttccttgttgcttattttaaaggtgtccagtgtgaggtgcagttggtggagtcgtgggggtaaccttggtccaggtccgtcgggggtccctgagaccttcctcctgtgtagcctntgtcgttcaccgtcagtagctaattacatgagtcgtcggtcccgccaggccgtaccgagggtaacgggcgtgggacggttggtactcgtaagtttatttagaggacgtagtacggaacctcaaccgtacttacgactaacggaccgtcccggagggacggggcaaaggtaccttaccaacccgtacgtacctacccgaagaacgtaaactaaaccgttaacccgtaaaacgtaaaaccccttcccttttaactacctttaaccgaagtaacgtacgaaacctaccggtaccgtaaggaacggtaccggaccggtaacgggtaccgttacgggtactagggtttaccttaagttaacccgttggtacggaccgtaggtaaccgttcaacggttcggtaccgtaccgggtaccgtacgttaccgggacggggtttaccgggttcccccggaaccccgggttacgggggg

SEQ ID NO: 232180 - DNA, 627 bp, Homo sapiens
  misc_feature: GYAE6OF01B4JX1.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtcgtgggggaaccttggtccagccgtgggggtccctgagactctcctgtgtagcctctgcgttcaccgtcagtagcaattacatgagcgtgggtccgccgaggcctccgagggtaggggctggagtgggtctcgagtttatttatagcgagtcggaaccgcacacttcgcacgacctccggcggacggggcaggtacttccgaacctactcctaccgaagaacgtaactaaacttacccaaagtaaccctaacccttttatcctttacagtactacgaacctagccctaggacgacggaccggaacgggtaccgtccggcttcgtacttacttacgtggtcgacgagtacgttacacggtcggaccgtcgggtaccacggtaccggtagggttccgggttcccggcccccgggtacggggg

SEQ ID NO: 232181 - DNA, 675 bp, Homo sapiens
  misc_feature: GYAE6OF01D1SZJ.5.27.C05.1.454.CMB.1.raw
  modified_base (417)..(417): a, c, t, g, unknown or other
  misc_feature (417)..(417): n is a, c, g, or t
  modified_base (532)..(532): a, c, t, g, unknown or other
  misc_feature (532)..(532): n is a, c, g, or t
  modified_base (612)..(612): a, c, t, g, unknown or other
  misc_feature (612)..(612): n is a, c, g, or t
tcagatcagacacgcacgaccggtgctcgatttagacgcgatcgaagggtttggggctggggagaggagcccagcactgggattccggaggtgtttccattcagtgatctgcactgaacacagaggactcgccagtggagtttgggctgagtcgttgggttttccttgttgtcttaagttttaaaaggtgtccagtgtgaggtgctagttggtggagtcggtggggtaaccttggtccgaggccggtcggggggtccctaggacgtcctccgttccgtgtcgtacgtcctctgtcgttcaccgtctagtacactaattacagtgagcgtcgggtccgccgacggtctaccggaaggggtaggggcgtgggtaggtcgggtctacgtaagtttattaacgtgcggtagtacggaaccnctaacgtacgtcgacgtacggaccgtccggacgggacgggactaagtcttaccactacgtcctacgacgacgtaactaactaccgaaacgtaaccttacctttatcgtacagtanacgtaacgacgcctaggaacgacggaccggacggtacgtcggttattcgtacgttactctggtacgaggtagcgttaacncggttcggccgttagaccgtacggtcggtaaccggtttcggtaccccgggcccgggtacgggg

SEQ ID NO: 232182 - DNA, 1049 bp, Homo sapiens
  misc_feature: GYAE6OF01EF2HY.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccagtgggtagtttgggctggagtcgttgggttttccttgttgtacttaagttttaaaaggtgtcctagtggtaggaggtgcgtaggttgggtgggtaggttcggtacggggggtaacctttcgggtaccgtacgggtcccgggttcgggggggttcccttaggaacggtaccttccgttccgttggttacggtacgtcccgttcgtcggtcccggttaccaccggtcgtaaggtaacgtactaaacttacgtagtaggacggtcggttccggggtccccgcggaccgggtaccgtaccgggtaaggggtaacggggtcggtaggggtacgggttcggggttaccttagttaagttttaagttaacggtacggtaccgtaggtaccgggaaacccgtcgaaccgttaccgttcggaacgtaaccggtacccggtaccgggaaccgggggtaagggtaccgtaaacggttacctttaaccccgaacccgtttaacggttaccccctaaacgggtaaccggtaaaacccggtaaaacccttaaaacccggtttaaaacccccgaaaaacggtttaaaaccccctttttaaaccccgtttttaatcccccgtttaaaagaaacggttaaacgtaaacccggtaacccggttaacccggtacccgggttaaacggaaccggggtaaccccggtaaccccggggaaccggggttaaccccggtttcccgggttactttaacccgggtttaaaccctttttaacgggccgttacgggggttaaccgggaaaccggtttacgtacccggtttaccgggaacggtttcccgggttaccgtaacccggggaccggtagggttaccccgggttacggggggtttaaccccccggttaacccgggtaaccccccggggggtaacccggggg

SEQ ID NO: 232183 - DNA, 616 bp, Homo sapiens
  misc_feature: GYAE6OF01E1YX6.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtcgtgggggaaccttggtccagccgtgggggtccctgagctctcctgtgtagcctctgcgttcaccgtcagtagctaattacatgagcgtgggtcccgccaggctccgagggtaggggctggaggtgggtctcgtagttatttatagcgagtcggaaccgcactacgttcgacacgacctccggacggagggcagtacttccacctatcctaccaagaacgaacctaacttaccgaaacgtaacctaacccctttactaccttacgagtactacgaacacgccgtagaacgacggaccggaggtaccgtcggacttcgttacttacgttacgtcgtacgacgtaggtacgtcacggtcggtcgtcggtaccgacggtacgtagggttccggttcccggccccggtcgggg

SEQ ID NO: 232184 - DNA, 730 bp, Homo sapiens
  misc_feature: GYAE6OF01AE9ZF.5.27.C05.1.454.CMB.1.raw
  modified_base (555)..(555): a, c, t, g, unknown or other
  misc_feature (555)..(555): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagttgggctgagcttgggttttccttgttgcttaattttaaaaggtgtccagtgtgaggtgcagttggtggagtcgtgggggaaccttgggtccaggtccggtggggggtccctgacgactctccgtgtgtacgcctctcgtcgttccaccgtcagtacgactaattacatggagtcgtcgggtcccgccgacggtcctaccggaagggtaacgggggctagggtaggtcgggtctacgtaagttttagtttagagcgtagtacgggaaccgacaactaccgttaccgacgtaacgtaccgtcccgggacgggtacggggactaacggtacttcccaaccgttactcccgtacccgaaggaacgtaacctaacgttacccaaacgtaacccttaccctttatcttacagtactacgaacncggaccctaggaacgacggaacccggagggtacccgtcggtaccgttagtaccgtttacttacggtgggttacgacgggtaacgcggttaccctacggttcgggccttccgggtaccctacgggcccggtacgggggtttacccgggtttacccggcccccggggtacccggggg

SEQ ID NO: 232185 - DNA, 616 bp, Homo sapiens
  misc_feature: GYAE6OF01ADRT5.5.27.C05.1.454.CMB.1.raw
  modified_base (263)..(263): a, c, t, g, unknown or other
  misc_feature (263)..(263): n is a, c, g, or t
  modified_base (482)..(482): a, c, t, g, unknown or other
  misc_feature (482)..(482): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggtttccttgttgctattttaaaaggtgtccagtgtgaggtgcagttggtggagtcgtgggggaaccttggtccagccgtggggggtccctgagactctcctgtgtagcctntgcgttcaccgtcagtagcaattacatgagctgggtcccgccagggctccgagggtaacggggctgggaggtgggtctcgtagtttattagtaggcgtagtaggaaccgtcactaccgttcgacacgactccggcgaggggcaggactttcaccatcctaccagacgactaaacttacccaagaaccttaccctttaatccttacagacttagaaccanccctaggacgtacggaccggaggaccgtcggctacgttacttaacgttacgtgtggaccgtaggtacgtccgaacgtcggccgttcggtaccgtacggaccgtagggtccggttcccggcccggttaccggggg

SEQ ID NO: 232186 - DNA, 626 bp, Homo sapiens
  misc_feature: GYAE6OF01A42HE.5.27.C05.1.454.CMB.1.raw
tcagatcagacacgcacgaccggtgctcgatttagacgcgatcgaagggtttgggctgggagaggagcccagcactgggattccgaggtgtttccattcagtgatctgcactgaacacagaggactcgccatggagtttgggctgagctggttttccttgttgtctattttaaaaggtgtccagtgtgaggtgcaggttggtggagtcgtgggggaaccttggtccagccgtgggggtccctgagacctctcctgtgtacgcctctgcgttcaacgtcagtagcaaattacatgagcgtcggtccgccgacggcctaccgagggtaacggggcgtagggtaggtgggtacctcgtaagtttattagtaggtacgagtacggtaaccgacacgtaccttacgactaacggaccgtccggacggagggcaagtacttccacctatccgtaccaagacgaactaaacgttaccgaaacgtaaaccttaccctttatacctttacgaagtactacgaactcgcctaaggacgacgcggtacggtactcggtctcgtacttaacgttctacgtgacgtagtactgacgtggcctcgtacgtgacgtgggtccgttccggacccggtcgggg

SEQ ID NO: 232187 - DNA, 764 bp, Homo sapiens
  misc_feature: GYAE6OF01BJWA9.5.27.C05.1.454.CMB.1.raw
  modified_base (258)..(258): a, c, t, g, unknown or other
  misc_feature (258)..(258): n is a, c, g, or t
  modified_base (299)..(299): a, c, t, g, unknown or other
  misc_feature (299)..(299): n is a, c, g, or t
tcagatcagacacgcacgaccggtgctcgatttagacgcgatcgaaggggtttggggctgggagaggagcccagcactgggattccgaggtgttccattcagtgatctgcactgaacacagaggactcgccatggagttgggctgagctgggtttcctgttgctatttaaaaggtgtccagtgtgaggtgcagttggtggagtctgggggaaccttggtccagccgtgggggtccctgagactctcctgtgtagcctntgtcgttcaccgtcagtagcaattacatgagctcgggtccnccaggctaccgagggtaacggggctggaggtgggtctcgtagttacttatagcgagtcggaaccgcacgtaccttcgcaaggaccctccgggaccggagggggtcctaaacggtactttacccgaacccgtactacccgttaccccgaagggtaaccgtaaaccgtaaaacgttttaccccgaaaacggttaaaaacccctaacccccttttttaaacgttacccggttttacccaaacggttaacgttaacgaaaacccgtaacggttaccccgttaggaaacgggtaaccggtacccccgggtaagggtaaacccggttcccgggaaccgttacggttaccgttaaacgtttacgtacgggtacggtaccggtaaggtacgttacgaaccggttcgggtccgttacgggtcctaacgggccgttaaggggttcgggttccccggaccccgggttaccgggggg

SEQ ID NO: 232188 - DNA, 634 bp, Homo sapiens
  misc_feature: GYAE6OF01BZSS7.5.27.C05.1.454.CMB.1.raw
  modified_base (303)..(303): a, c, t, g, unknown or other
  misc_feature (303)..(303): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagccgtggggggtccctgagactctcctgtgtagcctctgcgttcaccgtcagtgctaattacatgagcgtgggtccnccgaggcctccgagggtagggcgtaggaggtcgggtctcgtagttattagtacgcgagtacggaaccgcacacttcgacacgacctccgcggacggggcaggacttccaactatcctaccgagaacgaactaattaccaaagtaacctaaccctttatccttacagacgtcgaaactacgcctaggaacgaacggacccggaaggtaccgtcggtacttacgtacttaattaccgttaggtacgcggaggtacgttacgtaaccggtcgggacttccgggacccgtagggtcgagggtttccgggttacccggcccccgggtaccgggggg

SEQ ID NO: 232189 - DNA, 914 bp, Homo sapiens
  misc_feature: GYAE6OF01A4RO4.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggtagtttgggctgagtcgttgggttttccttggttgtacgtttaagtttttaaaaggtgttacctaggttggtggtagggttgacgtaggtttgggtgggtaacggttcggttacggggggtaaccttttgggtacccgtacggtcccgggttcgggggggttaccctaggtaccgtaccgttccgttccgtggttcgtacgtcccttcgtcggtccgttaccgacccggttcaagttacggacttaaatttaaccgagttacggacggtccgttacgggggtcccctaccggtacgggtacccttaacccgggaaggggttaacgggggtccgtaggggtacgggttcgggttactccgttaaaggttttaactttaaagtagggaccggtaagttaccgggaacccgtactaacccgttcgttaccgacgtaacggtacccgtaccgggaccgggtacggggacctaaggttacccgtttaaccaaccccgttacgtacccgttaaccgaaacgggtaaccgtaaaccctttaaacgttaaaccccgtaaaaacggttaaaaccccccttttacccgttttaaacctttaccggtttaaacccgaacgtaacgttaaccggaacccgtaacgtacccggtaaggaaccggtaccggaacggtacgtaccggtccggtacgttccgtacgttaacgttgttggtaccgcgtaaggctttacgcggttcgccgttcggacgacggtcgtaacggtcgggttccccggacccgggtaccgg

SEQ ID NO: 232190 - DNA, 772 bp, Homo sapiens
  misc_feature: GYAE6OF01BWPCI.5.27.C05.1.454.CMB.1.raw
  modified_base (320)..(320): a, c, t, g, unknown or other
  misc_feature (320)..(320): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcgttgggtttttccttgttgtcttaatttttaaaaggtgtccagtgtggaggtgctaggttgggtggaggtcggtgggggtaaaccttgggtccaggtccggtggggggtccctgacgtactcctccgtggtgtacgtcctctggtccttccacgtacagtagactaatacntggagtcgtcgggtccacgacggtcctccggaagggtaacggggcgttgggacgtgggttctacgtagtttaagtttagaggtacgtagttaccggaaccgtaccgaacgttaccgttaccggacctaaccggtaacccgttccggggaccggggacggggaactaaccggttacttaccgaccctaagtttccccgtaagaacccggtaagtaaccctaaaccgttaaaccgaaacccgtttaaaaccccttacccttttaagtcccgtttaacgaacgttacgtaaccggaactaacggttaccgaaggtaaccgacggacccgggtacgtccgttacggtacttacgttactttaacgttaccgttggtacgacgttcggaaacgtcgtaacggcgtaccgttagaccgtagtcggtaaccgggttcggtaccccgaccggggtacggg

SEQ ID NO: 232191 - DNA, 687 bp, Homo sapiens
  misc_feature: GYAE6OF01BYVO4.5.27.C05.1.454.CMB.1.raw
  modified_base (360)..(360): a, c, t, g, unknown or other
  misc_feature (360)..(360): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttggctgagcttgggttttccttgttgctattttaaaaggtgtccagtgtgaggtgctagttggtgagtcgtggggaaccttggtccgaggtccgtgggggtccctggacgtaccgtctcctgtgtacgcctcgtgcgttcgaccgtcagtagctaattacatgagcgtggtccgcacggctaccggaggtagggctggaggtggtctcgtaagttattagngcgtagtacggaacgcactacgttcgacagtaccgtcgcggtacgggcagtacttacacctatctacagtaacgacttaaactaccgaagtaaacccttacctttacttacgtcaaacgtaacgtacgaaacgtacgtacccgttagaaacggtaccggaaccccggtagggtaaccccgtacggggttccttcggttacttaaacgtttaccgtacgggtacgtaccggtaagtaccgttcgtacggtaggacccggttcgggtaacccgtaaggtacccggttaagggttcccggggtttaaccccgccccgggttaaccggggg

SEQ ID NO: 232192 - DNA, 663 bp, Homo sapiens
  misc_feature: GYAE6OF01BIBUD.5.27.C05.1.454.CMB.1.raw
  modified_base (280)..(280): a, c, t, g, unknown or other
  misc_feature (280)..(280): n is a, c, g, or t
  modified_base (353)..(353): a, c, t, g, unknown or other
  misc_feature (353)..(353): n is a, c, g, or t
  modified_base (368)..(368): a, c, t, g, unknown or other
  misc_feature (368)..(368): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttcctgttgctattttaaaaggtgtccagtgtgaggtgcagttggtggagtcgtgggggtaaccttggtccagccgtgggggtccctggagacctctcctgtgtacgcctctgtcgttcaccgtnagtagctaattacatgagctcgggtccgccaggcctccgagggtagggctggagtggtctctagtttatttanagcgagtcggaaccncacacgttcgcagaccgtcggacggaggggcaaggtacttaccgacctatcctaccgagaacgaactaacttaccgaaacgtaacccttaccctttataccgttacacgtaacttacgaaaccacggtccctagaacggacggcccggaacggtaccgttaccgggcttaggttacccttaagtttcgttaggtaggtaccgtaagggtacgtacccgtaacggtcgggtccgttcgggtaaccgacggtccggttaagggttcccgggtttcccgacccccggggttacggggg

SEQ ID NO: 232193 - DNA, 689 bp, Homo sapiens
  misc_feature: GYAE6OF01DU4GH.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcttgggttttccttgttgcttaatttaaaaggtgtccagtgtgaggtgcagttggtggagtcgtgggggaaccttggtccaggccgtgggggtccctgagactctcctgtgtagcctctgcgttccaccgtcagtagctaatacatgagcgtcgggtcccgccgacggctaccgaggggtaacggggctgggaggtgggtcttctagtttatttagagcgagtcggaaccgactaacaccgttcgacacgacctccggcggaggggcaaggtacttccactactactaccgaagaacgaactaacttaccgaaactaaaccgtaacccttttactaccttaccgaagtactaacgaaacgtacgacccgttggaaggaacggtacccggaacggtaccgtccggtacgttcgttaccttagttaccgtggtacgtaacggtaggtaaccgtctaaccggttcggaaccggttcgggacccggtacgggtaccgtaccggggtttacgggttccccgggtaaccccggggttacccgggggg

SEQ ID NO: 232194 - DNA, 755 bp, Homo sapiens
  misc_feature: GYAE6OF01B737B.5.27.C05.1.454.CMB.1.raw
  modified_base (741)..(741): a, c, t, g, unknown or other
  misc_feature (741)..(741): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttggctgagctgggttttccttgttgctattttaaaaggtgtccagtgtgaggtgcaggttggtggagtcgtgggggaaccttggtccgagccgtcggggggtccctggacgtacccctcctcgtggtacgcctcgtcgtcgttcgtacccgtcgtacgtaacggactaacgttaactaacgtagtaaggtccggtcgggtccccgggtcccgaacgggtccgttaccggtaacggggtaaagggggccggttacgggtagggttcggggttcgtaccgttaggtttaacgttttaagtacggtacggtagtaacggggaccgtaccacgtaaccttcgactacgaccgttccggacgggagggacgacgtaacgttcaaccgtctactaccgacgtaacggaacctaacttaacccgaaacgtaaccttaaacccgtttactacgttaccctaagtaacgtaacgaacgtacgaccctaggaacgtaacggaccgacgggtaacgccggtatcgttactaactacgttcgtacggcgtaacgtacggtcctaagtcggtcgacggttcccacggacttacgggttccggccggttccccggnggggtaaccccggg

SEQ ID NO: 232195 - DNA, 755 bp, Homo sapiens
  misc_feature: GYAE6OF01DS4V5.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggtagtttgggctgagtcttgggttttccttgttgtacttaagttttaaaggtgtccagtgtagaggtgcgtaggttggtggagtcggtagggggtaaccttgggccaggccggtcgggggtcctgacgtacctctcctgtgtagcctcgtcgtcttccaccgtctagtacgactaattacgatggagtcgtcgggtccgcgacggtcgtaccggaagggtacgggcgtagggtaggtcggtatacgttaagtttattaagtaggacgtaagtacggaaccgtctaaccgtaccgttacgacgtaaccggtacccgtaccggacgggaagggtctaaacggttacttaccgaaccgtactacccgtaccgaaagtaccgtaaactaaccttaaccgaaaaccttaaccgtttaccctttagtccttaacgaatacgtaacgaactacgtcgtacggaacgccggaaccggtacggtaccgttccggtacggtttacgttactttaacggttacgtggtaccggaagttacggaccttcggaacggttccggaccgttacgggaacccgttgggtacccggttagggggtttaccctccccggggtccccgggtaaacggggg

SEQ ID NO: 232196 - DNA, 885 bp, Homo sapiens
  misc_feature: GYAE6OF01BQ2RE.5.27.C05.1.454.CMB.1.raw
tcagatcagacacgcacgaccggtgctcgatttagacgcgatcgaagggtttggggcgtgggagaggagcccagcacgtgggattccgaggtgtttccattcagtgatctgcactagaacacagaggactcgccagtggtaggtttgggctgagtcgtttcgggttttccttggttgtactttaaagttttaaaaggtgttaccgtaggtggtggtagggtgcgtaggttgggtagggtaggttcgggtacgggggtaaccgttcggtaccgacggtccgggtcgggggtccctggacgtccgtccgtccgtgtacggtacgtccgtcgtacgtccgttccgaccgtacgtagtacgtactaactactagtaggacggtcggtcggccgccgacggtccgtacggaaggggtaacggggtcgtagggtcggttcggtacttacgttaagttttaagttagtacggacgtaacggtacggaacctaccgtaaccgtaccgtaccgaccgtacggtaccggtaccgggacgggacgggtactaacgtaccttaccgaacctaccgtaccgtaaccgaacgtaacgtaaaccgtaaaccgtaaaccgtaaaccgtaaacccttaaccctttaaccgttacgttaacgtaacgtaacgtaaccgtaaaccgtacgtacctacgggggggggggggggggggggtaacgaaccgggtaaccggtaaccgggtaccggtaccggttaccgttacgtttaacgttaacgttaacggttacggtacggtacggtacggttaacgttaccgtacggtccggtaccggttaccggtaccggtacggtacgggtaccgggttaccgggttaccccgggtaccccgggtacccgggg

SEQ ID NO: 232197 - DNA, 730 bp, Homo sapiens
  misc_feature: GYAE6OF01BP21D.5.27.C05.1.454.CMB.1.raw
  modified_base (204)..(204): a, c, t, g, unknown or other
  misc_feature (204)..(204): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccagtggagtttgggctgagtcgttgggttttccttgttgtacttaagttttaaaaggtgtccagtgtgaggtgngtaggttggtggagtcggtaggggtaaccttggtaccgaggcccggttgggggtcccctaggacgtaccttcctccgtggtcgtacgtcctccgtgtccgttaccgaccgtgaacgtagactaattacgatgacgtcgtcggtcccgaccgacgcctaccggtaaggggtaacggtcgtaggtagggtcgggttactagttagtttaattacgagtacggtagtacggaacctacgtaccgtacgtccgacacgtaccgtccggacggacgggtacagtacctacaccgtactcgtaccgaagaccgtaataacttcccgaaactaaccgttacccttaagtcctaacgaagtactaagaacctacggacctagggaacgtaacccggaccggtaagtaccccggtgtacgttaccttacgttaacgttaccgtggaccgtacgtaaggtcgtaccgaggtccggtacggttcgaaccgtcgggtagtacccgggttaccggttaccccgcccggggtaaaccggg

SEQ ID NO: 232198 - DNA, 734 bp, Homo sapiens
  misc_feature: GYAE6OF01DWHKZ.5.27.C05.1.454.CMB.1.raw
  modified_base (514)..(514): a, c, t, g, unknown or other
  misc_feature (514)..(514): n is a, c, g, or t
  modified_base (570)..(570): a, c, t, g, unknown or other
  misc_feature (570)..(570): n is a, c, g, or t
  modified_base (655)..(655): a, c, t, g, unknown or other
  misc_feature (655)..(655): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccagtggagtttggctgagtcgttgggttttcctgttgtacttaagtttttaaaaggtgtccaggttgtgaggtcgtcgtaggttgggtagcggttacggtagggggtaaccttggaccctaggtccggttcgggggtccctagacgtacctccgttctgggtacgtacgtcccttcgtcggtccttaccgaccggtatacggtaagtactaagttacaacgtggtacgtcgtacggtcccgacgacggtccgtacggaacggggtaaggtccgaggtacggtcgtccgttagtaagtttattagacggtacgtaaggtacgaacggtacacggtacttacgacgtacgaccgcccggagggaggtacagtcctaaccggtaccncgtacgtacaacgagaactaacgtaaccaaacgtaccttaccgttaactccgtaanacgtaagtactaacgaacgtccgtaagacggtaccgaacggacggtccgtacgtactacggttactaacggtttcagggttacgngtacggtagtaccgtcggtccgacgtacgtacctacgggttacgaagggttcccggtcccgtaaccggggtacccgggg

SEQ ID NO: 232199 - DNA, 886 bp, Homo sapiens
  misc_feature: GYAE6OF01CE76F.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggtagtttgggctgagtcgttgggttttccttgttgtacttaattttaaaaggtgtctagtgtggaggtgcgtaggttgggtggtaggtcggtcgggggtaaccgttcggtccgacggccggttcggggggtccctggacgtaccttccgtccgttggtcgtacgtccgttcgtgtccgttccgaccgtcgtagtacgactaattactataggacgtcggtcgggtcccgaccgacggtccgtaccggtaaggggtaacggggtcggtagggacgggttcggttcttaacgttaagttttaagttagtaggacggtaagtaccggaaccgtctaacctacgtcgacgacgaccgtcggacggacgggctacgtacttacacctactcccgtaccgaagtacctaaacctaaacttaacccgaaacgttaaaccctttacccgttttactaaccgtttaaccgaaagttaactaaccggtaaactaccggtacgtaacgggacccgtaccggggtaaccggtaaaccgggttcccgccgggttacctttaacggtttaccgtttaaacgtttccggttacgggttaccgggtaaccggtaaacggggttacccgttaaccgggtaccgggtttcggggtacccccggtttaccgggttacccgggtaaaccgggtttacccggggggtttaccgggggtttaccccggggttaccccccccggggtaccccgggggggttaaaccccggggggg

SEQ ID NO: 232200 - DNA, 906 bp, Homo sapiens
  misc_feature: GYAE6OF01DS6HA.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatgggtagtttgggctgagtcgttgggtttttccttgttgtactttaagttttaaaaggtcgtccgtaggttggtaggaggtgcgtaggttgggtgggtaggttcgggtacgggggtaacctttcgggtacccgtacggtcccgggttcggggggttcccctaggtacgtaccttccgttccgtggtcgtacgtccttcgtcgtccgttccgaccgtcgtaagtacgtactaattacagtgtacgtcggtcgggtcccgccgtacggtccgtaccgggtaaggggtaacggggtcgttagggtacgggttcgggttacttacgttaaggttttaacttaagtacggtacggtaacggtaccggaaacccgtactaaccgtaccgttccggaaccgtaaccggtacccggtacccggggaacggggtacggggactaacgggtaaccttacccgaaccgttacttacccgaaccggaagtaaccttaaaacccgtaaacccttaaaccgaaaacgttaaacccctttaaccttttactttaccttaaaccgtaagtaactaaccgtaaaccgtaccggtaccgtaagggaaccggtaacccgggtaccggtaaccgggtacccgttcggttaacctttacggttaacctttacggttacggtcggtaccggtaacggtacggtaccgtaccgttaacgggtcggttaccgtccggtaccgtacgggttaccggttaccgggttccccgggtacccggtcccggggtaacccggggg

SEQ ID NO: 232201 - DNA, 974 bp, Homo sapiens
  misc_feature: GYAE6OF01D0W9G.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagtcgttgggttttccttgttgacttaagttttaaaggtgtccagtgtgaggtgcgtagttggtggagtcgtagggggtaaccttggtaccacggccgtcgggggtccctggacgtacctccgtccgtggttcgtacgtccttcgtcggtccgttacctacccggtacgtaacggttaacgacttaaaacttacgtaagtacggtaacggtccggttccgggggtaccccgacccggtacgggtcccgttaaccgggtaaagggggttaacgggggcgttagggggtaacgggttcggggttacccttacgttaaggtttttaacgtttaagtaacgggtacggtaaacggttacccgggaaaccccgtccgtaaacccgttaccgttaccggaacctaaacggtacccggttacccgggacggggaacggggtacctaacggtaacctttacccggaacccttaacgttccccgttaccggaaaacgggtaacctaaaaccgtttaaaccctttaacccggaaaaacccgttaaacccttttaacccccttttttaacgtaccgttttaacccgaaaggtaacgtttaaccggaaacccgttacggtaacccgtagggaaaccgtaccgggacccggtaaacgggtcccgttacggttaccgtttacggttaccttaacggtttacgtagggtaccgacgggttaaaccggtacgtttaccccggaagggttcggtacccggttaccgggtaaccccgtagggtaacccgggtttaccggggtttacccggggttccccccggaaccccggggggtttacccggggg

SEQ ID NO: 232202 - DNA, 692 bp, Homo sapiens
  misc_feature: GYAE6OF01CG52B.5.27.C05.1.454.CMB.1.raw
  modified_base (314)..(314): a, c, t, g, unknown or other
  misc_feature (314)..(314): n is a, c, g, or t
  modified_base (368)..(368): a, c, t, g, unknown or other
  misc_feature (368)..(368): n is a, c, g, or t
  modified_base (382)..(382): a, c, t, g, unknown or other
  misc_feature (382)..(382): n is a, c, g, or t
tcagatcagacacgcacgaccggtgctcgatttagacgcgatcgaagggtttgggggctgggagaggagcccagcactgggattccgaggtgtttccattcagtgatctgcactgaacacagaggactcgccatggagtttgggctgagcttgggttttccttgttgcttattttaaaaggtgtccagtgtgaggtgctagttggtggagtcgtgggggaaccttggtccaggccgtcgggggtccctgagactctcctgtgtacgcctctgcgttcaccgtcagtagactaaattacatgagcgtcgggtccnccgaggcctccgagggtaagggcgtgggagtgggtctcgtagttattagtaggngtagtacggaaccncaactacttcgacacgaccgtccggcgggaaggggcaacgtacttccacctacttccgtaccgaagaacgtaaaccctaaacttaacccgaaacgtaaacccctaacccttttactacctttaacgaacgtagtaaccgaaactacgacccgttaggaacggtacggacccggaagggtacccgtcggtacgttcttacgttaacgttacgtcggtgtaccggaaggtaccgtactaaccggtggtaccgtcggttaccgacggtacggtacgggttaccggtccccgggtacccccgggtacccggggg

SEQ ID NO: 232203 - DNA, 680 bp, Homo sapiens
  misc_feature: GYAE6OF01AMLVL.5.27.C05.1.454.CMB.1.raw
  modified_base (293)..(293): a, c, t, g, unknown or other
  misc_feature (293)..(293): n is a, c, g, or t
  modified_base (444)..(444): a, c, t, g, unknown or other
  misc_feature (444)..(444): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgcttaattttaaaaggtgtccagtgtgaggtgcagttggtggagtcgtggggaaccttggtccagccgtgggggtccctgacgactctctgtgtacgcctctgcgttcaccgtcgagtagctaattacntgacgtcgtcggtcccgccgaggcctccggaggtacgggcgtggaggtgggtctcgtagtttactttagtaggacgtagtacggaacctcgactacgttcgacgtaacgaccgtcccggacggacgggacacgtacctccaacctctaccnccgaagacgtaactaaacttaaccgaaacgtaacccttacccgtttattaccgttacgacgtaacgtacgaactacgtccgtaagaggaacccggcggaacgtccgtacgtacttacggttaccttaagttcgtacgttaccgacggtaactacggttccctaacgggttgggtccttaccgggaccttagggaccgtttacggggtcccgttacccggacccccggggtacgggg

SEQ ID NO: 232204 - DNA, 758 bp, Homo sapiens
  misc_feature: GYAE6OF01DQUHM.5.27.C05.1.454.CMB.1.raw
  modified_base (202)..(202): a, c, t, g, unknown or other
  misc_feature (202)..(202): n is a, c, g, or t
  modified_base (451)..(451): a, c, t, g, unknown or other
  misc_feature (451)..(451): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccagtggagtttggctgagtcgttgggttttccttgttgacttaagttttaaaaggtgtcgagtgtgaggtgntaggttggtggagtcggtacggggtaacctttggtccgaggtccggtcgggggtaccctgacgtacttcctcgtgtacgtacgtccttcgtgtccgttcgaccgtgaagtacactaatacagtgagtcgtcggtccgacgacgtcgtaccggagggtacgggcgtagggtaggtcggtcgtacgttaagtttacgttagtacgacgtagtacgaccgactaacgtaccgtacgacgacgccgtaccggngggtacggactaacgttactaccgacctaccgtacgtaccgaagtacgtaaactaacgttaaccaaacgtaaccctttaccctttacgtacttacgaagtacgacgtaaacgcgtacgtaacggaggtaacccgttcgggaacgggttcgttaccggtctttaagtaccgtttaagttccggtgtaccggtaccggtagttaaaccgtccggtacgttcgggaccccgtttacgggacccggtaacggttacccggggtaaccgggttttcccgggtaaccccggttaacccggggtacccgggggg

SEQ ID NO: 232205 - DNA, 653 bp, Homo sapiens
  misc_feature: GYAE6OF01DPPF7.5.27.C05.1.454.CMB.1.raw
  modified_base (319)..(319): a, c, t, g, unknown or other
  misc_feature (319)..(319): n is a, c, g, or t
  modified_base (355)..(355): a, c, t, g, unknown or other
  misc_feature (355)..(355): n is a, c, g, or t
  modified_base (360)..(360): a, c, t, g, unknown or other
  misc_feature (360)..(360): n is a, c, g, or t
  modified_base (373)..(373): a, c, t, g, unknown or other
  misc_feature (373)..(373): n is a, c, g, or t
  modified_base (568)..(568): a, c, t, g, unknown or other
  misc_feature (568)..(568): n is a, c, g, or t
tcagatcagacacgcacgaccggtgctcgatttagacgcgatcgaagggtttggggctgggagaggagcccagcactgggattccgaggtgtttccattacagtgatctgcactgaacacagaggactcgccatggagtttggctgagcttgggttttcctgttgcttaattttaaaggtgtccagtgtgaggtgcgtaggttggtggagtcgtggggaaccttggtccaggccgtgggggtcccctgacgtactctccgtgtgtacgcctcgtgtccgttccgaccgtcagtagctaaattacatgagctcgggtccncgagctacgagggtaggctggagtggtctcaagttnttagngcgatcggaaccncactacgtcgcgacgtcctccggcggaggggaccaggtacttaccgacccgttaagtcctccgaaaggtacgaaaccttaaacttcccgaaaaaggtaaccccttacccgtttttatcgtaacctagtacttaaccgaactacgcgttagaaggaccgaccgacggtacgtcgtacgttacgtcttaacgttcgngtacgacgtagttcgtacgtacggtcggaccgttcggacctaggtaccggttgggttacccggtcccggtaccggtacccggggg

SEQ ID NO: 232206 - DNA, 955 bp, Homo sapiens
  misc_feature: GYAE6OF01CM95R.5.27.C05.1.454.CMB.1.raw
  modified_base (678)..(678): a, c, t, g, unknown or other
  misc_feature (678)..(678): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccagtggtagtttgggctgagtcgttggttttccttgttgtacttaagttttaaaggtcgtcctaggtggtggaggtgtacgtaggttggtggtacggttcggtacgggggtaacctttcgggtccgtacggtccgggttcggggggtccctaggacgtaccttccgttccgttgtcgtacgtccgtcgtgtccgttaccgtacccgtatacggtacgacttaaacgttacagtacgacggtccggttcgggcccgtaccgacggtcccgtacgggtaaggggtacgggcggttagggacggtcggttacgtacgttaaggtttacgttaaggtacggtacgtaacgtaaccggtaaccgtaccgtaaccgtaccgttacgaaccgtaaccggtacccggtccgggacggggtacggggtacctaacggttaaccgtcccgtaaacctcggtttaacccgaaccggtaaagggtaaacctaaaccgtttaaaacccttaaacccggaaaaccttaaaccccttttaacccttttaacgtacccgttaanaaacgggtaaccttaacggaacccgtaacggtaccgtaacggggtaaaccgaccccgggtaacccgggtaaccggttacccggttccccggtagtttaacccggttacttttaaaccgggttcggttaggtaccgggtaccggaaacggtttaacccggtccggttaacccggttggtacccccgggtttaaccggtacccggtacggggttaaccgggttaccccgggggttttccccgggacccccccgggggtaaaccccggggttcccggggg

SEQ ID NO: 232207 - DNA, 841 bp, Homo sapiens
  misc_feature: GYAE6OF01EO8GJ.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgcttaatttaaaggtgtccagtgtgaggtgctagttggtggtagtcgtgggggtaaccttggtaccaggccgtggggggtccctggacgtacgttcctccgttgtgtacgtcctcgtcgtccgttccaccgtcgtaaggtacgtactaattacctagtaggaacggtcgttccggggttccccgccggtacggccgttaccgggtaacggggtaaacgggtcggttagggacgggttcgggttccgttacgtaagttttaagtttaacgttacggaccgttaggtaccggaaacccgtaccaaccgtaccgtttaccgacccggtacggtaacccggttaccgggacccggggacggggtaccgaaacggttacgtttaccccgaaccgtaacgttaccccgttacccgaacggtaaccggtaaacctaaccgtttaaaccccgggaaacctaaacccctttaaccccgttttaacttacccgtttaacgagtacgtaacgaacctacgcccgtaaggaccggtaacggacccggtacggtaacgttcccgttacgttcgttacgttaacgtttaccgtagttacgacgggttacgtgtaccgttacgtcggtccgtcgggtaccgtcggttacccgggtagggttccgggttacccggcccccgggtaacccgggg

SEQ ID NO: 232208 - DNA, 919 bp, Homo sapiens
  misc_feature: GYAE6OF01BY9F8.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccagtggtagtttggctgagtcgttgggttttccttgttgacttaagttttaaaaggtgtccagtgtgaggtgctaggttggtggagtcggtacgggggtaaccttcggtccacggtcccggttcgggggtccctggacgtaccttcctccgtgtcggtacgcctcgtgtccgttccgaccgtacgacgtagacctaattacgatacggagtccggtcgggcccgccgacggtaccgtaccgggaagggttaacggggcgttagggtacggtgggttaccttacggttaagttttaacgtttagtaacggtacggtaacggtacggtaaaccccgacctaacgttaaccgttccgaccgtaccggacccgtaccgggacgggtaacgggacttaacgtaccgttaccaacctaccgttcccgtaaccgtaaaggaaccgttaaaacctaaccgttaaacccgaaaacgtaaacccgtttaaaccccttttacgttaaccgttaacggaataacgttaacgaaccgtaccggtaacccggtaggaaccggtaacccgggtaaccgggtacgtacccgggtttccggttacgttaccggtttaacccgtttaacgtttacggtggttaaccgggaacccgggtttagtaaccccggggtttacccgacgggtttaaccccgggttccgggttcccgggtaaaaacccggtcggggttaaaccccgggttttacccgggggttaacccccggggtttaccccccggggtacccccgggggtaaacccgggggg

SEQ ID NO: 232209 - DNA, 739 bp, Homo sapiens
  misc_feature: GYAE6OF01EQ6ZD.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagtcttgggttttccttgttgtcttaattttaaaaggtgtccagtgtgaggtgcagttggtggagtcgtggggaaccttggtccagccgtgggggtccctgacactctcgtgtgtacgcctctgccgttcaccgtcagtagactaattacatgagtcgtcggtcccgcgacggccgtaccggtaagggtacggggtcgtggacggtgggtctacgtagtttattagagtcgagtacggaaccgcactactcgcgacgtaccgtccgacgggacgggacaaggtacttaccgtaaccgactacccgtaccgaaggtaactaaaccctaaacttaacccgaaaacgtaaacccttaaccccgttttaattaccgtttaccaaagtaacgttaaccgaaacgtaacgtcccgtaaggaacgaacgggacccgtaacgggtacccgttccggtacgttacgttacgttaacttacgtacggttaccggacgttaacgggtacgttaccggtacggttcggtaccggttaccggtaccgtaacggttaccggtaacgggggtttcccggttaccccggtaccccccggggtaccgggg

SEQ ID NO: 232210 - DNA, 758 bp, Homo sapiens
  misc_feature: GYAE6OF01EZSRZ.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttcctgttgctattttaaaaggtgtcagtgtgaggtgcagttggtggagtcgtgggggaaccttggtccagccgtgggggtccctgagactctcctgtgtagcctctgcgttcaccgtccagttagcaattacatggagcgttcgggtccgccgacgcgacgtacggacgggtaacgggtcggtgggtaggttcgggtacgttacgttaagtttaacgttacgtacggtacggaacgtaccggaaccgtaccgtaccgtaccgttaccgtaccgtaacgtacccggtaccgggtacggacgggtacgtaacgtaccgttacctaacctaccgtaccgtaccgtaacgtaaacgtaaccgtaaaccgtaacctaaacccgttaaacccttaaccctttacgtaccgttacgtaacgtaacgtaacgtaaccgtacggtaccgtacggtaacggtaacggtacccggtaccggtaccggtaccggtacgttaccgttacgttacgttacggtacggtacggtacggtacgtaccggttaccggtaccgttcggtacggtacggtacggtaccggtaccggttaccgggttacccgggtacccggg

SEQ ID NO: 232211 - DNA, 751 bp, Homo sapiens
  misc_feature: GYAE6OF01DQ3KE.5.27.C05.1.454.CMB.1.raw
  modified_base (643)..(643): a, c, t, g, unknown or other
  misc_feature (643)..(643): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcgttgggttttccttgttgcttaattttaaaaggtgtccagtgtgaggtgctagttggtggagtcgtggggaaccttggtccaggccgtgggggtcctgacgtctctcctgtgtagcctcgtgtaccgttcaccgtcgagtacgactaaattaccatgagcgtcgggtcccgacgacggtcctaccggaaggggttaacggggcgtaggggtacggttcgggttaccttaggtaaggttttaacgtttaagcggtacgtaacggttaccggaaccgtaccgtaaactaccgttccggacaacggtacccgtccgggcggggtaacgggtcgaaacggttacttaccccaaccgtacgtttcccgaaccgaaaggtaacggaaaccttaaccgtttaacccaaaaacggttaaacccttaccctttttacgtactttaacgaaggtacttaacgaaacgcgtacctggaaaccgtcggaccggacgtaccgtcggnttacgtcttaattacgtcgtagtacgtacgtacgtacgtacggttcgtccggtagaccgaggtaccgggttcgggttaccgggttccccggtcccgggtaaacggggg

SEQ ID NO: 232212 - DNA, 698 bp, Homo sapiens
  misc_feature: GYAE6OF01A7L4B.5.27.C05.1.454.CMB.1.raw
  modified_base (339)..(339): a, c, t, g, unknown or other
  misc_feature (339)..(339): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcttgggttttccttgttgcttaattttaaaaggtgtccagtgtgaggtgcagttggtggagtcgtgggggaaccttggtccagccgtgggggtccctgagactctcctgtgtacgtcctctgtccgttcaccggttcagtagactaattaacatgagcgtcgggtcccgccgaggcctcgagggtaagggntgggagtgggtctctagtttattagagcgtagtacggaaccgcacgtacttccgacgacgaccgtccggacggaggggccaagtacttaccaaccgattacctccgaagaacgaacctaaacgttacccaaacgtaaccttaacccctttataccttacacgtaataccgaaacacgacccgttaggaacggtaaccgcccgggtaaaggtaccccgttagggtcctttagttacctttaacgttaccgtgtaccgggtactaaacgggtcgttaccgtaacggttccggttaccggtaccggtccgtaggtccggtaacggggtttcccgggtaccccggcccccggggttacggggg

SEQ ID NO: 232213 - DNA, 802 bp, Homo sapiens
  misc_feature: GYAE6OF01C57RI.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccagtgggagtttgggctggagtcgttgggttttccttgttgtactttaagttttaaaacggtgtcctaggtggtggaggttgcgtaggttggtggacgttcggtcgggggtaaccttgggtaccgacggtccggttcggggggtccctgacgtactctcgtgtcgtacgctcgtgtcgttccgtacgtctagtacgactaattacatcgtagtcgtcggtccgaccgacgtacgaccggtttttttttaacggggaacggggtacggtcgggtagggtcgggttacgttagttaagtttaattaagtaaggtacggtacgtaacggtaaccgtaccgtaacgtaaccgttaccgacgtaacggtaccgtacccgggacgggaacgggacgtaacgtaacttaccgtacctacgttaccgtaaccgtaacggtaacgtaaaccgtaacttaacccgtaaaaccgttaaacccttaacccgtttaacctacgttacctaacggtactaacgtaacgtacgtccgtacggaacgacggaccggtaaggtaccggtacggtcgttacgttacgttacgttacgtaggtcggacggtacggtacgtacgtacggtcggtacgttacggtacgtacggtacggtaccgggttacggtcccgggtacccggtacccggg

SEQ ID NO: 232214 - DNA, 743 bp, Homo sapiens
  misc_feature: GYAE6OF01AIL63.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggacgtttgggctgagcgtgggttttccttgttgctattttaaaaggtgtccagtgtgaggtgcagttggtggagtcgtggggaaccttggtccagccgtggggggtccctggagactctcctgtgtacgcctctgcgttcgaccgtcagtagcaattacatgagcgtgggtcccgcgacggctccgagggtagggctgggagtgggtctcgtagtttatttagtacgcgtagtacggaaccgtcactacttcggcacgaccgtccggacggtaagggggccaggtactttacccgaacccgtacttccctaccgaaggaaccgtaaacccgtaaactttaacccgaaaacggtaaacccctttaaccccttttaatttacccgtttacgaaacggtaacgttacgaaaccgtacggtacccgtacggaacgtaaccggacccgggtaacgggtacccgttaccgggtcgttacggttacctttaacgtttaccgtggttacgggaccgtaaggtacggtacgtaccggttcgggccgtttacgggtacccgtaacgggtccgtaagggggtttcccgggttaccccggtacccccgggtacccgggggg

SEQ ID NO: 232215 - DNA, 787 bp, Homo sapiens
  misc_feature: GYAE6OF01DJZY4.5.27.C05.1.454.CMB.1.raw
  modified_base (645)..(645): a, c, t, g, unknown or other
  misc_feature (645)..(645): n is a, c, g, or t
  modified_base (653)..(653): a, c, t, g, unknown or other
  misc_feature (653)..(653): n is a, c, g, or t
  modified_base (667)..(667): a, c, t, g, unknown or other
  misc_feature (667)..(667): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccagtggtagtttggctgagtcgttcgggttttccttgttgtactttaaagtttttaaaacggtgttaccgaaggttgtggtaaggttcgacgttaggtttgggtgggtaacggttccggtaacggggggtaacccctttgggtaccccgtacgggtcccggggtttacggggggttccccctaggacgtaccttccgttaccgttggttaggtccgtcccttgtacgttccgttaccgaaccggtacgtaaggtactaacttaaacgttacgaggtcgaggtccggttcgggtacccggccggtacggtacccgtaccgggtaaggggtacgggtcgtacggggtggttacgggttcctagttagttatttaagcggtagtaacggtccgaaccgtctacctacgttaccgacgtacggtacccgtcgggacgggtagacgtaagttacgtacccgacctactaccgtaaccgaagtactaaacctaacgtaccaaacgttaaccctaccttttntccgtaanacgtatacgaacgntaccgaaggacgccgacggtacgtactcggtatacgttagttaacgtgtgtacgcgtaacgtctacgtacggtgcgttacggacgtacgcgggttacggttcggtacccgtccggtacgg

SEQ ID NO: 232216 - DNA, 734 bp, Homo sapiens
  misc_feature: GYAE6OF01A8ZX9.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacgagtaggactcgccagtggagtttgggctgagtcgttgggtttccttgttgtacttaagtttaaagtgtcgtagtgtgagtgcgtagtggtggagtgtaggggtaaccgttgtccgagtccggtcggggtccgtacgagacctccgtcgtacgtgtacgtccgtctcgtcgttcaccgtacgtagtacgactaagttaacagtagtaggtcgtcggtccgccggacggtcgtccgaacgggtaacgggcggtacggtggtaggtcgtactagttaattagtagacgagtacggaacgctaacgtacgttacgacgacgaccgtcggacggaggcgtagtactttacgaaccctgtaacctaccgaacgtagtaaacctaactaacccgtaacgtaaaccctaacccgttttagtaaccttacggaacgtaactaacggtaaccgtaaccgtcgtaacgggtaacgtaacggaaccccgggtacgtaccgggtacgttaacttaccggttacgttacgttaaacgtccgtaaggacccggtagtaccccgggttatcggtacggtcgtacggtactacggacggttaggttcggtcccggtaccccgggtaccggg

SEQ ID NO: 232217 - DNA, 915 bp, Homo sapiens
  misc_feature: GYAE6OF01C73KU.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactagaacacagaggactcgccagtggagtttgggctgagtcgttgggttttccttgttgtacttaagtttttaaaaggtgtccgtagtgtggaggtgctaggttggtggagtcggtaggggaccttggtcgaggccggtcggggtcctgacgtctcctcgtagtcgtacgtcctcgtcgtccgtacgtaccgtcgtaagtacgtactaatttacagtaggtaccgtccggttcggggtaccccggaccgacggtacccggtacgggtaaggggttaacggggtccggtaggggttacggttcgggttcgttacgttaaggtttaacgtttaaggacgggtacgtacggtaccgggtaacccgactaacggtaccgttacggaccgtaacgggtaccgtaccgggacgggtaacgggggtactaacggtaccgttaacccgaacccgttaaccgtacccgtaaaccgtaaacggtaaccggtaaaccttaaaacccgttaaacccgtaaaaccggttaaaaccctttaaccctttttaacgttaacccgtttaaaccgaaacggtttaaacgtaaaccggtaaaccgtaccggttaaacccgtaggtaaacccgggaccgggtacccggaaaccgggttacccggttaccgttaccgttaacggtttacgtttaaccgttacgttagggtaccggtaacgtaacggttaaccggtaccggttacggtccgggttcggttaaggtaccggtacggttacggggttaccggttacccgggtacccgggtaccccggggtacccgggg

SEQ ID NO: 232218 - DNA, 664 bp, Homo sapiens
  misc_feature: GYAE6OF01BS7P2.5.27.C05.1.454.CMB.1.raw
  modified_base (537)..(537): a, c, t, g, unknown or other
  misc_feature (537)..(537): n is a, c, g, or t
  modified_base (545)..(545): a, c, t, g, unknown or other
  misc_feature (545)..(545): n is a, c, g, or t
  modified_base (607)..(607): a, c, t, g, unknown or other
  misc_feature (607)..(607): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttggctgagctggttttccttgttgctattttaaaaggtgtccagtgtgaggtgctagttggtggagtcgtggggaaccttggtccagccgtgggggtccctgacgactctcctgtgtacgcctctgtcgttcaccgtcagtacgactaattacagtggacgtcgtacgggtcccgccgaggtccgtaccggaggggtaacggggctaggggaggttcgggtctacgtagttttattacgtaggtacgagttacggaaccgtacaaccgtaccgttccgacgacggaccgtcccggacggacggggcaagtacttaccgacacgttcctaccgaagtacgaacctaacttaacccgaacgtaaacctaccccgtttatccgttacgagtactacgaacncggtaccnggaaacgtcgaccgggagtaccgtcgtctagtacttaacgttcgtcgtcggacgtagacgtnacggtcggtacgtcggtaccctagggcgtacgggttcgtaccccggccggtccgggg

SEQ ID NO: 232219 - DNA, 884 bp, Homo sapiens
  misc_feature: GYAE6OF01BTEKL.5.27.C05.1.454.CMB.1.raw
  modified_base (198)..(198): a, c, t, g, unknown or other
  misc_feature (198)..(198): n is a, c, g, or t
  modified_base (286)..(286): a, c, t, g, unknown or other
  misc_feature (286)..(286): n is a, c, g, or t
tcagatcagacacgcacgaccggtgctcgatttagacgcgatcgaagggtttggggctgggagaggagcccagcactgggattccgaggtgttccattcagtgatctgcactgaacacagaggactcgccatggagtttgggctgagtcgttggttttccttgttgtcttaattttaaaggtgtcctagtgtgaggtnacgagttggtggtagtcgtagggggtaccttggtaccaggccggttcgggggtccctgaacgtcctcctccgtagtcggtactccgtntcgtcgttctaccgtcacggtacgataactacgagtaggacgtcggtcgggtccccgacgtacggtacccgtaccgggtaaggggtacggggtcggtacggggtacgggtccgggttacgttacgttaaaggttttaacgttttaacggtacggtaaccggtacggttaaccgggaaaccccggtacctaaacccggttaccggtttacccgggaacgtaacccgggtacccgggttacccgggacggggggtaaacggggtacccggtaaacgggtttaaccctttaaccccgaacccgttaccttacccgtaacccgggtaaacggttaaacccgtaaaacccgtttaaaacccgttaaacccgaaaaacccgtttaaaaccccgtttaacccctttttaacggtcctttaaaccggaacggtacgtaaccgtaacgtaacccggtaaccgtagggaaacgtacccgggtaccggtaacgggtacgttccggtacttacggtacgttacgttacgtggtacgtacggtactccggttacacggttcgacgtcgtacgtcggtacggttcggttcccggtacgcccggggtaccggg

SEQ ID NO: 232220 - DNA, 1038 bp, Homo sapiens
  misc_feature: GYAE6OF01CYKH0.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatgggagtttgggctgagtcgttgggttttccttgttgacttaagttttaaaaggtgtccagtgtgaggtgcgtaggttggtggagtcgtcgggggtaaccttggtccgaggtccgttggggggtcccctggacgtacctccttccgtggttcgtacgtcccttcgtcggtccgttccaccggtcaaggtacgactaaattaaccagtaggaggtcggtaccggggtcccgccgacggtcgtaccgaagggtacggggcgtgggtaggtcgggtacttgtagtttagttaagtacggtcgtaagtacggtaacccgactaaccgtaccgttaccgacgtaacggtacccgtacccggggacggggacggggtaccgtaaggtacgtttacccaacccgtaacgttacccgtacccggaaaggtaaaccggtaaaacccttaaaacccgtttaaacccccgtaaaaaacgggttaaaaccccccttttaaacccccgttttttaacgttacccgttttaaacccgaaaggttaacccgttaaacccggttaaaaacccgacccgggtttaaacccgtacggggtaaaaccgggtaacccggggtaaaccccggggtaaacgggttaaccccgggttcccgggtacccggttttaaccggttttaccgtttttaaaaacccggtttcggtttacgggtaaccggggttaaccgggttaaacgggttaacccgggttaccccgttaaacggggttcccggggtttaaccccggggttacccggggtttaaaccccgtaaaccgggggttaaccccgggttttaaacccgggggggggttttacccccgggggtttaaacccccccgggggttaaacccccccccgggggggttaacccccgggggggggg

SEQ ID NO: 232221 - DNA, 922 bp, Homo sapiens
  misc_feature: GYAE6OF01C6CEZ.5.27.C05.1.454.CMB.1.raw
  modified_base (562)..(562): a, c, t, g, unknown or other
  misc_feature (562)..(562): n is a, c, g, or t
tcagatcagacacgcacgaccggtgctcgatttagacgcgatcgaagggtttgggctgggagaggagcccagcactggattccgaggtgtttccattcagtgatctgcactgaacacgagaggactcgccagtggtagttgggctgagtcgttggttttccttgttgtacttaagttttaaaaggtcgtacctaggttggtggtaggtcgtacgtaggttgggtaggtacggttacgggttacgggggtaacctttcgggttaccgacgggtcccgggttcggggggttcccctggaccgtaccgttccgttccgttggttacggtaccgtcccttcggtcggtacccgtttacccgaaccgttacgaacgttacgaaccttaagttacgacggtaggtacgtccggtacgggtccccgacggccggtaccgtaccgggtaagggtacggggtacggtcgggtaggtcggttcttacgttaagtttacgttagaacggtagtaacgtaccggaacctacctaaacgtccgttaccgaacgaccgtacccgtcgggaccgggngggaactacgtacttaccgaaactccgtacccgtaacgaacgtaaccgtaaacttaaccaaacccgtaaaccgttaaacccctttaacgttttacctaaccggtaacgtaacggtacttaaaccggtaccgaaccgtccgtaagggaacggttaacccgggtaacccggggtaacccgttacgggtaccggttcccttttaagggttacctttaaacgtttcccgggtggttacccggaaacggttcggtaaccggtttaacccgtgggttacccggttacccgtttacccgggaccggtaggtaccccgggttagggttcccccggggtacccggtaaccccccgggggttaccggggg

SEQ ID NO: 232222 - DNA, 850 bp, Homo sapiens
  misc_feature: GYAE6OF01EA7CL.5.27.C05.1.454.CMB.1.raw
  modified_base (185)..(185): a, c, t, g, unknown or other
  misc_feature (185)..(185): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccagtggagtttgggctgagtcttgggttttccttgttgcttaagttttaaaggtntccagtgtgaggtgcgtaggttggtggagtcggtgggggtaaccttggtccaggtccggtcgggggtccctgacgaccttcctccgtggtcgtacgtccgttcgtcgtccgttccgaacccggttcgaacgtacgtaactaaactttaaccgagtacggagtccggtccggggtacccgccgtacgggtccttaccgggaagggggttaacggggtccgtaggggtacggtcgggttaccttacgttaaggttttaagttacgtacggacgtacgtaccggaacccgacctacctacgttaccgacgaaccgtacccgtaccggacgggtacggggactaacggtaccttacccgaaccctacgtaccccgtacgaaacgtacgtaaacctaaacgttaaccgaaaaccgttaaccctttaacccctttaacgtaccttaacgtaacgtaacgttaccgaaacgtacccgtacgtaacggggaacaccgggtaacccggtaacgggtcccggttaccggtacgttaccgttaaccgttacgttaccgttgggtacggtaacggtaacggtaccgttacccgtacgggttcgaacccgggttacgccccggtacgggaccgttaggggttcccccggttaaaccccgggcccccggttaccggggg

SEQ ID NO: 232223 - DNA, 799 bp, Homo sapiens
  misc_feature: GYAE6OF01EMSMO.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttggctgagtcttgggttttccttgttgtcttaagttttaaaaggtgtccagtgtgaggtgcgtagttggtggaggtcggtagggggtaaccttgggccaggtcccggttggggggtccctggacgtaccgttcctccgttggttcgtacgtcccttcgtcgtccgtttaccgacccgttcgtaaggtaacgaccttaaattaacgagttaggacgtccggtcggggtcccgcccgacgggtcctaccgggtaaaggggttaacggggcgtaggggtagggtcgggttaccttacggttaagttttactttaaggtacgtacggtaagtaccggaacccgtacaacccgtaccgttacgaccgtaaccggtcccgtacccgggacgggaacgggggactaacgtaccgttacccaacctacgttccgtacccgaagtaacgtaacgtaaccttaaccaaaacgtaacccttaacccttttacgttaacctacgtaagtaacgtaacgaaccgtacgtcctaagggaccgaaccgggaccgtaacgggtaccgtaccggttcttacgtaccttacgttaacgtcggtacggacgtagtacgttcgacgttcggccgtacgtaccgtcgtacggtaggttccggtcccggtaccggtccgggg

SEQ ID NO: 232224 - DNA, 774 bp, Homo sapiens
  misc_feature: GYAE6OF01AMCOE.5.27.C05.1.454.CMB.1.raw
  modified_base (538)..(538): a, c, t, g, unknown or other
  misc_feature (538)..(538): n is a, c, g, or t
  modified_base (666)..(666): a, c, t, g, unknown or other
  misc_feature (666)..(666): n is a, c, g, or t
  modified_base (687)..(687): a, c, t, g, unknown or other
  misc_feature (687)..(687): n is a, c, g, or t
  modified_base (699)..(699): a, c, t, g, unknown or other
  misc_feature (699)..(699): n is a, c, g, or t
tcagatcagacacgcacgaccggtgctcgatttagacgcgatcgaagggtttggggctgggagaggagcccagcactgggattccgaggtgtttccattcagtgatctgcactgaacacaggaggacctacgccaagtgggtagtttcgggctggagtcgttgggttttccttggttagtactttaagttttaaaaggtcgtaccgtaggttgtagtaggtgacgtgggttgggtagggtacggttcggtacgggggtaacccttcgggtaccgtaccgggccgggttccgggggtacccttaggacgtaccttccgtccgttgttcgtaccgccttcgcgtcgtacccgtacgtacgtacgtacgtacttaattacgagtacggcggtcggtcggtacccgcggacgtccgtaaccggagggttaggcgtagggtacggtcgtacgtacgtttagtttacgttagtcgggtactaacggtccgaaaccgtcctacggtacgttccgacgtaaccggacctccggggaggtaccgggntacgttacctaccgtactactcggtaaccaaggtaacctaaccgtaaccgttaaaccaacgttaaaccccctttcgttactacctaagcgacgtaaccacgacgtcgagaccgacggacgcgtaccgngtacttcgtacttagttacgnggtaccacggtntacggtacttacggtcgttacgcgggaactcgggttaccggttaacgggttcccgaccggggtcccggtaccggg

SEQ ID NO: 232225 - DNA, 778 bp, Homo sapiens
  misc_feature: GYAE6OF01DDW0H.5.27.C05.1.454.CMB.1.raw
  modified_base (303)..(303): a, c, t, g, unknown or other
  misc_feature (303)..(303): n is a, c, g, or t
  modified_base (355)..(355): a, c, t, g, unknown or other
  misc_feature (355)..(355): n is a, c, g, or t
  modified_base (383)..(383): a, c, t, g, unknown or other
  misc_feature (383)..(383): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccagtggagtttgggctgagtcgttgggttttccttgttgtctttaaagtttttaaaaggtgtcctagtgttggaggttgcgtaggttgggtaggagtcggtagggggaaccctttggtcccaggcccggttggggggtccctgacgtacctcttccgtgtcgtacgccttcgngtcgttccgaaccgtcgagtacgactaattacagtggacgcgtcgggtcccncgtacggcctaccggagggtaacggggngtcgggtaggttcggtcgtcgttaagttattaacgagaccgtaagtcggaacccgcctaacgacccgttccggaccgtaacgtaccccggtacccggtacggggaacggggacctaaggtacttacccgaaccgtaacctcccgtaaccgaacggaactaaacctaaacgtttaaccccgaaaaacgttaaccccgtttaccccttttaacttaccgttaacgtaacgtacgtaacgtaacccgacgtacccgtaggaacggtacggaccggtaacggtccgttccggtagttcgttattaccgttccgtcggtacggcgtaaggtcgtacgtcggttcggaccctggtcccgagttaccggtggtttaaccgggcccggccccggttacggggg

SEQ ID NO: 232226 - DNA, 918 bp, Homo sapiens
  misc_feature: GYAE6OF01E47G5.5.27.C05.1.454.CMB.1.raw
tcagatcagacacgcacgaccggtgctcgatttagacgcgatcgaagggtttggggctgggagaggagcccagcactggattccgaggtgtttccattcagtgatctgcactgaacacagaggactcgccagtggagtttgggctgagtcttgggttttcctgttgtacttagttttaaaaggtgtacctagttggtgagggtgcgtaggttgggtggtacggttcggtacggggggtaaacctttcgggtccctagggtcccggttcggggggtccccttaggtacgtaccgttccgtccgttgggttacggttacggtccccgttcgttcggtcccggttaccaacccggtacgtaaggttaacggaaccttaaacgtttaaccaagttacgggtaccggtccggttcggggttaccccgacccgggtacggttacccgtaccggaaagggggtaacgggggtccgttaggggtacgggttaccgggttccgttaagttaaggttttaacgtttaaggtaacggtacggtaacggttaacgggaacccgtacgtaaccgtaccgtttaccggacgtaaccggtaccgttacccggggacgggtaaccggggactaacggtaccgttacccaacgttaccgtcccgttaaccgaaggtaaccgtaaaccttaaaccgttaacccggaaacgtacccttttaaacccgtttagttacctttaccgaagttactaaccggaacgttcccgacgttaacggacgtaaccggtacccgggtaaggttcccggtgttaccgtttagttacccgttagttaccggtagttaccggaacgtacgtacgggttctaccgggtcggtacgttaccggacgtaacggttccgtaagggtcccgggttaccccgacgggtacccgggg

SEQ ID NO: 232227 - DNA, 793 bp, Homo sapiens
  misc_feature: GYAE6OF01AGETI.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttggctgagcgtgggttttccttgttgtcttaattttaaaaggtgtccagtgtgaggtgcgagttggtggtaggtcgtagggggtaaccgttggtccgacgccgtcgggggtccctgagtaccgtctcctgtgtacgcctctgcgttccgacgtcagtagactaattacagtcgacggtccgtcgggtcccggaccgacggtccgtaccggaaggggtaacgggggtccgtaggggtacgggttcgggtaccttacggtaagttttagtttagtaacggccgggtaactacgggtaacccgacgtaacccgtacgttacccgacgaccgtaccgtacccgggacgggtaccggggaactaggtaacctttacccgaaccctacttcccgtaccgaaggtacctaaaccgttaaccttaacccgtaaaacttaaacccgttaccccttttactaacctttaccgaagtaacgtaaccggtaacgaacgtccccgtaggtaacgggaaccgacccgggtacggtaccggttccggtacgttcgttaccgttaacgttaccgtggttaacggacgtaacggtacgtaccgttcggtcggtccgttaggaccgtccggacggttcgggttacccgggttcccgggaccccggtacgggg

SEQ ID NO: 232228 - DNA, 791 bp, Homo sapiens
  misc_feature: GYAE6OF01EN0OF.5.27.C05.1.454.CMB.1.raw
  modified_base (382)..(382): a, c, t, g, unknown or other
  misc_feature (382)..(382): n is a, c, g, or t
  modified_base (416)..(416): a, c, t, g, unknown or other
  misc_feature (416)..(416): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccagtggtaggtttgggctggagtcttgggtttttccttgttgtactttaattttaaaaggtgtcctagttggtggaggtgcgtaggttgggtgggtaggttcggtacggggggtaaacctttgggtccgtacggtcccgggttcgggggggtaacccctggaacgtaccttccgttccgttgtcgtacgtcctcgtcgtccgttccgaccgtcgaagtacgactaattacagtggacgtcggtcgggtcccncgacggcctacgggaaggggtacggggcgtgggnggtcggtctagtagtttattagagtcgacgtacggaccgctactacgtcgacgtaacgcgtaccggacgggaggtaccagtaccgtaccaccgtctaccgtacaaggaaccttaaacctaaccgttaaccgaaaaaccgtttacccttaacccgttttacttacccggtaactagtaaacgtaaccggaacctacgaccgtacgggtaagaccgggtacccggaaggttcccgttccgtacggtttcgttaacgtttaccgttggtgttacgggacgttaaggtccgttacctacggtcgggtcgtaacccggtacggtacccgggttcggttagggggttcccccggtcccggtaacccggggtaccccggggg

SEQ ID NO: 232229 - DNA, 907 bp, Homo sapiens
  misc_feature: GYAE6OF01BS5E4.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacgagacggactcgccatggtagtttgggctgagcttgggttttccttgttgtacttaagttttaaaaggtcgtccaggtgtaggaggtgcgtaggtttgggtggtacggttcggtacgggggtaaccgtttcgggtacccgacggtcccgggttacggggggttccccttaggaacgtaccgttcccgttaccgtggttacggtacgtcccgttcgtcggtccgtttccgtaacccggttcgtaaggttaacgtactaaactttaacacgtacggtacggtcggttccgggtacccgccgtaaccggtaccgtaccgggtaaggggtaacggggccgttgggtaacggttcgggtcttacggtagttttaacgttacggtagaccgtaggtaccggaaccgtacaccgtaccgttacgaccgaacgtaaccgtccgggaccgggtagggacgtagttaccgttaccgaaccgtaccgttaccgtaacccgaaggtaaccgtaaaccttaaacccgtaacccgtaaacgtaaacccgttacccttttaaccgttaccttaaaccgtcgtaaaaccgtaacggtaaaccgtaccggtaaccgtaacggtacgggtaacccggtaccgggaccgggttacccggttacggttccgttaacgttacccgtttaagtaccggttgtaaaccggtcggttaaacgccggttaccggaccggttacggggacttccggacccgttaacggacggttaccggttaccgggtccccggtacccggggtaaccccgggg

SEQ ID NO: 232230 - DNA, 810 bp, Homo sapiens
  misc_feature: GYAE6OF01DOJKU.5.27.C05.1.454.CMB.1.raw
  modified_base (276)..(276): a, c, t, g, unknown or other
  misc_feature (276)..(276): n is a, c, g, or t
tcagatcagacacgcacgaccggtgctcgatttagacgcgatcgaagggtttggggctgggagaggagcccagcactgggattccgaggtgtttccattcagtgatctgcactgaaccacagaggactcgccatggagttgggctgagtcgttgggttttccttgttgacttagttttaaaaggtgtcctagtgtgaggtgcgaggttggtggagtcgtggggaaccttggtccaggccgtcgggggtccctgacgactctcctgtgacgcctcgngtcgttcaccgtcagtacgactaattacagtgacgtccgtcgggtcccgtaccgacggtcgtaccggaaggggtaacggggtccgtaggggacggttcgggttactacgtttaagtttacgttaactacggtacggtaaggttaccgggaaacccgtcgtaaaccgtaccctttccggtaccgtaacggacccgttacccgggcggggtaaccgggggactaacggtactaaccgtaaccgtaccgttacccgacctaaagggaacctaaacgtaaaaccttaccgaaaacgttaaccctaacccgttttattaccttacaaagtacgtaacgtaaacccgagaccggttaacggaacgaacccgggtacccggtaagggtaccccggttacggtcggtttaacggtacctttagtttaaccgttggtaacggtaccggtacgacgtttacccgcggttaggccgtttccggaaccgtacggttacgggtaccgggttttcccggtccccgggtccccgggttaaccccggggg

SEQ ID NO: 232231 - DNA, 826 bp, Homo sapiens
  misc_feature: GYAE6OF01CIAWK.5.27.C05.1.454.CMB.1.raw
  modified_base (370)..(370): a, c, t, g, unknown or other
  misc_feature (370)..(370): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccagtggagttgggctgagtcgttgggttttccttgttgtacttaagttttaaaggtgtccgtagtgtgaggtgcgtaggttggtggagttcggtgggggtaaccttgggtaccgacggtccggttcgggggttccctggacggtacctccgttccgttggtacgtacgtccttcgtgtaccgttccgaccgtacgtaagtacgtaactaattacgaagtcggtacgtcggtcgggtcccncggtacggccgtaccggtaagggtacgggcgtagggtacggttcggtccttagttacgttttagtttagtacggtacgtaacgtaccggaaccgtaccgtaacgtaccgttacgaaccgtaaccgaccggtaccggacgggacgggctaacggtactcccgaactacgtacctacgaacggaactaacccgtaaacttaacccgaaacgttaaccccttaaccgttttacgtaaccgttacgagtaaacgtaaccgaaaccgtaccgtaaccgtagggaacctaaccggggtaacccgacggggtttcccgaccggtttagttaccttaccgtttacgtacggttcggtaccgtacggttaggtacctaccggtacggttgtaccccggttagggtacccgtaagggtacccggtttaccgggggtcccgttacccgggccccgggttaacggggg

SEQ ID NO: 232232 - DNA, 746 bp, Homo sapiens
  misc_feature: GYAE6OF01E0KQ9.5.27.C05.1.454.CMB.1.raw
  modified_base (212)..(212): a, c, t, g, unknown or other
  misc_feature (212)..(212): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgcatggagtttgggctgagcttggttttccttgttgtcttagttttaaaaggtgtccgaagtgtgaggttgcaggttcggtggngtcgtaggggtaacctggtccagccgtcgggggtcctgagactctcctagtgtacgcctctcggtcgttccaccgtctagtacgactaatacatagacgtcggtcggccgccgaggctaccgaggtacggggctagggagttcgggtctacgttagtttattacgtagtacgacgttacggaaccgtacacgttactcgacaaacggtcctacggaccgggtaggacgatacgtaccgaccagtccccgtactaaggacctaaaccacttaaaccaacgtaaccctttacccgttaacttccgttaataacgtataaccgaacgtcccacggttacgaaacggtcgtacccgggaaagtcccggttcgttactacccggtttaattaccccgtaaggttccggttacgggaacggttaggttaaacccgaggttacccggttagacccgggtttacccgggaacctaacggggaaccccgggtttaaggggttaccccgggtttccccccgaaccgggggtttaaccccggggg

SEQ ID NO: 232233 - DNA, 766 bp, Homo sapiens
  misc_feature: GYAE6OF01BDHSF.5.27.C05.1.454.CMB.1.raw
  modified_base (277)..(277): a, c, t, g, unknown or other
  misc_feature (277)..(277): n is a, c, g, or t
tcagatcagacacgacacgaccggtgctcgatttagacgcgatcgaagggtttggggctcgggagaggagcccagcactgggattccgaggtgtttccattcagtgatctgcactgaacacagaggactcgccatggagttgggctgagctgggttttcctgttgctattttaaaggtgtccagtagtgaggtgcagttggtggagtcgtggggaaccttggtccagtccgtgggggtccctgagactctcctgtcgtagcctctgcgttcaccgtnacgtagactaacttacatgacgtcgtacgggttcccgccgtacggcctaccggagggtaacggggtctagggaggttcgggtctacgtagtttactttagtacgacgtagtacggaaccgctactaccgttcgacgaacgtaccgtccggtacgggacggggtactaacggtactttaccgaacccgtacgttaccgtaacccgaagggtaacccgtaaacccgttaaaacgtttaaccccgaaaacggttaaaaccccctttaccccttttaagtacccgtttaccgaacgttaacgtacggtaaaccctacggtacccgtaggaaccgaccggtacccggaaggtacccgttacggtaccttagttaccttaagttccgtagggtacgacccggtaaagtccgttacgacggttccggtacggttccggaccgtaacggaccgggttaaagggttcccggtaccccggtccccggggttaacggggg

SEQ ID NO: 232234 - DNA, 832 bp, Homo sapiens
  misc_feature: GYAE6OF01CVMPI.5.27.C05.1.454.CMB.1.raw
  modified_base (464)..(464): a, c, t, g, unknown or other
  misc_feature (464)..(464): n is a, c, g, or t
tcagatcagacacgcacgaccggtgctcgatttagacgcgatcgaagggtttgggctgggagaggagcccagcactgggattccgaggtgtttccattcagtgatctgcactgaacacagaggactcgccatggtaggtttgggctgagtcgttgggttttccttgttgtacttaattttaaaaggtcgtccgtagtgtgaggtgcgtaggttggtggtagtcggtacggggtaaccttcggtccgacggtcccggttcgggggtcccctaggacgtaccttccgtccgttgtggtacgtccttcgtcggtccgttaccgaccgttacgaggtaacgacctaacttactagtagacggtcggtccgggtaccctccgacggtaccgtaccggtaagggtacggggcgtagggtcggtcgggtcttacgttaagtttacgttaagtacgcgtaacgtcggaaccnctaccgtacgttcgacgtaccgtaccgtaccggacggtacggactagtacccgttaccgaaccttacgtaccctaaccggtaacgtaaaacgtaacccgttaaaccttaaaccccggtaaaaccgtttaacccccgtttaacctttttaaccggttaccctaaacgtaacgttaacgtaaccgtaaaccgggttcgaacccgtaaggggtaaccgaccggtaacccgggtacgttacccggtaacgttccgttaacgtttcgttaaccgttgaccgtggtaactaacggtcgttaccgtaacggcggttacccgtaggtcccgacggttacgtaaccgggtcccgggtaccccgtacgggtacccggg

SEQ ID NO: 232235 - DNA, 1007 bp, Homo sapiens
  misc_feature: GYAE6OF01A72P6.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccagtggtagtttgggctgagtcgttgggttttccttgttgtacttaagttttaaaaggtgtaccgagttgtggaggtgtcgtaggttgggtaggagttcggtacgggggtaaccttcggtcccgtaggtccggtcgggggtcccgtgacgtaccttccgttccgtgttcggtacgtcccttcgtcgtccgttaccgtaccgtacgtagtacgacttaaacttaccgagtacggtacggtccggttccggggtaccccgaccggtacgggtcccgttaccgggtaaacggggttaacggggtcggttaggggtacgggttacgggtttaccttaccggtttaaagtttttaacgtttaacggtaacggtacggttaacggtaaccgggaacccgtaccgtaacccgtaccgtttaccggaccgtaaccggtaacccggtcccggggaccgggtaacgggggtaccgtaaacggttaccgtttaccccgaacccgtacgtttacccgtaacccgaaaggtaaacccgtaaaacccgttaaaccgttttaaaccccgaaaaaccggtttaaacccccttttaaaaccccgtttttactttaacccggtttaaccgtaaaggttaacccgttaaaccggaaacccgttacccggtaaccggtaagggaaccggttaaccgggaccggtaacgggtaccggtttacccgtcggtttacgttaacccgttttaagttacccggtacgggttacggaaccggtaggttaaccggttacccggtagggttccccggtacggttaccggttaaccccggtacggggttaccgggttacccggggttccccggggttacccccgggtaaccccggggtacccggggg

SEQ ID NO: 232236 - DNA, 737 bp, Homo sapiens
  misc_feature: GYAE6OF01B752Q.5.27.C05.1.454.CMB.1.raw
  modified_base (286)..(286): a, c, t, g, unknown or other
  misc_feature (286)..(286): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagtctgggttttccttgttgcttaattttaaaaggtgtccagtgtgaggtgcagttggtggagtcgtgggggtaaccttggtccagccggtgggggtccctggagtactctccgtgtgtacgctcgtgtcgttcaccgtnagtagctaattacagtgagtcgtcgggtcccgacgaggtccttaccgaaggggttaacgggccgtagggacggttcgggtctacgtaaggtttattaagtacgaccgtagtacggaacccgctaacccgtacgttcgacgaacgtaccctccgggacggaggggccaaggtacttaccgaacctacgtcctaccgagaacgaacctaacgttaacccgaaacgtaaaccccttaacccgttttaacgtaccttaccgaaagtaacgtaacggtaaacctacgtcccgaagtaacggaaccgcccgggtaacggtaaccgtccggtaccttaggtacccttacgttaacgtcggtacgaacccggtaggtaccgtaccgtacggtccggtaccgttagggtacccgtaggacggttacgggtcccggttacccggaaccccgggtacggggg

SEQ ID NO: 232237 - DNA, 711 bp, Homo sapiens
  misc_feature: GYAE6OF01BIAO9.5.27.C05.1.454.CMB.1.raw
  modified_base (542)..(542): a, c, t, g, unknown or other
  misc_feature (542)..(542): n is a, c, g, or t
tcagatcagacacgcacgaccggtgctcgatttagacgcgatcgaagggtttggggctgggagaggagcccagcactgggattccgaggtgttccattcagtgatctgcactgaacacagaggactcgccatggagtttgggctgagcgttgggttttccttgttgcttaattttaaaaggtgtccagtgtgaggtgctagttggtggagtcgtagggggaaccttggtccagccgtgggggtccctgagactccgtcctgtgtacgcctctgtcgttaccaccgtcgagtacgactaacttacagtacgacggtcgtcggggtacccgtaccgacgggtccgtaccggtaaggggtaacggggccgttgggaaggttcgggtcttacgtagtttattagtacggacgtacgtacggaaccgacaacgtacgttcgacgagtaccgtccggtacggagggctaacggtactaccgaacctgtccctacgagaacgtaactaaacgttaccgaaacgtaacccttacccgtttataccgttanaacgtactaacggaacacggtaccgtaggaacgaccggcccggaaggtacccgtcggacttccggtaaccttaagttcgtacgtaggtactacggtctacgtacggtcggtacgtacggtacgcgggtacgtaccggtttcccgtacccggtaccccgggtaaccgggg

SEQ ID NO: 232238 - DNA, 664 bp, Homo sapiens
  misc_feature: GYAE6OF01AL4CG.5.27.C05.1.454.CMB.1.raw
  modified_base (180)..(180): a, c, t, g, unknown or other
  misc_feature (180)..(180): n is a, c, g, or t
  modified_base (585)..(585): a, c, t, g, unknown or other
  misc_feature (585)..(585): n is a, c, g, or t
tcagatcagacacgcacgaccggtgctcgatttagacgcgatcgaagggtttggggctgggagaggagcccagcacctgggattccgaggtgtttccattcagtgatctgcactgaacacagaggactcgccatggagtttgggctgagctggttttccttgttgctatttttaaaaggngtccagtgtgaggtgcagttggtggagtcggtggggaaccttggccagccgtggggggtccctgagactctcctgtgtagccttcgtcgcgttcaccgttcagtagctaattacagtgacgcgttcgggtcccgcgtaggctccgagggtaaggggctagggagtcgggtctcgtagtttattagagcgtagtcggaaaccgcgaacgtacgttccgacgtacggtacccgtccggacggtaggggactaaggactttaccgaccctacttcccgtacgaagaacggtacctaaacgtttacccgaaacgtaacccttacccgttttatacccttacgaagtacttaacggaactacgcctaggaccgacggaccgacgcctacggtcttacgacttagttacgngtcggacgaggtactccgacggttggccgttacggacctagggctaacggggttccgtcccggtaccccggtacggggg

SEQ ID NO: 232239 - DNA, 938 bp, Homo sapiens
  misc_feature: GYAE6OF01C0Z1M.5.27.C05.1.454.CMB.1.raw
tcagatcagacacgcacgaccggtgctcgatttagacgcgatcgaagggtttggggctgggagaggagcccagcactgggattccgaggttgtttccattcagtgatctgcactgaacacagaggactcgccagtggaggtttggctagagtcgtttgggttttccttgttagtactttaagttttaaaggtcgtcctaggttgtaggtagggtgtacgttaggttcgggttagggaggttccggggtaggggggtaaccctttcgggtacccgagggttcccggggttcggggggttcccctaggtaaccgtccttccgtcccgttggttaccggtacggtccccttcgtacggttaccgttacccggacccgttacgtaaaggtaccgtaactaacgtttaaccgagtacggacggtccggttaccgggcccgtaccggtacgtacccggttaaccggggaggggttaacgggcggttagggtagggttcgttacgttaacgttagttttacgttaggtacggacggttaaggaccggtaacccacgtaccgttaccggttacgaacgtaccggtccgtcgggaagggtacggactaagttcctaaccgactccttaaccgcgtaacgaactaactaaaccgttaaccgtaaacgtaaaccccctttacccgttttaattaccgtaacccggtaataaccggtaacctaacccggtagttaccgaaccgggtaaggggaaccccggttaaccggtaccgggttaccccgtaggttaccttaaccgttagtttaaacccgtcgttaacgggtacaacggggtacgtacgttaacccggttcgggtaaccgtttccgggttacggacccgttaaacggggtcgggtttaccccggggttccccggttaaacccccggggcggttaaacccccgggggg

SEQ ID NO: 232240 - DNA, 816 bp, Homo sapiens
  misc_feature: GYAE6OF01DSUF2.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccagtggtacgtttggctggagtcgtttgggtttttccttgtttagctttaagtttttaaaaggtgttccaggttgtggaggtgctaggttggtggtaggttcggtacgggggtaacctttggtaccaggtcccggttcggggggtccctaggacgtacctccgtccgttgtcgtacgtcctcgtcgtccgttccgaccgttcgagtacgaacttaattacacgtgacgtccggttacgggcccaccgtaggtccgtaccgggtaaggggttaacggggcggttgggtaacgggttcgggtcttacgttagtttaattagtagacgtagtacggaacccgtcaaccgtacgttcgacgtaacggtaccgtaccgggacggacgggtactaacggtacttaccgaaccttacgttacccaacggaagtaaccgtaaactaaaccgtttaaccgaaaacgttaaaccccgtttaaccctttactaaccgttacgaacggttaataaccggtaaacgaccgttccgtaagggaacctaccggaccggtaacgtccgtacggtacttacgttacgtaatttccggtagtacggaccgtaaggtaccttacggacggtttccgaccggttcgtaacccggacggttaccgggttagggttccccggtaaccccggcggggttaaacccgggg

SEQ ID NO: 232241 - DNA, 1020 bp, Homo sapiens
  misc_feature: GYAE6OF01DWRP3.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagtcgttcggttttcctgttgtacttaagttttaaaaggtcgtaccgaggtgtagaggtgcgtagttgggtggtagtcggtacgggggtaaccgtttcggtaccgacggtccgggtcggggggttacccctaggtaccgtacccgttccgttccgttggttacggtaccgtcccgttcgttacggtccgttaccgaccgtacgtagtaacgacttaaattacgagtcggtacggtccggttaccggggtcccgacggacggtacccgttacgggaacggggttaacgggtcggttaggggtacggttcgggttacttaacggtttagttttaagttaacgtacggtaacgtaaccggtaaccggaaccccgtacgtaaaccgtacccgttacggaccgtaaccggtaccggtcccgggaacgggtagggaacctacggttaccttaccgaaccgtacgttcccgtaacgaacgaaaccgttaacccttaaaacgttaaccccgaaaaccggttaccccttttaaacccgtttacgttacccttaaggaaaccgttaactaacggaaacccgttagggtaccgtaacgggtaaacccggaccggtaacccggggtacggttaacccggtttcccgggtaaccgtttaggttttaacccccgtaaagtttttaccgggtaccgggggttaaccggtaaaccgggtttaacccgggtttacgttaaacccccgggttcgggtttcggggttaaccccccggtttacccggggttacccgtaacgggggtttaaccccgggggtttacccccggggttttaccccgggggttaaaccccccccggtaaaccccccggggggttaaaccccgggggggg

SEQ ID NO: 232242 - DNA, 984 bp, Homo sapiens
  misc_feature: GYAE6OF01CHGCG.5.27.C05.1.454.CMB.1.raw
  modified_base (682)..(682): a, c, t, g, unknown or other
  misc_feature (682)..(682): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccagtggtagtttgggctggagtcgttgggtttttccttggttgtacttaagtttttaaaaggtcgtaccaggttggtggaggtgcgtaggtttgggtggtacggtcggttacggggggtaaccctttgggtcccgaggtcccgggttcgggggggtcccctaggacggtaccttccgttccgttggtacggtacgtccttcgtcgtccgttccaccgtcagtagtacctaattacagttgacggtccggtcggggtcccgccgacggtccgtaccggaaggggttaacggggcgtcgggtagggttcggtacgtcgtaagttttacttaagtaggaccgtaagtaccggtaaacccgctaacccgtaccgttcccggacgtaaccggtacccggtacccggggacggggtaacggggtaccgaagttaaacccgttaccgaacccgttacgttccccgttacccggaaaggttaaacccggtaaacccttaaaaaccctttaaccccgggaaaaacttttaaaccccccttaacccggttttttttaaaccncccggttttaacgaaaacggtttaacgtaaaacccgggtaaacctcccgggtacccgtaagggaacgggaaccccgggtaacccgggtaagggtcccgggttaccggttaccgtttagggtttaccccctttaaggtttacccgtagggtcccgggagttaaacggttaccccggtaacgttccgggggtttcgacccggggtttacccggaacccggtaacgggggtttacccgggttaacccggggggttttccccgggtaaaccccccggggtttccccgggggaaaccccgggggggg

SEQ ID NO: 232243 - DNA, 731 bp, Homo sapiens
  misc_feature: GYAE6OF01C2OKQ.5.27.C05.1.454.CMB.1.raw
  modified_base (191)..(191): a, c, t, g, unknown or other
  misc_feature (191)..(191): n is a, c, g, or t
  modified_base (390)..(390): a, c, t, g, unknown or other
  misc_feature (390)..(390): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatgggagtttgggctgagcgtggtttcttgtgtctatttaaaggtgtcagtgtgaggtgnagttggtggagtcggtaggggacttggtccagccgtcgggggtcctagagtactcctcctgtcgtaacgtcctcgtgtaccgttccgaacgtcagtacgacctaattacagtaggacgtcggttcgggacccgcgacggtcctaccggaggggtaaacgggcgtgggtaggtcgggtctacgtagtttattagtaacgngtaactacggaaccgctaactccgtcacgtaacgtaccgaccgggtacggaagggactaaggtactacccgaccgtactcctaccgaagtaacgtaacgaaccttaacccgtaaacggtaaaccccttacccgttttacttaccgttacgtaaacgtaacgttaaccgaaactaccgtaccgtaacgggaagtaccgggaacccggtacggtacccggtccggtactttacggttcctttaaacgtttcgtaggaccggtaagaccggtagtacgtacggccggttacggcgacgtaccgtcggtagggttccggttaaccccggcccgggtaacccgggg

SEQ ID NO: 232244 - DNA, 989 bp, Homo sapiens
  misc_feature: GYAE6OF01EUXFM.5.27.C05.1.454.CMB.1.raw
tcagatcagacacgcacgaccggtgctcgatttagacgcgatcgaagggtttggggctgggagaggagcccagcactgggattccgagtgttccattcagtgatctgcactgaacacagagactcgccagtcggaggtttgggctgagtcgttgggttttccttgttgtcttaagttttaaaaggtgtcctagtgtgaggtgctaggttggtggagtcggtcgggggtaaccttggtccgacggtccggtcgggggtccctggacgtacctcttccgtgtacgtcgtcctcgtcgtccgttcctaccgtacgaaggtacgactaacttacgtacgtaggaacgtccggtaccgggtcccgaccggacgggtccgtaccgggtaagggggtaaccgggtcgggtacgggtagggttcgggttcttacggttaagttttactttacggagtacggtaggtaaccggaaccgtacgtacctaaccttaccggacctaacggtacccggtacccgggtacgggacggggtactaacgggtaacccttaccgaacgttaccgtaccccttaaccggaaccgtaacgtaaaccttaacccgttaaaaacccggtaaaacccgttaaaaccccggttttaacccccttttaaaggtttacccttaaaaccggtaccgttaagttaaacccgtaaaccggtaacccggttacgtaaccgggtaaaaccgggccggtaaaccccggggttaccggttaaacccgggttacccgggttccgtttttaaaccggttaccgttttaaacccgtttaccggggttacggtttacggggaaaccggtaccggtttaaaccgggtaacccgttttacccggggtcgggttaccccccgggttaccggttaaacccggttacccgggggttaaacgggttacccccgggggttttcccgggggtttaaacccccgggtaccccccgggggggtttaaaccggggg

SEQ ID NO: 232245 - DNA, 900 bp, Homo sapiens
  misc_feature: GYAE6OF01CLNKD.5.27.C05.1.454.CMB.1.raw
  modified_base (731)..(731): a, c, t, g, unknown or other
  misc_feature (731)..(731): n is a, c, g, or t
  modified_base (854)..(854): a, c, t, g, unknown or other
  misc_feature (854)..(854): n is a, c, g, or t
  modified_base (867)..(867): a, c, t, g, unknown or other
  misc_feature (867)..(867): n is a, c, g, or t
tcagatcagacacgcacgaccggtgctcgatttagacgcgatcgaagggtttgggctgggagaggagcccagcactgggattccgaggtgtttccattcagtgatctgcactgaacacagaggactcgccagtggagtttgggctgagtcgttgggttttccttgttgcttattttaaaaggtgtccagtgtgagtgctagttggtggagtcggtagggggtaaccttggtccgaggccggttcgggggtccctaggacgtaccgtccgtccgttagtcggtacgtcccttcgttacggtccgtttacccgacccggttaccgtaaggttaacggtaccttaaaactttaccgtaacgtttcgggaaccggttccggttccgggggtacccccgaaccggtaccgggtacccgttacccgggtaaaggggggttaaccgggggtccgttagggggttaaccgggtttcgggttacccgtttaaccgttttaagttttttacgtttaaacgtaacgggtaccggttaacggttaaccgggaacccgtacccgttaaaccgttaacccgttcggaaccgtaaccggtacccggtacccgggacgggttaacgggcctaaggtaccgtttacccaaccgttaacgtcccgtaaccgaagtaaccgtaacctaaccgttaacccgaaaccgttaaccctttccccttttaatacccgttaagaagtaccggtaanaaccgtaccggtacttacggacgtaacccgggccggtaaaggggttccctcgggtattaccgggtttattacggttcgttcggaccgttacgtaacggtcgttactcgggttccgtacggtcncgtacggttcggngggtttccccgtacccggcccggttacccgggg

SEQ ID NO: 232246 - DNA, 735 bp, Homo sapiens
  misc_feature: GYAE6OF01BX1PM.5.27.C05.1.454.CMB.1.raw
  modified_base (312)..(312): a, c, t, g, unknown or other
  misc_feature (312)..(312): n is a, c, g, or t
  modified_base (441)..(441): a, c, t, g, unknown or other
  misc_feature (441)..(441): n is a, c, g, or t
  modified_base (551)..(551): a, c, t, g, unknown or other
  misc_feature (551)..(551): n is a, c, g, or t
  modified_base (565)..(565): a, c, t, g, unknown or other
  misc_feature (565)..(565): n is a, c, g, or t
  modified_base (573)..(573): a, c, t, g, unknown or other
  misc_feature (573)..(573): n is a, c, g, or t
tcagatcagacacgcacgaccggtgctcgatttagacgcgatcgaagggtttggggctgggagaggagcccagcactgggattcccgaggtgtttcccattcagtgatctgcactgaacacagaggactcgcctatggagtttgggctggagtccgttgggttttccttgttgcttaattttaaaaggtgtccagtgtgaggttgctagttggtggagtcgtagggggtaaccttggtcccaggtccggttcgggggtcccttagacgtacctacgtcctgtacgtcgtcctcgtgccgttaccgaccgttnaacgtacgacctaaagttacagtagacgtcgtagggtcccaccggtacggtcctaccggagggttaacggggctggtacggttggtccttagaggttttacttagtaagtcgtaaggtacggtaacccnccgaacgttaccgttacgacgtaaccgggtaccacggggacgggacgggacgtaggtacttcaacctacttcaccgagtacaactataaccgaacgtaacctacccgttnttaacgtcagtaanaccttaanaccgtacgtaggaaccgtacggtaccggaagttccggcgacgttcgtacttacgttaccgtgggttacgacggtacgtacgttacgtacggtcgggtacctacgggtacccggtaagacgggtttacgggtaccccggttccgggccccgggtaaaccgggg

SEQ ID NO: 232247 - DNA, 857 bp, Homo sapiens
  misc_feature: GYAE6OF01A430N.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccagtggagtttgggcttagagtcgttgggttttccttgttgtacttaatttttaaaaggtgttaccagttgtggaggtgcgtagttggtggaggttcgtacgggggtaaccttgggtaccaggtaccggttgggggtacacgtggacggtacgtccgttccgtggttacgtacgtccgttcgtcggtcgtttccgtaaccgtctaaggtacgtacctaaatttacgagtcggtaacgtccgttcggggtacccgaccggaaggtcctaccggaggggttaacgggcgttgggacggttggttctacgttagtttaagtttacgaggtggaacgtcggaaaccgtcacgtactcgacgacgtaccgtcggaccgggaggactacgtacgttacaccgtagttaccctacgaacggacgttaaacctaacgttaacccgtaaaggtaaccccctttaaccgttttacgtacccgtttaacgaacggtttaacttaaccgggtaaaccgtaccgttacccgtaagggtaaaaccggcccggttaaacccgggtaacgggtaacccggttccgtacggtttaacggttaaccctttaggtaccgtttacggacggtacccgggtaaagtaccggttaccggttaaccggccgggtaaccgttaccccgggtacgtacggggttaacccggttgggggtttaaaccccgggtcccggtaaccccccgggggg

SEQ ID NO: 232248 - DNA, 771 bp, Homo sapiens
  misc_feature: GYAE6OF01AUBMU.5.27.C05.1.454.CMB.1.raw
  modified_base (582)..(582): a, c, t, g, unknown or other
  misc_feature (582)..(582): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggtagtttgggctgagtcgttggttttccttgttgtcttaagttttaaaaggtgtcctagtggtgtaggtgcgtagttgggtggtaggtcggtacgggggtaaccgtttcggtccgacggtccggttcggggggttcccctaggtacgtacctccgtcctagtcgtacgtccttcgtcgtccgttaccgaccgtcgtacgtacgtactaacttacacgttgacgtccgtcgggtaccgccgtaggtcccgtaccggtaggggtaaggggtccgtagggtacggttcgggtctacgttagttttagtttaagtacggacgtaagtacggaacccgtctaaccgtaccgttcgacgaccgaccgtcggacggagggtacacgtactacacctctacctaccgaagacgtaactaaactaaccgaagtaaccctttaccgttattaccgtanaacgtacgtaaccgaacgacggtaccgtacggaacgtaccggacccgtaacggtccgttaccgtacgttacgtacgttacgtacggtcgttacggacgtagtaccgtcggacggttaccggtcggttaccgtaacccgtggttacccggttaacgggttcccgggtacccggtaccccggggtaccggg

SEQ ID NO: 232249 - DNA, 673 bp, Homo sapiens
  misc_feature: GYAE6OF01CCSC5.5.27.C05.1.454.CMB.1.raw
  modified_base (182)..(182): a, c, t, g, unknown or other
  misc_feature (182)..(182): n is a, c, g, or t
  modified_base (329)..(329): a, c, t, g, unknown or other
  misc_feature (329)..(329): n is a, c, g, or t
  modified_base (517)..(517): a, c, t, g, unknown or other
  misc_feature (517)..(517): n is a, c, g, or t
  modified_base (584)..(584): a, c, t, g, unknown or other
  misc_feature (584)..(584): n is a, c, g, or t
tcagatcagacacgcacgaccggtgctcgatttagacgcgatcgaagggtttgggctgggagaggagcccagcactgggattccgaggtggtttccattcagtgatctgcactgaacacagaggactcgccatggagtttggctgagcttgggttttcctagttgcttaagttttaaacggngtccagtgtggaggtgcgagttggtggagtcgtgggggaaccttggacctaggtcccggtgggggtccctggacgtacctctccgtgtgtacgcctctggccgttcaccgtcgtagtacgtcaatttcatagactcgtcgggtcccncgaggtcctaccgagggtaacggggctggtagtcgggtcctacgtagtttattagagtcgtagtcgacgcacgtactcgacacgtactcgcggaggcagtaacgtcactagcctaccaaggtacactaaagtccccaaagaacccccttcccgttttaaccgtttacaacggtattacgaaaccgtancccgtagaaccgaaggcccgaacggtacgtccggacttggttacctacggttttaagcggttaacgnggtaacgtacctgttaccggtggacccgtttcggacccctaagggtccgttaacgggtccgggttcccccgcggggttaaacccggggg

SEQ ID NO: 232250 - DNA, 261 bp, Homo sapiens
  misc_feature: GYAE6OF02HORXB.5.27.C05.1.454.CMB.1.raw
  modified_base (258)..(261): a, c, t, g, unknown or other
  misc_feature (258)..(261): n is a, c, g, or t
tcagatcagacacgcacgaccggtgctcgatttagacgcgatcgaagggtttgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccgccctcctccgtgtctgatctgagcgggctggcaaggcgcatagnnnn

SEQ ID NO: 232251 - DNA, 262 bp, Homo sapiens
  misc_feature: GYAE6OF02GJ1HX.5.27.C05.1.454.CMB.1.raw
  modified_base (258)..(262): a, c, t, g, unknown or other
  misc_feature (258)..(262): n is a, c, g, or t
tcagatcagacacgcacgaccggtgctcgatttagacgcgatcgaagggtttgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccaccctcctccgtgtctgatctgagcgggctggcaaggcgcatagnnnnn

SEQ ID NO: 232252 - DNA, 259 bp, Homo sapiens
  misc_feature: GYAE6OF02IESE6.5.27.C05.1.454.CMB.1.raw
  modified_base (256)..(259): a, c, t, g, unknown or other
  misc_feature (256)..(259): n is a, c, g, or t
tcagatcagacacgcacgaccggtgctcgatttagacgcgatcgaagggtttgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccaccctcctccgtgtctgctgagcgggctggcaaggcgcatagnnnn

SEQ ID NO: 232253 - DNA, 522 bp, Homo sapiens
  misc_feature: GYAE6OF02IQ7QK.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagcctggggggtccctgagactctcctgtgtagcctctgcgttcaccgtcagtagcaattacatgagctgggtccgccaggctccaggtaaggggctggagtgggtctcagttatttatagcgatggaaccgcacacttcgcagactccgcgaggggcagattcaccatctccagagacaattccaagaaccaccctttatccttcagatgaacagcctgagagccgaggactcggctgtctattactgtgcgaggagtcactggctggtccagcaggtggttccgacccgtcgggg

SEQ ID NO: 232254 - DNA, 518 bp, Homo sapiens
  misc_feature: GYAE6OF02FTWF8.5.27.C05.1.454.CMB.1.raw
  modified_base (377)..(377): a, c, t, g, unknown or other
  misc_feature (377)..(377): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagcctggggggtccctgagactctcctgtgtagcctctgcgttcaccgtcagtagcaattacatgagctgggtccgccaggctccaggtaaggggctgggagtgggtctcagttatttatagcgatggaaccgcacacttcgcagactccgngaggggcagattcaccatctccagagacaattccaagaacacccttatcttcagatgaacagcctgagagcgagactcggctgtctattactgtgcgagagtcactggctggtccagcaggtcggttcgaccccgtcgggg

SEQ ID NO: 232255 - DNA, 261 bp, Homo sapiens; identical to SEQ ID NO: 232026
  misc_feature: GYAE6OF02HH6OA.5.27.C05.1.454.CMB.1.raw
  modified_base (258)..(261): a, c, t, g, unknown or other
  misc_feature (258)..(261): n is a, c, g, or t

SEQ ID NO: 232256 - DNA, 546 bp, Homo sapiens
  misc_feature: GYAE6OF02I5TFJ.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggtttccttgttgctattttaaaggtgtccagtgtgaggtgcagttggtggagtcgtgggggaaccttggtccagcctggggggtccctgagactctcctgtgtagcctctgcgttcaccgtcagtagcaattacatgagctgggtccgccaggcctccgagggtaaggggctgggagtgggtctcgagtttattatagcaagtggaaccgcacacttcgcagctcgcggaggggcagattcacatcctccagacgacaattccaagaacctacccttatccttacagtatagaacacgcctagagacgccgagacgtcggacttgtcttattacgtgtgacgagtagtacacgtgcgtcggtacaggcgtaggtcggttccggacccgtcgggg

SEQ ID NO: 232257 - DNA, 520 bp, Homo sapiens
  misc_feature: GYAE6OF02HIFUP.5.27.C05.1.454.CMB.1.raw
  modified_base (478)..(478): a, c, t, g, unknown or other
  misc_feature (478)..(478): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagcctggggggtccctgagactctcctgtgtagcctctgcgttcaccgtcagtagcaattacatgagctgggtccgccaggctccaggtaaggggctggagtgggtctcagttattatagcgatggaaccgcacacttcgcagactccgcgaggggcagattcaccatctccagagacaattccaagaacaccctttatcttcagatgaacagcctgagagccgaggactcggctgtctattactgtgcgagngtcactggctggtccagctaggtcggttcgaccccgtcgggg

SEQ ID NO: 232258 - DNA, 526 bp, Homo sapiens
  misc_feature: GYAE6OF02GXRB3.5.27.C05.1.454.CMB.1.raw
  modified_base (441)..(441): a, c, t, g, unknown or other
  misc_feature (441)..(441): n is a, c, g, or t
  modified_base (480)..(480): a, c, t, g, unknown or other
  misc_feature (480)..(480): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagcctggggggtccctgagactctcctgtgtagcctctgcgttcaccgtcagtagcaattacatgagctgggtccgccaggctccaggtaaggggctggagtgggtctcagttattatagcgatggaaccgcacacttcgcagactccgcgaggggcagattcaccatctccagagacaattccaaagaacctaccctttatcttcagatgaacancctgagagccgagactcggctgtctattactgtgcgagngtcacgtggcttggccaggccgagggtcggttccgacccgtcgggg

SEQ ID NO: 232259 - DNA, 528 bp, Homo sapiens
  misc_feature: GYAE6OF02GU7WK.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagcctggggggtccctgagactctcctgtgtagcctctgcgttcaccgtcagtagcaattacatgagctgggtccgccaggctccaggtaaggggctgggagtgggtctcagttatttatagcgatggaaccgcacacttcgcagactccgcgaggggcagattcaccatctccagagacaattccaaagaacaccctttatcttacagatgaacagcctagagacgccgaggactcggctgtctattactgtgcgagagtcacgtggctggtccaggcgaggtcggttccgacccgtcgggg

SEQ ID NO: 232260 - DNA, 532 bp, Homo sapiens
  misc_feature: GYAE6OF02FVQMP.5.27.C05.1.454.CMB.1.raw
  modified_base (379)..(379): a, c, t, g, unknown or other
  misc_feature (379)..(379): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagcctggggggtccctgagactctcctgtgtagcctctgcgttcaccgtcagtagcaattacatgagctgggtccgccaggctccaggtaaggggctgggagtggggtctcgagttatttatagcgatggaaccgcacacttcgcagactccgngaggggcagattcaccatctccagagacaatccaaagaacctaccctttatccttcagtatagaacagcctgagagccgaggactcggctgtctattactgtgcgagcgtcacgtggctggtccagcgtagggtcggttccgacccgtcgggg

SEQ ID NO: 232261 - DNA, 515 bp, Homo sapiens
  misc_feature: GYAE6OF02I6UWT.5.27.C05.1.454.CMB.1.raw
  modified_base (474)..(474): a, c, t, g, unknown or other
  misc_feature (474)..(474): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggtttccttgttgctatttaaaaggtgtccagtgtgaggtgcagttggtggagtctgggggaaccttggtccagcctgggggtccctgagactctcctgtgtagcctctgcgttcaccgtcagtagcaattacatgagctgggtccgccaggctccaggtaaggggctggagtgggtctcagttatttatagcgatggaaccgcacacttcgcagactccgcgaggggcagattcaccatctccagagacaattccaagaaccacccttatcttcagatgaacagcctgagagccgagactcggctgtctatactgtgcgagngtcacgtgctggtccagcaggtcggttccgacccgtcgggg

SEQ ID NO: 232262 - DNA, 760 bp, Homo sapiens
  misc_feature: GYAE6OF02FEN06.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccagtggagttggctgagtcgtggtttctgtagtactatttaaaggtgtcagtgtgaggtgcgtaggttggtggtagtcggtacggggtaaccttcggtccgacggtccggtcgggggtccctgacgtcctctccgtgtcgtcgtcctcgtcgtccgttacgaccgtactaacggtacgacttaacgttacgtacgtcggacgtccggtcggtcccgacggtacggtaccgtaccgggtagggtacggtcgtaggtaggtcggtactagttagttagttagacgacgacgtacgaccacacgtaccgtacgcgacgtcgcggacggacggtacacgtaccaccaactaccgtaccaacgtaagtaaaccgtaaccttaaccgtaacctaaaccgttaaccctacgttacgttacgaacgaagtacgaacgtacggtccgtaggacggtacgaccggtaccggtaacgttcgtaccgttacgtaacttaggttccgttaacggacggttaccgaacggtccggttaaccgtaccggtaccgggtccgttacccggtacgggtaccggttaccgggttacccggggtaccgggtttaccccccgggtaaccgggtaccccgggggtaacccgg

SEQ ID NO: 232263 - DNA, 523 bp, Homo sapiens
  misc_feature: GYAE6OF02I59MH.5.27.C05.1.454.CMB.1.raw
  modified_base (477)..(477): a, c, t, g, unknown or other
  misc_feature (477)..(477): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggtttccttgttgctattttaaaaggtgtccagtgtgaggtgcagttggtggagtctgggggaaccttggtccagcctggggggtccctgagactctcctgtgtagcctctgcgttcaccgtcagtagcaattacatgagctgggtccgccaggctccaggtaaggggctggagtgggtctcagttattatagcgatggaaccgcacacttcgcagactccgcgaggggcagattcaccatctccagagacaattccaagaacaccctttatcttcagatgaacagcctgagagccgaggactcggctgtctattactgtgcgagngtcacgtggctggtccaggccgaggtcggttccgaccccgtcgggg

SEQ ID NO: 232264 - DNA, 530 bp, Homo sapiens
  misc_feature: GYAE6OF02H6YT7.5.27.C05.1.454.CMB.1.raw
  modified_base (463)..(463): a, c, t, g, unknown or other
  misc_feature (463)..(463): n is a, c, g, or t
  modified_base (486)..(486): a, c, t, g, unknown or other
  misc_feature (486)..(486): n is a, c, g, or t
tcagatcagacacgcacgaccggtgctcgatttagacgcgatcgaagggtttgggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagcctggggggtccctgagactctcctgtgtagcctctgcgttcaccgtcagtagcaattacatgagctgggtccgccaggctccgaggtaaggggctggagtgggtctcagttattatagcgatggaaccgcacacttcgcagactccgcgaggggcagattccaccatctccagagacaattccaaagaaccaccttttatcttacagatagaacagcctgaagagccgaggacncggctgtctattactgtgcgagngtaccatggctggtccaggcagggtcgttcccgacccgtcgggg

SEQ ID NO: 232265 - DNA, 522 bp, Homo sapiens
  misc_feature: GYAE6OF02FTYDJ.5.27.C05.1.454.CMB.1.raw
  modified_base (396)..(396): a, c, t, g, unknown or other
  misc_feature (396)..(396): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagcctggggggtccctgagactctcctgtgtagcctctgcgttcaccgtcagtagcaattacatgagctgggtccgccaggctccgaggtaaggggctggagtgggtctcagttatttatagcgatggaaccgcacacttcgcagactccgcgaggggcagattcacatcncagagacaattccaagaacacccttatcttcagatgaacagcctgagagccgaggactcggctgtctattactgtgcgagagtcactggctggtccaggcgagggtcggttccggacccgtcgggg

SEQ ID NO: 232266 - DNA, 525 bp, Homo sapiens
  misc_feature: GYAE6OF02I3ESX.5.27.C05.1.454.CMB.1.raw
  modified_base (361)..(361): a, c, t, g, unknown or other
  misc_feature (361)..(361): n is a, c, g, or t
  modified_base (438)..(438): a, c, t, g, unknown or other
  misc_feature (438)..(438): n is a, c, g, or t
  modified_base (479)..(479): a, c, t, g, unknown or other
  misc_feature (479)..(479): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggtttccttgttgctattttaaaaggtgtccagtgtgaggtgcagttggtggagtctgggggaaccttggtccagcctggggggtccctgagactctcctgtgtagcctctgcgttcaccgtcagtagcaattacatgagctgggtccgccaggctccaggtaaggggctgggagtgggtctcagttatttatagcgatggaaccgcacncttcgcagactccgcgaggggcagattcaccatctcagagacaattccaagaacaccctttatcttcagatcgaacngcctgagagccgaggactcggctgtctattactgtgcgagngtcacgtggctggccaggccgtagggtcggttccgacccgtcgggg

SEQ ID NO: 232267 - DNA, 536 bp, Homo sapiens
  misc_feature: GYAE6OF02FQR7O.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcgtggtttcgtgtgctatttaaaggtgtccagtgtgaggtgcagttggtggagtctgggggaaccttggtccagcctggggggtccctgagactctcctgtgtagcctctgcgttcaccgtcagtagcaattacatgagctgggtccgccaggctccgaggtaaggggctggagtgggtctcgagttattatagcgatggaaccgcacacttcgctacgactccgcgaggggcaggacttcaccatctcccagacgacaattccaagaacctaccctttaatcttacagatgaacagcctgagacgccgagactcggctgtctattactgtgcgagagtcacgtggcgttggtccgagccgtagggtcggttaccggacccgtcgggg

SEQ ID NO: 232268 - DNA, 646 bp, Homo sapiens
  misc_feature: GYAE6OF02IHC72.5.27.C05.1.454.CMB.1.raw
  modified_base (296)..(296): a, c, t, g, unknown or other
  misc_feature (296)..(296): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcggtggttcgtcgtaggctatttaaagtagtcagtgtgagtgcagttggtgagtctgggggaaccttggtccagccgtgggggtccctgagactctcctgtgtgcctctgcgttcaccgtcagtagcaattacatgagcgtgggtccncgaggctccgaggtagggctggagtggtctgagtttattagtagcgtagtacggaacccgcaactaccgttcggacacgtaccgtccggacgacgggggaccaggtagtttcccaaccgtattcctacccgaaggaacaactaacttacccaaaaggtaaccctacccttttaatcctttacaagtactacgaaactcgacctaggaacgtacggcccgtaaggacccgtcggtacttacgggttactaaccgtttatggtccgtacggaagtcggtaacctggtcggtaccgttacgaccgtacggaccgttaggggtttccggttacccggacccggtacccgggggg

SEQ ID NO: 232269 - DNA, 528 bp, Homo sapiens
  misc_feature: GYAE6OF02JD5CQ.5.27.C05.1.454.CMB.1.raw
  modified_base (360)..(360): a, c, t, g, unknown or other
  misc_feature (360)..(360): n is a, c, g, or t
  modified_base (432)..(432): a, c, t, g, unknown or other
  misc_feature (432)..(432): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggtttccttgttgctattttaaaaggtgtccagtgtgaggtgcagttggtggagtctgggggaaccttggtccagcctggggggtccctgagactctcctgtgtagcctctgcgttcaccgtcagtagcaattacatgagctgggtccgccaggctccaggtaaggggctgggagtggggtctcagttatttatagcgattggaaccgnacacttcgcagactcgcgaggggcagatcaccatctccagagacaattccaagaacaccctttatcttacanatgaacagcctgagagccgagactcggctcgtctattactgtgcgaggagtcacgtggctggtccacggcagggtcggttaccgaccccgtcgggg

SEQ ID NO: 232270 - DNA, 527 bp, Homo sapiens
  misc_feature: GYAE6OF02GNUL3.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagcctggggggtccctgagactctcctgtgtagcctctgcgttcaccgtcagtagcaattacatgagctgggtccgccaggctccaggtaaggggctggagtgggtctcagttatttatagcgatggaaccgcacacttcgcagactccgcgaggggcagattccaccatctccagagacaattccaaagaacctaccctttatccttacagatgaacagcctgagagccgaggactcgctgtctattctgtgcgagagtcacgtggctggtccaggcgagggtcggtccgacccgtcgggg

SEQ ID NO: 232271 - DNA, 526 bp, Homo sapiens
  misc_feature: GYAE6OF02F4VS0.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttgggtccagcctggggggtccctgagactctcctgtgtagcctctgcgttcaccgtcagtagcaattacatgagctgggtccgccaggctccaggtaaggggctggagtggggtctcagttatttatagcgatggaaccgcacacttcgcagactccgcgaggggcagattcaccatctccagagacaattccaagaacaccctttatcttcagatgaacagcctgagagccgagactcggctgtctattactgtgcgagacgtcacgtggctggtccaggccagggtcggttccgacccctcgggg

SEQ ID NO: 232272 - DNA, 531 bp, Homo sapiens
  misc_feature: GYAE6OF02G1W3P.5.27.C05.1.454.CMB.1.raw
  modified_base (395)..(395): a, c, t, g, unknown or other
  misc_feature (395)..(395): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctatttaaaaggtgtccagtgtgaggtgcagttggtggagtctgggggaaccttggtccagcctggggggtccctgagactctcctgtgtagcctctgcgttcaccgtcagtagcaattacatgagctgggtccgccaggctccgaggtaaggggctggagtgggtctcgagttatttatagcgatggaaccgcacacttcgcagactccgcgagggcagattcacatcnccagagacaatccaaagaactaccctttatcttcagatgaacagcctgagacgccgaggactcggctgtactattactgtcgacgagtcgtcacgtggctggtcccaggcctagggtcggttccgacccgtcgggg

SEQ ID NO: 232273 - DNA, 636 bp, Homo sapiens
  misc_feature: GYAE6OF02J3AX1.5.27.C05.1.454.CMB.1.raw
  modified_base (560)..(560): a, c, t, g, unknown or other
  misc_feature (560)..(560): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtgagtcgtggggaaccttggtccaggccgtggggggtccctgacgactctcctgtgtacgcctctgcgttcaccgtcagtagactaattacatgagcgtggtcccgcgaggtcctaccgagggtacgggctgggtagtcgggtctcgtagtttatttagtaggcgtagtcggaaccgcactacgttcgctacggaccgtccggacggacgggcaacggtacttaccaccgtactccaccgagaacgaacctaaacttaccgaaacgtaacccttaaccgtttatccttaacaagtaactacgaactacgcctagaacgaccgtaccggaggtaccgttcggtactagtacgtattacgngtacgcggagtacgtcgacgtcgtccgtacggacctacggtccgtacgggttccggtacccggtcccggtacgggg

SEQ ID NO: 232274 - DNA, 525 bp, Homo sapiens
  misc_feature: GYAE6OF02I96OF.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagcctggggggtccctgagactctcctgtgtagcctctgcgttcaccgtcagtagcaattacatgagctgggtccgccaggctccaggtaaggggctgggagtgggtctcagttatttatagcgatggaaccgcacacttcgcagactccgcgaggggcagattcaccatctcagagacaattccaagaacaccctttatcttcagatgaacagcctgagagccgagactcggctgtctatactgtgcgagcgtcacgtggctggcccagccgtagggtcggttccgaccccgtcggggg

SEQ ID NO: 232275 - DNA, 261 bp, Homo sapiens; identical to SEQ ID NO: 232250
  misc_feature: GYAE6OF02HK5JL.5.27.C05.1.454.CMB.1.raw
  modified_base (258)..(261): a, c, t, g, unknown or other
  misc_feature (258)..(261): n is a, c, g, or t

SEQ ID NO: 232276 - DNA, 530 bp, Homo sapiens
  misc_feature: GYAE6OF02FQBUE.5.27.C05.1.454.CMB.1.raw
  modified_base (437)..(437): a, c, t, g, unknown or other
  misc_feature (437)..(437): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagcctggggggtccctgagactctcctgtgtagcctctgcgttcaccgtcagtagcaattacatgagctgggtccgccaggctccgaggtaaggggctgggagtggggtctcagttatttatagcgatggaaccgcacacttcgcagactccgcgaggggcagattcaccatctccagagacaattccaaagaacacccttatcttcagatnaacagcctgagagccgaggactcggctgtctattactgtcgcgagacgtcacgtggctggtccagccgagggtcggttccgaccccgtcgggg

SEQ ID NO: 232277 - DNA, 536 bp, Homo sapiens
  misc_feature: GYAE6OF02HUXYG.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcgtggttttccttgttgctatttaaaaggtgtccagtgtgaggtgcagttggtggagtctgggggaaccttggtccagcctggggggtccctgagactctcctgtgtagcctctgcgttcaccgtcagtagcaattacatgagctgggtcagccaggctccagggtaagggctgggagtgggtctcgagtttatttatagcgatgggaaccgcacacttcgcagactccgcgagggcagattcaccatctccagagacaattccaaagaacctacccttattcttacagtatagaacacgcctgaagagccgaggactcgctgtactattactgtgcgagtacgtcacgttggctcggtccagtcgtaggttcggttccgaccccggg

SEQ ID NO: 232278 - DNA, 525 bp, Homo sapiens
  misc_feature: GYAE6OF02GDTS8.5.27.C05.1.454.CMB.1.raw
  modified_base (482)..(482): a, c, t, g, unknown or other
  misc_feature (482)..(482): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagcctggggggtccctgagactctcctgtgtagcctctgcgttcaccgtcagtagcaattacatgagctgggtccgccaggctccaggtaaggggctgggagtgggtctcagttatttatagcgatggaaccgcacacttcgcagactccgcgaggggcagattcaccatctccagagacaattccaagaacaccctttatccttcagatgaacagcctgagacgccgaggactcggctgtctattactgtgcgagngtcacgtggctggtccagcgaggtcggttccgacccgtcgggg

SEQ ID NO: 232279 - DNA, 275 bp, Homo sapiens
  misc_feature: GYAE6OF02IDX6R.5.27.C05.1.454.CMB.1.raw
  modified_base (256)..(275): a, c, t, g, unknown or other
  misc_feature (256)..(275): n is a, c, g, or t
tcagatcagacacgcacgaccggtgctcgatttagacgcgatcgaaggtttgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccaccctcctccgtgtctgatctgagcggctggcaaggcgcatagnnnnnnnnnnnnnnnnnnnn

SEQ ID NO: 232280 - DNA, 532 bp, Homo sapiens
  misc_feature: GYAE6OF02IJA3Z.5.27.C05.1.454.CMB.1.raw
  modified_base (347)..(347): a, c, t, g, unknown or other
  misc_feature (347)..(347): n is a, c, g, or t
  modified_base (487)..(487): a, c, t, g, unknown or other
  misc_feature (487)..(487): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagcctggggggtccctgagactctcctgtgtagcctctgcgttcaccgtcagtagcaattacatgagctgggtccgccaggctccgagggtaaggggctggagtgggtctcgagtttattanagcgatcggaaccgcacacttcgcagactccgcgaggggcagattcaccatctccagagacaattaccaagaacctaccctttatcttacagatgaacagcctgagagccgagacgtcgctgtactattactgtgcgagngtcactggcctggtccagcgagggtcggttcccgacccgtcgggg

SEQ ID NO: 232281 - DNA, 637 bp, Homo sapiens
  misc_feature: GYAE6OF02H0F0W.5.27.C05.1.454.CMB.1.raw
  modified_base (296)..(296): a, c, t, g, unknown or other
  misc_feature (296)..(296): n is a, c, g, or t
  modified_base (357)..(357): a, c, t, g, unknown or other
  misc_feature (357)..(357): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcggtggtttcgtgtaggcgtatttaaagtgtcagtgtgagtgcagttggtgagtctgggggaaccttggtccagccgtgggggtccctgagactctcctgtgtagcctctgcgttcaccgttcagtgcaattacatgagctgggtccnccaggcctccgagggtacgggctaggcgtggtctgagttatttacgagcgatcggaacccnctactacgtcgacgtacgaccgtccgacggacggcgtagtacgtaccgactactccgtacgaggtaacaacctaactaaccgaaacgtaacccttacccgtttaataccttaacgagtactaacgaaccgacgtacctaggacgacggtacgtacggtaccgtacggtacgttcgtacgttacgttacgtcgtacgacgtacggtacgtaccgtacggtcggtaccgtcggaccgtacggtccgtaacgggtttcccggtacccggtacccggtacgggg

SEQ ID NO: 232282 - DNA, 539 bp, Homo sapiens
  misc_feature: GYAE6OF02IB0Z4.5.27.C05.1.454.CMB.1.raw
  modified_base (407)..(407): a, c, t, g, unknown or other
  misc_feature (407)..(407): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagcctggggggtccctgagactctcctgtgtagcctctgcgttcaccgtcagtagcaattacatgagctgggtccgccaggctccgagggtaaggggctggagtgggtctcgagtttatttatagcgtatggaaccgcacacttcgcagactccgcgaggggcagattccacatctccaganacaattccaaagaacctaccctttatcttacagatagaacagcctgagagccgaggactcggctgtactattacgtgtcgcgagacgtcacgtggctggtccaggccgagggttcggtccgacccgtcgggg

SEQ ID NO: 232283 - DNA, 539 bp, Homo sapiens
  misc_feature: GYAE6OF02JHJ1N.5.27.C05.1.454.CMB.1.raw
  modified_base (301)..(301): a, c, t, g, unknown or other
  misc_feature (301)..(301): n is a, c, g, or t
  modified_base (344)..(344): a, c, t, g, unknown or other
  misc_feature (344)..(344): n is a, c, g, or t
  modified_base (357)..(357): a, c, t, g, unknown or other
  misc_feature (357)..(357): n is a, c, g, or t
  modified_base (441)..(441): a, c, t, g, unknown or other
  misc_feature (441)..(441): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagcctggggggtccctgagactctcctgtgtagcctctgcgttcaccgtcagtagcaattacatgagctgggtccnccaggctccgaggtaagggctggagtgggtctcagttatttanagcgatggaaccncacacttcgcagactccgcgaggggcagattcaccatctcagagacaattccaagaacctacccttatcttacagactgaacancctgagacgccggagactcggctgtctaattactgtgcgagtacgtctacgtcggacgtggtaccgagcctagggtcggttaccgaccccgtacgggg

SEQ ID NO: 232284 - DNA, 544 bp, Homo sapiens
  misc_feature: GYAE6OF02JMAFN.5.27.C05.1.454.CMB.1.raw
  modified_base (300)..(300): a, c, t, g, unknown or other
  misc_feature (300)..(300): n is a, c, g, or t
  modified_base (358)..(358): a, c, t, g, unknown or other
  misc_feature (358)..(358): n is a, c, g, or t
  modified_base (376)..(376): a, c, t, g, unknown or other
  misc_feature (376)..(376): n is a, c, g, or t
  modified_base (392)..(392): a, c, t, g, unknown or other
  misc_feature (392)..(392): n is a, c, g, or t
  modified_base (400)..(400): a, c, t, g, unknown or other
  misc_feature (400)..(400): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctatttaaaggtgtccagtgtgaggtgcagttggtggagtcgtgggggaaccttggtccagcctggggggtccctgagactctcctgtgtagcctctgcgttcaccgtcagtagcaattacatgagctgggtccnccaggctccgaggtaaggggctggagtgggtctcgagttattatagcgatggaaccgnacacttcgcagactccgngaggggcagattcacntctcaganacaattccaagaacctaccttatcttacagtatgaacagcctagagacgaccgagacgtcggcttggtactagttactggtgacgagaaggtcagtcggctacggtccaggccgtagggttcggttccgacccccggtacgggg

SEQ ID NO: 232285 - DNA, 601 bp, Homo sapiens
  misc_feature: GYAE6OF02IWPFX.5.27.C05.1.454.CMB.1.raw
  modified_base (381)..(381): a, c, t, g, unknown or other
  misc_feature (381)..(381): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggtttccttgttgctattttaaaaggtgtccagtgtgaggtgcagttggtggagtcgtgggggaaccttggtccagcctggggggtccctgagactctcctgtgtagcctctgcgttcaccgtcagtagcaattacatgagctgggtccgcaggctccgagggtaaggggctgggagtgggtctcgtagttatttatagcgatggaaccgcaacacttcgcagactccgngaggggcagattcaccatccacagaagacaacttaccaaagaacctaaccctttatccttacagaactagaaccgagccctaggacgacggacccgaggaccgttcggccttacgtccttaagtttaccgtggtcgacggtaagtacggtacaacgttgggtaccttcgggttaccaggtccgtaggggtttcggttacccggtaccccgggtacggggg

SEQ ID NO: 232286 - DNA, 567 bp, Homo sapiens
  misc_feature: GYAE6OF02F7TPU.5.27.C05.1.454.CMB.1.raw
  modified_base (303)..(303): a, c, t, g, unknown or other
  misc_feature (303)..(303): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagcctggggggtccctgagactctcctgtgtagcctctgcgttcaccgtcagtagcaattacatgagctggggtcccnccgaggctccgagggtaaggggctgggagtgggtctcgagttatttatagcgagtcggaaccgcactacttcgcagactccgcggaggggcagatccacatctccagagacaataccaacgaaactaccctttatcttacagtatagaacacgcctgaagacgaccggacgactcggctcgtacttaattaccgtgtagcggtaagcgtactacgtggcgttcggtccacggtcgtacgggttcggttccgaccccggtcgggg

SEQ ID NO: 232287 - DNA, 524 bp, Homo sapiens
  misc_feature: GYAE6OF02G33H0.5.27.C05.1.454.CMB.1.raw
  modified_base (427)..(427): a, c, t, g, unknown or other
  misc_feature (427)..(427): n is a, c, g, or t
  modified_base (436)..(436): a, c, t, g, unknown or other
  misc_feature (436)..(436): n is a, c, g, or t
  modified_base (440)..(440): a, c, t, g, unknown or other
  misc_feature (440)..(440): n is a, c, g, or t
  modified_base (478)..(478): a, c, t, g, unknown or other
  misc_feature (478)..(478): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttggctattttaaaaggtgtccagtgtgaggtgcagttggtggagtctgggggaaccttggtccagcctggggggtccctgagactctcctgtgtagcctctgcgttcaccgtcagtagcaattacatgagctgggtccgccaggctccaggtaaggggctggagtggggtctcagttatttatagcgatggaaccgcacacttcgcagactccgcgaggggcagattcaccatctccagagacaattccaagaacaccctttancttcagatnaacngcctgagagccgagactcggctgtctatctgtgcgagngtcacgtggctggtccaggcgagggtcggttaccgccccgtcgggg

SEQ ID NO: 232288 - DNA, 541 bp, Homo sapiens
  misc_feature: GYAE6OF02IL20J.5.27.C05.1.454.CMB.1.raw
  modified_base (343)..(343): a, c, t, g, unknown or other
  misc_feature (343)..(343): n is a, c, g, or t
  modified_base (498)..(498): a, c, t, g, unknown or other
  misc_feature (498)..(498): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggtttccttgttgctattttaaaggtgtccagtgtgaggtgcagttggtggagtctgggggaaccttggtccagcctggggggtccctgagactctcctgtgtagcctctgcgttcaccgtcagtagcaattacatgagctgggtccgccaggctcgagggtaaggggctgggagtgggtctcagttattanagcgatcggaaccgcacacttcgcacgactcgcgaggggcagattcactatctaccagagacaattccaaagaacctacccttttatccttacaagtactagaacagtacctgagacgccgaggactcggcttgtctattacgtgtgcgtaaggntacacgtggctggtccagcgagggtcgttaccgacccgtcggg

SEQ ID NO: 232289 - DNA, 593 bp, Homo sapiens
  misc_feature: GYAE6OF02G3UMO.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgcttattttaaaaggtgtccagtgtgaggtgcaggttggtggagtcgtgggggaaccttggtccagccgtggggggtccctgagactctcctgtgtagcctctgccgttcaccgtcagtagcaattacatggagcgtcggggtccgccgaggcctaccgagggtaaggggctgggaggtgggttctctagtttatttagagtcgagtagaaccgcactactcgcagactcgcggagggcagactcacatctacagacaactaattaccaaagaacctacctttatcttacagtactacgaacagcctagacgacgaccgacgacgtcgctgtacttaattcgtgtcgacgaaggtcgtccaacggtcggccgttacggtacccgaggtccggtacgggttcggttacccggacccccggttaccggggg

SEQ ID NO: 232290 - DNA, 551 bp, Homo sapiens
  misc_feature: GYAE6OF02HCQKH.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaccttggtccagcctggggggtccctgagactctcctgtgtagcctctgcgttcaccgtcagtagcaattacatgagctgggtccgccaggctccgaggtaaggggctggagtgggtctcagttatttatagcgatggaaccgcacacttcgcagactccgcgaggggcaggattcacatctccagagacaatccaagaacaccctttatcttacagatgaacagcctagagacgaccgaggacctcgggctcggtacttagttacgtgtcgcgtaggagtccagtcggccgttcggtcccaggtccagggttcggttacccggaccccgtcggggg

SEQ ID NO: 232291 - DNA, 623 bp, Homo sapiens
  misc_feature: GYAE6OF02I062D.5.27.C05.1.454.CMB.1.raw
  modified_base (404)..(404): a, c, t, g, unknown or other
  misc_feature (404)..(404): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttcttgttgctatttaaaaggtgtccagtgtgaggtgcagttggtggagtcgtgggggaaccttggtccagccgtggggggtccctgagactctcctgtgtagcctctgcgttcaccgtcagtagcaattacatgagctgggtcagccaggctccgaggtagggctggacgtgggtctcgtagtttatttagtagcgatggaaccgcactacgttcgacagacctccgcggagggcagatcgaccatcncagacgacaacttaccaagaaccctacctttaatccttacaacgtatacgtaacacggtcctaggaagacgccggaacggtaccgttcgggcttacgttacgtaacgtttacgtgtcggaccggtaacgacggtttaccgaaccggttcgggtaccgttacgggtcccgtaacggtccggtaacggggtttcccgggttaccccggtaaccccccgggg

SEQ ID NO: 232292 - DNA, 522 bp, Homo sapiens
  misc_feature: GYAE6OF02F39P6.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagcctggggggtccctgagactctcctgtgtagcctctgcgttcaccgtcagtagcaattacatgagctggtccgccaggctccgaggtaaggggctggagtgggtctcagttatttatagcgatggaaccgcacacttcgcagactccgcgaggggcaggattcaccatctccagagacaattccaaagaaccacccttatcttcagatgaacagcctagagagccgaggactcggctgtctattctgtgcgagtgtccagtgctggccaggcaggtcgttccggaccccgtcggg

SEQ ID NO: 232293 - DNA, 540 bp, Homo sapiens
  misc_feature: GYAE6OF02F2VXP.5.27.C05.1.454.CMB.1.raw
  modified_base (449)..(449): a, c, t, g, unknown or other
  misc_feature (449)..(449): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagcctggggggtccctgagactctcctgtgtagcctctgcgttcaccgtcagtagcaattacatgagctgggtccgccaggctccgaggtaaggggctgggagtggggtctcgagttatttatagcgatggaaccgcacacttcgcaggactccgcgaggggcaggacttcaccgatctccagagacaattccaaagaccaaccctttatcttcagtatgaacngacctgacgagccgaggactcggctgtctattactgtacgcgagcgtcacgtggctggtcccaggcctagggtcgttccgacccgtcgggg

SEQ ID NO: 232294 - DNA, 518 bp, Homo sapiens
  misc_feature: GYAE6OF02H0Q0G.5.27.C05.1.454.CMB.1.raw
  modified_base (378)..(378): a, c, t, g, unknown or other
  misc_feature (378)..(378): n is a, c, g, or t
  modified_base (404)..(404): a, c, t, g, unknown or other
  misc_feature (404)..(404): n is a, c, g, or t
  modified_base (479)..(479): a, c, t, g, unknown or other
  misc_feature (479)..(479): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagcctggggggtccctgagactctcctgtgtagcctctgcgttcaccgtcagtagcaattacatgagctgggtccgccaggctccaggtaaggggctggagtggggtctcgagttatttatagcgatggaaccgcacacttcgcagactccgngaggggcagattcaccatctccaganacaattccaagacaccctttatcttcagatgaacagcctgagacgccgagactcggctgtctattctgtgcgagngtcactggctggccagcaggtcggtccgacccgtcgggg

SEQ ID NO: 232295 - DNA, 573 bp, Homo sapiens
  misc_feature: GYAE6OF02H6KC3.5.27.C05.1.454.CMB.1.raw
  modified_base (263)..(263): a, c, t, g, unknown or other
  misc_feature (263)..(263): n is a, c, g, or t
  modified_base (343)..(343): a, c, t, g, unknown or other
  misc_feature (343)..(343): n is a, c, g, or t
  modified_base (358)..(358): a, c, t, g, unknown or other
  misc_feature (358)..(358): n is a, c, g, or t
  modified_base (385)..(385): a, c, t, g, unknown or other
  misc_feature (385)..(385): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttcctgttgctattttaaaaggtgtccagtgtgaggtgcagttggtggagtctgggggaaccttggtccagccgtggggggtccctggagactctcctgtgtagcctntgcgttcaccgtcagtagcaattacatgagctggtccgcaggctccgaggtaagggctggagtgggtctcgagttattanagcgtatggaaccgnacattcgacagactccgagagggcagnttcaccatctccagagacaattccaagaacctacctttatccttacagatacgtaacagaccttagaacgacgacccgaggacctcggactcgtactacgtttacgcgtacgtacggtagtacgtccacgtcggtacctcggtaccacggccgtaacgggttcggttacccggaccccgttacggggg

SEQ ID NO: 232296 - DNA, 594 bp, Homo sapiens
  misc_feature: GYAE6OF02IXTMS.5.27.C05.1.454.CMB.1.raw
  modified_base (191)..(191): a, c, t, g, unknown or other
  misc_feature (191)..(191): n is a, c, g, or t
  modified_base (201)..(201): a, c, t, g, unknown or other
  misc_feature (201)..(201): n is a, c, g, or t
  modified_base (400)..(400): a, c, t, g, unknown or other
  misc_feature (400)..(400): n is a, c, g, or t
  modified_base (432)..(432): a, c, t, g, unknown or other
  misc_feature (432)..(432): n is a, c, g, or t
  modified_base (464)..(464): a, c, t, g, unknown or other
  misc_feature (464)..(464): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcgtggtttcgtgtagcgtatttaaaggtgtcagtgtgaggtgnagttggtggngtcgtgggggaaccttggtccagccgtggggggtccctgagactctcctgtgtagcctctgcgttcaccgtcagtgacaattacatgagcgtgggtccgccaggccttccgagggtaacggggctgggaggtgggtctcgtaggtttatttataggcgatcggaccgcaactacttcgcagacctcgcggagggcaagnttcaccatccacaagagaactactaccgaaanacctaaccctttatccttacagtatacgaacncgacctaggagacgcccgaaggtaccgtcggtcgttcgtacttacttacgtgttacggaccggaagtaccgtcgtacgtacggtcgtgtacccaggtccgttagggtacggttcccgaccggttccgggg

SEQ ID NO: 232297 - DNA, 518 bp, Homo sapiens
  misc_feature: GYAE6OF02JCK7Z.5.27.C05.1.454.CMB.1.raw
  modified_base (432)..(432): a, c, t, g, unknown or other
  misc_feature (432)..(432): n is a, c, g, or t
  modified_base (483)..(483): a, c, t, g, unknown or other
  misc_feature (483)..(483): n is a, c, g, or t
  modified_base (496)..(496): a, c, t, g, unknown or other
  misc_feature (496)..(496): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttgggtccagccgtggggggtccctgagactctcctgtgtagcctctgcgttcaccgtcagtagcaattacatgagctgggtccgccaggctcgaggtaaggggctggagtgggtctcagttattagtagcgatggaaccgcactactcgcagctccgcgagggcagattcacagtctccagagacaattccaaagaactacccttatccttanacgtatagaacagcctgagacgccgagactcgctgtctatcgtgtgcgagngtcatggctggcngctaggtcgtccgaccgtcggg

SEQ ID NO: 232298 - DNA, 543 bp, Homo sapiens
  misc_feature: GYAE6OF02HNPIA.5.27.C05.1.454.CMB.1.raw
  modified_base (344)..(344): a, c, t, g, unknown or other
  misc_feature (344)..(344): n is a, c, g, or t
  modified_base (377)..(377): a, c, t, g, unknown or other
  misc_feature (377)..(377): n is a, c, g, or t
  modified_base (445)..(445): a, c, t, g, unknown or other
  misc_feature (445)..(445): n is a, c, g, or t
  modified_base (480)..(480): a, c, t, g, unknown or other
  misc_feature (480)..(480): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagcctggggggtccctgagactctcctgtgtagcctctgcgttcaccgtcagtagcaattacatgagctgggtccgccaggctccaggtaaggggctggagtgggtctcagttatttanagcgagtggaaccgcacacttcgcagactccgngaggggcagattcaccatctaccagacgacaattccaaagaacctaccctttatcttacagatgaacngcctgagagccgaggacctcggctgtctattacgngtgcgtagacgtcacgtggcctgggtcccaggtcagggttccggtcggacccccgtacggggg

SEQ ID NO: 232299 - DNA, 651 bp, Homo sapiens
  misc_feature: GYAE6OF02INKCP.5.27.C05.1.454.CMB.1.raw
tcagatcagacacgcacgaccggtgctcgatttagacgcgatcgaagggtttgggggctgggagaggagcccagcactgggattccgaggtgtttccattcagtgatctgcactgaacacagaggactcgccatggagtttgggctgagctgggtttccttgttgctattttaaaaggtgtccagtgtgaggtgcagttggtggagtcgtgggggaaccttggtccagccgtggggggtccctgagactctcctgtgtagcctctgcgttcaccgtcagtagcaattacatgagctgggtccgccaggctccgagggtaaggggctgggaggtgggtctcgagtttatttatagcgatcggaaccgcacacttcgacacgactccggcgaggggcagacttcaccatcctaccagacgaactaacttaccaaacgtaaacctaacccttttaatcctttacaacgtactacgaaacctacgaccctaggaacggacggacccggaagggacccgttccgggacctttacggttaccttaacgtttaccgttggttcggacggtaaggtacgttaccgaccgttcgggtccgttcgggtacccgaggtccgtacggggttcgggttaccccggtacccccgggtaccggggg

SEQ ID NO: 232300 - DNA, 525 bp, Homo sapiens
  misc_feature: GYAE6OF02GBVI0.5.27.C05.1.454.CMB.1.raw
  modified_base (424)..(424): a, c, t, g, unknown or other
  misc_feature (424)..(424): n is a, c, g, or t
  modified_base (428)..(428): a, c, t, g, unknown or other
  misc_feature (428)..(428): n is a, c, g, or t
  modified_base (437)..(437): a, c, t, g, unknown or other
  misc_feature (437)..(437): n is a, c, g, or t
  modified_base (443)..(443): a, c, t, g, unknown or other
  misc_feature (443)..(443): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagcctggggggtccctgagactctcctgtgtagcctctgcgttcaccgtcagtagcaattacatgagctgggtccgccaggctccaggtaagggctggagtgggtctcagttatttatagcgatggaaccgcacacttcgcagactccgcgaggggcagatcaccatctccagagacaattccaaagactaccctttancttnagatgaacngctganagccgaggctcggctgtctattactgtgcgagagtcagtggctcggccaggtccgtagggtcggttacccgacccgtcgggg

SEQ ID NO: 232301 - DNA, 568 bp, Homo sapiens
  misc_feature: GYAE6OF02G1Z70.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtcgtgggggaaccttggtccagccgtggggggtccctgagactctcctgtgtagcctctgcgttcaccgtcagtagcaattacatgagctgggtccgccaggctccgaggtaaggggctggagtgggtctctagttatttatagcgatacggaaccgcacacttcgacagacgtccgcggaggggcagtacttcacctatcctccagacgacaacttccaaacgtaacctaaccctttatcttacaagtatacgaacacgcctagagacgccgaggacctcggctcgtctattactgtcgacgaggctacgcgtcggtcgtcggtccaggcgtacgggtcggttcccggacccggtccgggg

SEQ ID NO: 232302 - DNA, 659 bp, Homo sapiens
  misc_feature: GYAE6OF02JWWBP.5.27.C05.1.454.CMB.1.raw
  modified_base (299)..(299): a, c, t, g, unknown or other
  misc_feature (299)..(299): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttcctgttgctattttaaaggtgtccagtgtgaggtgcagttggtggagtctgggggaaccttggtccagcctggggggtccctgagactctcctgtgtagcctctgcgttcaccgtcagtagcaattacatgagctgggtccnccaggctccagggtaagggctggagtggggtcctgagtttatttagagcgtatcggaaccgcacacgttcgcagactccgcgtaggggcagacttcgactatctaccagtaacgactaaacttaccaaacgtaaaccctaccctttaatcctttacaaggtactcgtaaaccagacccttaggaacggaacggacccggtaagggtaacccgtccgggtaccgttagggttacctaacgttttaacgtcggttaggtccggtaaggtacggtacctacggttcgggtaccgttagggtaccccggtaggtaccggtacggggtttccggttaccccgggtaacccccggttcccgggggg

SEQ ID NO: 232303 - DNA, 527 bp, Homo sapiens
  misc_feature: GYAE6OF02J1GIM.5.27.C05.1.454.CMB.1.raw
  modified_base (438)..(438): a, c, t, g, unknown or other
  misc_feature (438)..(438): n is a, c, g, or t
  modified_base (471)..(471): a, c, t, g, unknown or other
  misc_feature (471)..(471): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttcctgttgctatttaaaaggtgtccagtgtgaggtgcagttggtggagtctgggggaaccttggtccagcctggggggtccctgagactctcctgtgtagcctctgcgttcaccgtcagtagcaattacatgagctgggtccgccaggctccgaggtaaggggctggagtggggtctcgagttatttagagcgatggaaccgcacacttcgcagactcgcgaggggcagattcaccatctcagagacaattccaaagaccaccttatcttacagatgaacancctgagacgccgagactcgctgtactattacgngtgcgagtacgtcacgtcggcgtcggccagcgtaggtcggttccgacccgtcgggg

SEQ ID NO: 232304 - DNA, 521 bp, Homo sapiens
  misc_feature: GYAE6OF02IPH8Z.5.27.C05.1.454.CMB.1.raw
  modified_base (482)..(482): a, c, t, g, unknown or other
  misc_feature (482)..(482): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggtttccttgttgctattttaaaaggtgtccagtgtgaggtgcagttggtggagtctgggggaaccttggtccagcctggggggtccctgagactctcctgtgtagcctctgcgttcaccgtcagtagcaattacatgagctgggtccgccaggctccaggtaaggggctgggagtgggtctcgagttatttatagcgatggaaccgcacacttcgcagactccgcgaggggcagattcaccatcctccagagacaattccaacgaacaccctttatcttacagtatgaacagcctgagacgccgagactcggctgtctatctgtgcgagngtcacgtgctggcaggcaggtcggtccgacccgtcgggg

SEQ ID NO: 232305 - DNA, 282 bp, Homo sapiens
  misc_feature: GYAE6OF02GC8KV.5.27.C05.1.454.CMB.1.raw
  modified_base (218)..(218): a, c, t, g, unknown or other
  misc_feature (218)..(218): n is a, c, g, or t
  modified_base (233)..(233): a, c, t, g, unknown or other
  misc_feature (233)..(233): n is a, c, g, or t
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
  modified_base (249)..(249): a, c, t, g, unknown or other
  misc_feature (249)..(249): n is a, c, g, or t
  modified_base (251)..(251): a, c, t, g, unknown or other
  misc_feature (251)..(251): n is a, c, g, or t
  modified_base (258)..(258): a, c, t, g, unknown or other
  misc_feature (258)..(258): n is a, c, g, or t
  modified_base (260)..(267): a, c, t, g, unknown or other
  misc_feature (260)..(267): n is a, c, g, or t
  modified_base (269)..(282): a, c, t, g, unknown or other
  misc_feature (269)..(282): n is a, c, g, or t
tcagatcagacacgcacgaccggtgctcgatttagacgcgatcgaaggttgggaacacggccaccctgaccatcagcaggtcgaagccgggatgaggccgactatactgtcaggtgtggaatggtgattagtgattatgtcttggaactgggaccaaggtcaccgtctaggtcagcccaaggccaacccatgtacactctgttcccacctcctccgtntctgatctgagcggntggcaggcncatgntncngatgacngnnnnnnnngnnnnnnnnnnnnnn

SEQ ID NO: 232306 - DNA, 557 bp, Homo sapiens
  misc_feature: GYAE6OF02GNZDY.5.27.C05.1.454.CMB.1.raw
  modified_base (363)..(363): a, c, t, g, unknown or other
  misc_feature (363)..(363): n is a, c, g, or t
  modified_base (489)..(489): a, c, t, g, unknown or other
  misc_feature (489)..(489): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagcctggggggtccctgagactctcctgtgtagcctctgccgttcaccgtcagtggccaattacatgagctgggtccgccaggcctccgaggtaaggggctgggagtgggtctcgagttattatagcgatggaaccgnacacttcgcagactccgcgaggggcagattcacatctccagacgacaattccaaagacctaccctttatccttcagatacgaacagccctagacgacgccgaggacctcggctgttctagttaccngtcgcggagagtccaacgtggcgtacggtccaggtccgtagggttcggttcccgaccccggtcggggg

SEQ ID NO: 232307 - DNA, 519 bp, Homo sapiens
  misc_feature: GYAE6OF02G0HH8.5.27.C05.1.454.CMB.1.raw
  modified_base (346)..(346): a, c, t, g, unknown or other
  misc_feature (346)..(346): n is a, c, g, or t
  modified_base (396)..(396): a, c, t, g, unknown or other
  misc_feature (396)..(396): n is a, c, g, or t
  modified_base (480)..(480): a, c, t, g, unknown or other
  misc_feature (480)..(480): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagcctgggggtccctgagactctcctgtgtagcctctgcgttcaccgtcagtagcaattacatgagctgggtcccgccaggctccgagggtaaggggctggagtgggtctcagtttattanagcgatggaaccgcacacttcgcagactccgcgaggggcagatcacatcncagagacaatccaagaacctaccctttatccttacagtatagaacagcctgagacgccgagactcgctgtctatctgtgcgagngtcatgctggacaggcgtaggtcgttccgaccctcgggg

SEQ ID NO: 232308 - DNA, 526 bp, Homo sapiens
  misc_feature: GYAE6OF02HMO5D.5.27.C05.1.454.CMB.1.raw
  modified_base (425)..(425): a, c, t, g, unknown or other
  misc_feature (425)..(425): n is a, c, g, or t
  modified_base (471)..(471): a, c, t, g, unknown or other
  misc_feature (471)..(471): n is a, c, g, or t
  modified_base (479)..(479): a, c, t, g, unknown or other
  misc_feature (479)..(479): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagcctggggggtccctgagactctcctgtgtagcctctgcgttcaccgtcagtagcaattacatgagctgggtccgccaggctccaggtaaggggctggagtgggtctcagttatttatagcgatggaaccgcacacttcgcagactccgcgaggggcagattcaccatctccagagacaattccaagaacaccctttancttcagatgaacagcctgagagccgaaggctcggctgtctattacngtgcgagngtcacgtggctcggtccaggcagggtcggttaccgaccccgtcgggg

SEQ ID NO: 232309 - DNA, 575 bp, Homo sapiens
  misc_feature: GYAE6OF02GIU88.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagcctggggggtccctgagactctcctgtgtagcctctgcgttcaccgtcagtagcaattacatgagctgggtccgccaggctccgagggtaacggggctggagtgggtctcgagttatttatagcgatggaaccgcacacttcgcagacctccgcggaggggcaggactcaccatctccagacgacaacttaccaaagaacctaccctttatcctttacagtatacgaacagcctagagacggaccgaggtacctcggtctcgtactattacgtgtgacgaggacgtcacgtggtccgttaggtcccgacgggtcgtagggtcggttacccggaccccggtaccggggg

SEQ ID NO: 232310 - DNA, 564 bp, Homo sapiens
  misc_feature: GYAE6OF02HET3E.5.27.C05.1.454.CMB.1.raw
  modified_base (300)..(300): a, c, t, g, unknown or other
  misc_feature (300)..(300): n is a, c, g, or t
  modified_base (411)..(411): a, c, t, g, unknown or other
  misc_feature (411)..(411): n is a, c, g, or t
  modified_base (435)..(435): a, c, t, g, unknown or other
  misc_feature (435)..(435): n is a, c, g, or t
  modified_base (449)..(449): a, c, t, g, unknown or other
  misc_feature (449)..(449): n is a, c, g, or t
  modified_base (469)..(469): a, c, t, g, unknown or other
  misc_feature (469)..(469): n is a, c, g, or t
  modified_base (486)..(486): a, c, t, g, unknown or other
  misc_feature (486)..(486): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagcctgggggtccctgagactctcctgtgtagcctctgcgttcaccgtcagtagcaattacatgagctgggtccncaggctccagggtaaggggctggagtcgggtctcgagttatttagagcgatggaacccgctaacacttcgcacgactccgacggaggggcagacttcaccgatctccaganacaattccaagaccacccttttancttacagatcaacncgctagagacgccgaaggcncggctgtactagttacngttgacggtagagttccacgtcggtacctcgggttacccacggcgtacgggttacgggttcccgaccccggtcggggg

SEQ ID NO: 232311 - DNA, 603 bp, Homo sapiens
  misc_feature: GYAE6OF02IK9P1.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtcgtgggggaaccttggtccagccgtggggggtccctgagactctcctgtgtagcctctgcgttcaccgtcagtagcaattacatgagctgggtccgccgaggcctaccgagggtaaggggctggaggtgggtctcgagtttatttatagcgagtcggaaccgcactacttcgacagacgtccgacggaggggcagtactcaccatctaccgagacgacaattaccaagaacctaccctttatcctttacagtactacgaactacgccgtagaacggacgacccggaaggacccgtcggccttagtacttaacgttacgtcgtaggcgtaggtacgtccgacgtggtcgttagggtcccaggtcgacgggttcggttacccggaccccggtcggggg

SEQ ID NO: 232312 - DNA, 610 bp, Homo sapiens
  misc_feature: GYAE6OF02JXIDJ.5.27.C05.1.454.CMB.1.raw
  modified_base (482)..(482): a, c, t, g, unknown or other
  misc_feature (482)..(482): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtcgtgggggaaccttggtccagccgtgggggtccctgagactctcctgtgtagcctctgcgttcaccgtcagtagcaattacatgagcgtgggtccgccgaggcctccgagggtaagggcgtggaggtgggtctcgtagttagttagtagcgtagtcggaaccgcacgtacttcgacagacgtccgcggacggggcagacttccgactactcctacgagacgaactaactaccaaacgtaacctaacccgttactccttacacgtaatacgaaacncgacctggacgacgaccgaacggaccgtcggtcgttcgtacttacgttacgtgtacgcgtacgcgtacgtacgtcggtcgtacggtcgacggacgtagggttcgggtacccggtacccggtaccgggg

SEQ ID NO: 232313 - DNA, 639 bp, Homo sapiens
  misc_feature: GYAE6OF02GB89N.5.27.C05.1.454.CMB.1.raw
  modified_base (303)..(303): a, c, t, g, unknown or other
  misc_feature (303)..(303): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagccgtggggggtccctgagactctcctgtgtagcctctgcgttcaccgtcagtagcaattacatgagcgtgggtccnccgaggctccgagggtaaggggctggagtgggtctcagttattagtagcgagtcggaaccgcactacttcgcagacctccggacggaggggcaggacttcaccatcctaccagagacaattccaaagaacctaccctttatcttacagtatacgaacacgtccgtaggacgacggacccggaacgggtaccgtacgggcctttacgttaccttaacgtttaccgtggttacggaccggtaacggtacggttacctaacggttcgggtaccgttcgggtacccgagggtacccgtaggggtttccgggtttaccccggacccccgggtaccgggggg

SEQ ID NO: 232314 - DNA, 530 bp, Homo sapiens
  misc_feature: GYAE6OF02GCYG9.5.27.C05.1.454.CMB.1.raw
tcagatcagacacgcacgaccggtgctcgatttagacgcgatcgaagggtttggggctgagagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtcgtgggggaaccttggtccagcctggggggtccctgagactctcctgtgtagcctctgcgttcaccgtcagtagcaattacatgagctgggtccgccaggctccgaggtaaggggctgggagtgggtctcagttatttatagcgagtcggaaccgcacacttcgcagactccgcgagggcagattcaccatctcagagacaattccaaagaacctacccttatcttacagatgaacagcctagagacgccgaggactcgctgtctattactgtgcgagagtcgacgtggcttcggccaggtcgaggttcggtaccgaccccgg

SEQ ID NO: 232315 - DNA, 547 bp, Homo sapiens
  misc_feature: GYAE6OF02HV5MD.5.27.C05.1.454.CMB.1.raw
  modified_base (408)..(408): a, c, t, g, unknown or other
  misc_feature (408)..(408): n is a, c, g, or t
  modified_base (434)..(434): a, c, t, g, unknown or other
  misc_feature (434)..(434): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagccgtggggggtccctgagactctcctgtgtagcctctgcgttcaccgtcagtagcaattacatgagcgtgggtccgccaggctccgagggtaaggggctggagtcgggtctcgagtttattatagcgataggaccgcacacttcgcagactccgcggaggggcagattcaccatctcaganactaatccaaagaacctaccctttanccttacagtatgaaacagcctgagacgccggagacgtcggcttgtactagttctgtgcgagagtccacgtggcgtggtccagtcgtagggtcggttaccgccccggtacgggg

SEQ ID NO: 232316 - DNA, 577 bp, Homo sapiens
  misc_feature: GYAE6OF02H5P36.5.27.C05.1.454.CMB.1.raw
  modified_base (382)..(382): a, c, t, g, unknown or other
  misc_feature (382)..(382): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagcctggggggtccctgagactctcctgtgtagcctctgcgttcaccgtcagtagcaattacatgagcgtgggtccgccaggctccgagggtaaggggctggaggtgggtctcgagtttattatagcgatggaaccgcactacttcgcagactccgnggacggggcagattcaccatcctacagacgactaattccaaagaaccctacccttttaatccttacagtatacgaacagcctagacgagccgaaggacctcggtcttgtacttaagttacgtgtgacgtagtagtaccacggtggccgtcggtaccaggtccggtagggttcggttcccgaccccggtacggggg

SEQ ID NO: 232317 - DNA, 679 bp, Homo sapiens
  misc_feature: GYAE6OF02G31M0.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtcgtgggggaaccttggtccagccgtggggggtccctgagactctcctgtgtagcctctgcgttcaccgtcagtagcaattacatgagctgggtcccgccgaggcctccgagggtaacggggctgggaggtgggtctcgtagttatttagtagcgagtaggaaccgcactactcgcacgactccgcggagggcagtctcgactactctaccaagacgactaaactaccaaagtaaccctaacccttttataccttacaacgtaatacgaaaccacggtaccgtagaacgtacggacccgggaagggtaccgttccgggtacttacgggttacctttaaacgtttaccgtaggttaccggacgggtaacggtaacggttaccgaacggttcggggtaccgttacggggtacccgaacgggtccggttaacgggggtttcccgggtttaccccgggacccccgggttccgggggg

SEQ ID NO: 232318 - DNA, 709 bp, Homo sapiens
  misc_feature: GYAE6OF02HR60E.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggtttccttgttgctatttaaaaggtgtccagtgtgaggtgcagttggtggagtcgtgggggaaccttggtccagccgtggggggtccctgagactctcctgtgtagcctctgcgttcaccgtcagtagcaattacatgagctcgggtccgccaggctccgagggtaaggggctgggagtgggtctcgtagtttatttagagcgagtacggaacccgcaactaccttcgacaacgaccgtccggacggaggggcagtacttccaacctatcctaccgaagacgaactaaattacccaaagtaaacccttaaccccttttaagttacccttacgaagtaacttacgaaacctacgacccgttaggaaacggtaacggacccgggtaagggtacccgtccgggtaccgttaccggttactttaacgtttaaccgttgggttacggtaccggtaagggtaacggttacccaacgggttccgggaccggtttcgggtacccgtagggtaccggtacgggggtttaccgggtttaccccggtaccccccgggtaccggggggg

SEQ ID NO: 232319 - DNA, 571 bp, Homo sapiens
  misc_feature: GYAE6OF02HM75F.5.27.C05.1.454.CMB.1.raw
  modified_base (151)..(151): a, c, t, g, unknown or other
  misc_feature (151)..(151): n is a, c, g, or t
  modified_base (358)..(358): a, c, t, g, unknown or other
  misc_feature (358)..(358): n is a, c, g, or t
  modified_base (384)..(384): a, c, t, g, unknown or other
  misc_feature (384)..(384): n is a, c, g, or t
  modified_base (399)..(399): a, c, t, g, unknown or other
  misc_feature (399)..(399): n is a, c, g, or t
  modified_base (431)..(431): a, c, t, g, unknown or other
  misc_feature (431)..(431): n is a, c, g, or t
  modified_base (444)..(444): a, c, t, g, unknown or other
  misc_feature (444)..(444): n is a, c, g, or t
  modified_base (449)..(449): a, c, t, g, unknown or other
  misc_feature (449)..(449): n is a, c, g, or t
  modified_base (470)..(470): a, c, t, g, unknown or other
  misc_feature (470)..(470): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcgnggtttcgtgtagcgtatttaaaagtgtcagtgtgaggtgcagttggtggagtctgggggaaccttggtccagcctggggggtccctgaggactctcctgtgtagcctctgcgttcaccgtcagtagcaattacatgagctggtccgccaggctccgagggtaagggctgggagtgggtctcgagttatttatagcgatcggaaccgnacacttcgacagactcgcgacggggnacgattccaccatcnccagagacaattccaaagaacctaccctttanccttacagactanaacancctagagagccgagggtaccncggtctgtactacgttacgtggtcgacgacggtacgtacgtacggtcgtacgtcggtacgacggtacggtacgggttccggttacccggacccggtcgggg

SEQ ID NO: 232320 - DNA, 648 bp, Homo sapiens
  misc_feature: GYAE6OF02I4W77.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggtttccttgttgctattttaaagtgtccagtgtgaggtgcagttggtggagtctgggggaaccttggtccagccgtggggggtccctgagactctcctgtgtagcctctgcgttcaccgtcagttagcaattacatgagctgggtccgccaggctccagggtaaggggctggagtgggtctcgagtttatttatagcgatcggaaccgtcactacttcgcagaccttccgcgaggggcagactttccgacctatcctaccgagaacgaacaaattacccaaagtaaacctaccccgtttatacctttacgaagacttagaaaccctagacccttggaacgtacgaccggaacggtaccgtccgggtcttaaccgtctttaacgtttaccttggtcggtacggtaacggtaagttccaacggttcgggtacccgttggggtacccaggtcccggtaaggggtttcggtttacccgggacccccggttaccggggggg

SEQ ID NO: 232321 - DNA, 581 bp, Homo sapiens
  misc_feature: GYAE6OF02G7MIL.5.27.C05.1.454.CMB.1.raw
  modified_base (303)..(303): a, c, t, g, unknown or other
  misc_feature (303)..(303): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagccgtggggggtccctggagactctcctgtgtagcctctgcgttcaccgtcagtagcaattacatgagctgggtccncgaggctccgagggtaaggggctggagtgggtctcgagttattatagcgtatcggaaccgcacacttcgcacgactccgcgaggggcagacttcacctatcctccagacgactaacttaccgaaacgtaacctaccctttatccttacaagactacgaacagcctagagacgccgaggactcggcttcgtacttattacgtgtcgacggtagacgttccgacgtcggtccgtcggtacccaggccgtagggtcggttacccggaccccggtacggggg

SEQ ID NO: 232322 - DNA, 556 bp, Homo sapiens
  misc_feature: GYAE6OF02GU7DS.5.27.C05.1.454.CMB.1.raw
  modified_base (406)..(406): a, c, t, g, unknown or other
  misc_feature (406)..(406): n is a, c, g, or t
  modified_base (409)..(409): a, c, t, g, unknown or other
  misc_feature (409)..(409): n is a, c, g, or t
  modified_base (414)..(414): a, c, t, g, unknown or other
  misc_feature (414)..(414): n is a, c, g, or t
  modified_base (436)..(436): a, c, t, g, unknown or other
  misc_feature (436)..(436): n is a, c, g, or t
  modified_base (475)..(475): a, c, t, g, unknown or other
  misc_feature (475)..(475): n is a, c, g, or t
  modified_base (486)..(486): a, c, t, g, unknown or other
  misc_feature (486)..(486): n is a, c, g, or t
  modified_base (491)..(491): a, c, t, g, unknown or other
  misc_feature (491)..(491): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggtttccttgttgctatttaaaaggtgtccagtgtgaggtgcagttggtggagtcgtgggggaaccttggtccagccgtggggggtccctggaggactctccgtgtgtagcctctgtcgttcaccgtcagtagcaattacagtgagctcgggtccgccgaggctccgagggtaacggggctggtagtggggtctcgagttattatagcgtatcggaaccgcacacttcgcagacctcgcggagggcagactcacntcncaganacatccaagaacctacctttancttcagatgaacacgtctagacgacgccgaggactcggntgtctattacngtcgngtaagcgtacacggtcggccttgggcccaggtccgaagggttcggttacccggacccggtcgggg

SEQ ID NO: 232323 - DNA, 850 bp, Homo sapiens
  misc_feature: GYAE6OF02FOMDZ.5.27.C05.1.454.CMB.1.raw
  modified_base (783)..(783): a, c, t, g, unknown or other
  misc_feature (783)..(783): n is a, c, g, or t
tcagatcagacacgcacgaccggtgctcgatttagacgcgatcgaaggtttgggctgggagaggagcccagcactgggattccgaggtgtttccattcagtgatctgcactgaacacagaggactcgccatggagtttggctgagctgggttttcctgttgctattttaaaaggtgtccagtgtgaggtgctagttggtggagttcgtgggggaaccttggtcctaggtccgtcggggggtccctggacgactcgtccgtggtcgtacgccttacgtggtccgtttcgaccgttcgacggttagaccgtaaattaccgagttcggacgtccgttacgggtacccgacgtacggtacccgttacccgaaggggttaacgggtcgttacgggtacggttaccgggtaccttacggttaggttttaacgtttacggtacggtaccggtaacggttaccgggaaacccgtccgtaaaccggttaccgtttaccggtaccgtaaacggtacccgttaccgggtaaccgggtaacgggggtaccgtaacggttaacgtttacccgaaccgttagttacccgtaacccgtaaagggtaacggtaaccttaaaccggtttacccgaaaggttaaaccccctcccgtttttaacgtaccggttacccgaaggttacgtaccggtaaacctacggtaccgttaaggaaccgtacggacccggttagtacccggttacggccgtttcggttaacttacgttacggtacggtcgaaggttacggattaacccggnggttcggttacctacgggtaccctgggtaccgttacggggtaccgttaccccgggcccggttacggg

SEQ ID NO: 232324 - DNA, 665 bp, Homo sapiens
  misc_feature: GYAE6OF02H1F7V.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtcccagccgtggggggtccctgagactctcctgtgtagcctctgcgttcaccgtcagtacgcaattacatgagctgggtccgccgaggcctccgagggtaaggggtcgtagggagtggggtctcgtagtttatttatagcgatcggaacccgcaaccacttcgccagacctccgcggacggggcaggactttccaacctactcctaccgaagacgaactaaacttaccgaaacgtaaccctacccttttaactcctttaccagtaatacgtaaacacgtacctaggtaacggacgtacccggaaggtacccgtcgggtccttacggtcttaaacgttgttcgtacggccggtaagtcggttaccaccggttaggtaccgtcggtacccgtacgggaccgttacgggttaccgggtttaccccggtaccccggtacccgggggg

SEQ ID NO: 232325 - DNA, 263 bp, Homo sapiens
  misc_feature: GYAE6OF02HUW8W.5.27.C05.1.454.CMB.1.raw
  modified_base (258)..(263): a, c, t, g, unknown or other
  misc_feature (258)..(263): n is a, c, g, or t
tcagatcagacacgcacgaccggtgctcgatttagacgcgatcgaagggtttgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccaccctcctccgtgtctgatctgagcgggctggcaaggcgcatagnnnnnn

SEQ ID NO: 232326 - DNA, 298 bp, Homo sapiens
  misc_feature: GYAE6OF02HI6X6.5.27.C05.1.454.CMB.1.raw
  modified_base (259)..(260): a, c, t, g, unknown or other
  misc_feature (259)..(260): n is a, c, g, or t
  modified_base (265)..(266): a, c, t, g, unknown or other
  misc_feature (265)..(266): n is a, c, g, or t
  modified_base (268)..(298): a, c, t, g, unknown or other
  misc_feature (268)..(298): n is a, c, g, or t
tcagatcagacacgcacgaccggtgctcgatttagacgcgatcgaagggtttgggaacacggccaccctgaccatcagcagggtcgaagccggggatgaggccgactattactgtcaggtgtggaatggtgattatgattatgtcttcggaactgggaacaaggtcaccgtcctaggtcagcccaaggccaaccccactgtcactctgttccccgccctcctccgtgtctgatctgagcgggctggcaaggcgcatagnntcagnntnnnnnnnnnnnnnnnnnnnnnnnnnnnnnnn

SEQ ID NO: 232327 - DNA, 568 bp, Homo sapiens
  misc_feature: GYAE6OF02HX8IH.5.27.C05.1.454.CMB.1.raw
  modified_base (302)..(302): a, c, t, g, unknown or other
  misc_feature (302)..(302): n is a, c, g, or t
  modified_base (377)..(377): a, c, t, g, unknown or other
  misc_feature (377)..(377): n is a, c, g, or t
  modified_base (432)..(432): a, c, t, g, unknown or other
  misc_feature (432)..(432): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagcctggggggtccctgagactctcctgtgtagcctctgcgttcaccgtcagtagcaattacatgagctggggtccnccaggctccgaggtaaggggctggagtgggtctcagttattatagcgatggaaccgcacacttcgcagactccgngacggggcagattcaccatctaccagagacaattccaaagtaaccacccttttanccttacagtactacgaacagaccctggacgacgccggaggacctccggcttcggtctaagttactggtcgacggagtacgtcacgtcggctcggtcccaggtccgtagggttccggttaccggaccccgtcggggg

SEQ ID NO: 232328 - DNA, 537 bp, Homo sapiens
  misc_feature: GYAE6OF02F6SFD.5.27.C05.1.454.CMB.1.raw
  modified_base (358)..(358): a, c, t, g, unknown or other
  misc_feature (358)..(358): n is a, c, g, or t
  modified_base (377)..(377): a, c, t, g, unknown or other
  misc_feature (377)..(377): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagcctggggggtccctgagactctcctgtgtagcctctgcgttcaccgtcagtagcaattacatgagctgggtccgccaggctccgaggtaaggggctggagtgggtctcagtttattatagcgatggaaccncacacttcgcagactccgngagggcagattcacatctccagagacaattaccaagaacctaccctttatcctttacagtatacgaacacgcctagagagcccgaggacctcggctgtactattacgtgtgcgagtgtcacgtggctggtccagcgtaggtcggttccgaccccgtcggg

SEQ ID NO: 232329 - DNA, 632 bp, Homo sapiens
  misc_feature: GYAE6OF02JXRVP.5.27.C05.1.454.CMB.1.raw
  modified_base (403)..(403): a, c, t, g, unknown or other
  misc_feature (403)..(403): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggtttccttgttgctattttaaaaggtgtccagtgtgaggtgcagttggtggagtctgggggaaccttggtccagcctgggggtccctggagactctcctgtgtagcctcgtgcgttcaccgtcagtagcaattacatgagctgggtccgccgaggctccgagggtaaggggctgggaggtgggtctcgtagtttatttagtacgcgtaagtggaaaccgtcactacgttcgcagcctccgcgaggggcagnttacacgatctcagacgaacacttaccaaagtaacctaacctttatccttacacgtatacgaacgaccgtaccgtgacgacggaccggtaacggtaccgtcggtacgttcgtacttaacgtttacgtcggttagacggtacgtacggtacctacgtaccgggtcgtacggtacccgacggtaccggttagggtacccgggtttacccggtaccccgggttacccggggg

SEQ ID NO: 232330 - DNA, 556 bp, Homo sapiens
  misc_feature: GYAE6OF02FYKIB.5.27.C05.1.454.CMB.1.raw
  modified_base (203)..(203): a, c, t, g, unknown or other
  misc_feature (203)..(203): n is a, c, g, or t
  modified_base (435)..(435): a, c, t, g, unknown or other
  misc_feature (435)..(435): n is a, c, g, or t
  modified_base (439)..(439): a, c, t, g, unknown or other
  misc_feature (439)..(439): n is a, c, g, or t
  modified_base (449)..(449): a, c, t, g, unknown or other
  misc_feature (449)..(449): n is a, c, g, or t
  modified_base (484)..(484): a, c, t, g, unknown or other
  misc_feature (484)..(484): n is a, c, g, or t
tcagatcagacacgcacgaccggtgctcgatttagacgcgatcgaagggtttgggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggnggagtctgggggaaccttggtccaggccgtggggggtccccgagactctcctgtgtagcctctgcgttcaccgtcagtagcaattacatgagctgggtccgcaggctccaggtaaggggctgggagtgggtctgagtttatttagtagcgtatggaaccgcacacttcgcagactccggcgaggggcagattcaccatctccgagagacaattccaaagaaccaccctttancttnaagatgaacngcctgagagccgagactcggctgtctattacgtgngcgagtacgtcacgtcgggcttcgggtaccaggtccgagggttcggttacccggaccccgttggggacccgg

SEQ ID NO: 232331 - DNA, 553 bp, Homo sapiens
  misc_feature: GYAE6OF02G79VI.5.27.C05.1.454.CMB.1.raw
  modified_base (396)..(396): a, c, t, g, unknown or other
  misc_feature (396)..(396): n is a, c, g, or t
  modified_base (399)..(399): a, c, t, g, unknown or other
  misc_feature (399)..(399): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagcctggggggtccctgagactctcctgtgtagcctctgcgttcaccgtcagtagcaattacatgagctgggtccgccaggctccgagggtaaggggctgggagtgggtctcagttatttatagcgatcggaaccgcacacttcgcagactccgcgaggggcagattcacntcncagagacaatccaagaacctaccctttatccttacagactagaacagcctagacgacgccggagacctcggctggtacttagttacgtgtcgacggagtagtccacggtggtccgtcgggccaggcgtagggtcggttaccgacccggtcgggg

SEQ ID NO: 232332 - DNA, 713 bp, Homo sapiens
  misc_feature: GYAE6OF02IEBIE.5.27.C05.1.454.CMB.1.raw
  modified_base (308)..(308): a, c, t, g, unknown or other
  misc_feature (308)..(308): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcttgggttttccttgttgcttaattttaaaaggtgtccagtgtgaggtgcaggttggtggagtcgtgggggaccttggtccagccgtgggggtccctgagactctcctgtgtagcctctgcgttcaccgtcagtagcaattacatgagcgtcggggtccnccgaggtcctaccggtaaggggtaacgggggccgtggggaggttcggggttcctcgtaagttttaactttagtaggcgtagtacggaacccgcaaccgtacgttcgacgtaacgacctccgggacggagggggaccaagtactttccaacctatcccgtaccgaagacgaaacctaattacccaaagtaaccctacccttttaatccttacaagtaacttacgaaacgtactaccgtaggaacggtacggcccgtaacgggacccgttcgggaccttgtttaaacctacgtttaaccgtgtacggacggtaacggtacgttaaccgtacggtccgggtactccgggtacccgacggtaccgggtacgggtttccgggttacccccggacccgggttacccggggg

SEQ ID NO: 232333 - DNA, 611 bp, Homo sapiens
  misc_feature: GYAE6OF02HXQK0.5.27.C05.1.454.CMB.1.raw
  modified_base (344)..(344): a, c, t, g, unknown or other
  misc_feature (344)..(344): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggtttccttgttgctatttaaaggtgtccagtgtgaggtgcagttggtggagtctgggggaaccttggtccagccgtggggggtccctgagactctcctgtgtagcctctgcgttcaccgtcagtagcaattacatgagcgtgggtccgccaggctccgagggtaaggggctggagtgggtctcagttattanagcgagtacggaccgcacacttcgacacgactccgcgaggggcaagacttccaacctatcctaccaaggacgtaactaaacttaccgaaagaaccctacccttttaatcctttacaagtactagaaaccacgcctagaacggacgcccggaaggacctcggcttaggtacttaacttacgtggtacgacggaaggtacgtccgaacgtggccgttaggtacccgaggtccgtaggggtttccggttaccccgacccccggtcggggg

SEQ ID NO: 232334 - DNA, 732 bp, Homo sapiens
  misc_feature: GYAE6OF02H6JJE.5.27.C05.1.454.CMB.1.raw
  modified_base (302)..(302): a, c, t, g, unknown or other
  misc_feature (302)..(302): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagttttgggctgagctgggttttccttgttgctattttaaaaggtgtccagtgtgaggtgcagttggtggagtctgggggaaccttggtccagcctgggggtccctgagactctcctggtgtagcctctgcgttcaccgtcagtagcaattacatgagcgtggtccnccgaggcctccgagggtaacggggctcggaggtgggtctcgtaggtttatttagtaggcgtaagtcggaacccgctaccacctttcggcaacggtaccgttccccggaggtacgggggcctaaggtactttcccgaacctacgttcccttacccgaaggaacggaaccctaaacgtttacccgaaacggtaaaccctaccccgtttttaattacctttaccgaacgtaacttacgaaactacggtcccgttaggaaccgacgggacccggagggtaaccgttccgggacgttcggtacctttaacgtttaccgtggtacggtaccggaaggtaccgttaccaaccggtttcgggtccgttacggggttacccagggtacccggttacggggtttcccgggtttaccccggaccccgggttacccgggggg

SEQ ID NO: 232335 - DNA, 790 bp, Homo sapiens
  misc_feature: GYAE6OF02H9588.5.27.C05.1.454.CMB.1.raw
  modified_base (266)..(266): a, c, t, g, unknown or other
  misc_feature (266)..(266): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcgtgggttttccttgttgcttattttaaaaggtgtccagtgtgaggtgcagttggtggagtcgtgggggaaccttggtccagtccgtgggggtccctgagactctcctgtgtagcctntgcgttccaccgtcagtagactaacttacgatgacgtcggtcgggtcccgccgtaggccgttaccggaagggtaacggggcctgggtaggttcgggtctacgtaagttttaagtttaagacggtacgtaagtaccggaaccgtctaaccgtacgttcgacgaacgtaccgtcccggacgggaacggggacctaaggtacttcccgaaccgtacgtccgtaccgaagaacgtaaacctaaacgttaacccgtaaaacgtaaacccttaccccgtttttaaatacccgttaacgtaacgtaacgtaaaccgtaaacgtacggtaacccgtaggaaaccgggtaaccgacccgggtaacggggtacccgtaccgggttaccttcggtttaaccgtaacgtttttaccgtggtacccggtaaggaaccggttaacgtacccgtaacgggttccggtaaccttcgggtacccgaacgggttccggttaccggggtttacccgttaccccggggtaccccggtacggggg

SEQ ID NO: 232336 - DNA, 834 bp, Homo sapiens
  misc_feature: GYAE6OF02JR7H1.5.27.C05.1.454.CMB.1.raw
tcagatcagacacgcacgaccggtgctcgatttagacgcgatcgaagggtttggggcgtgggagaggagcccagcactgggattccgaggtgtttccattcagtgatctgcactgaacacagaggactcgccatggagtttgggctgagctggtttcttgtgcttatttaaagtgtccagtgtgaggtgcgtagttggtggtagtcgtgggggtaaccttggtccgaggccgtgggggtccctggagtaccgtcgtcctggtgtacgcctcgtcggtccgttccgaccgtcgagtacgtctaacttactagtacgtagtcggtacgggtcccgaccgtacggacctccggaagggtaacgggtccggtaggggtacggttcgggtccgttacgtaggtttagtttaacggtacggtacgtagtacggtacccgtactaacgtccgttacggcgaaccgtaccgtcccgggaccggtacgggggaactacggttaccgttaccgaccgtaaccgtcccgtacccgaacgtaacggtaaacctaacgttaacccgaaacgttaaaccctaaccccgttttacgttaccgttaccgtaaaccgttaacggtaacctaaacccgtacgtaaccggttacggaaacccggtaacggtaccccggtaacggggtacccgttacggtaaccgttccggtaacgtttaaccgttacggtcggttacgtaaccggaggttaacccggtaccgtaacgggttccggtaccggttaaccggttacccggtacggtaccggttaccggggtttacccggttaccccggttaccccgggtaccgggg

SEQ ID NO: 232337 - DNA, 574 bp, Homo sapiens
  misc_feature: GYAE6OF02IPHF1.5.27.C05.1.454.CMB.1.raw
  modified_base (510)..(510): a, c, t, g, unknown or other
  misc_feature (510)..(510): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagccgtggggggtccctgagactctcctgtgtagcctctgcgttcaccgtcagtagcaatttacatgagctggggtcccgccagggcctccgaggggtaaggggctgggaggttggggtctcgtagtttatttagtagcgatcggaaaccgcacacttcgcagacctccgcggaggggcaggacttcaccatcctaccagagacaattccaaagaacctacccttttatctttacagaatgaaacacgcctagagacgccgagcctcggctgtcttagttcgtgngcgagtagtaccacgttggcctgggtaccaggccgtagggttcggttccgaccccggtcggggg

SEQ ID NO: 232338 - DNA, 585 bp, Homo sapiens
  misc_feature: GYAE6OF02I688L.5.27.C05.1.454.CMB.1.raw
  modified_base (451)..(451): a, c, t, g, unknown or other
  misc_feature (451)..(451): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctatttaaaaggtgtccagtgtgaggtgcagttggtggagtctgggggaaccttggtccagcctgggggtccctgagactctcctgtgtagcctctgcgttcaccgtcagtagcaattacatgagctgggtccgccaggcctccgaggtaaggggctggagtgggtctcgtagttatttagtagcgagtaggaaccgcacacttcgcagacctccgcggaggggccaggacttcgactatcctacgagacgacaacttccaaagtaacctaccctttaatccttanaacgtaatacggaaacacgtacctgaacgacgccgaaggacctcggtactcgttactaacgttacgtgtcgacgtagacgttacacgtggctggtaccacggtcgacgggttcggttaccgaccccggtcgggg

SEQ ID NO: 232339 - DNA, 611 bp, Homo sapiens
  misc_feature: GYAE6OF02I60CB.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagcctggggggtccctgagactctcctgtgtagcctctgcgttcaccgtcagtagcaattacatgagctgggtccgccaggctccgaggtaaggggctggagtgggtctctagttatttagtagcgatcggaaccgcacctacttcgcagactccgcgaggggcagactcaccatctccagacgacaattccaaagtaacctaccctttatcttacagtactagaacagcctagacgacgacccgaggaccgtcggcttcggtactacttacgtggtacgacgtacggtaacggttccaacggtcgggtaccgttacgggttacccgaacgggtccggttaacggggtttaccgggtttaccccggaccccccgggttacgggggg

SEQ ID NO: 232340 - DNA, 692 bp, Homo sapiens
  misc_feature: GYAE6OF02GPIS1.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtcgtgggggaaccttgggtccagccgtggggggtccctgagactctcctgtgtagcctctgcgttcaccgtcagtagcaattacatgagctgggtcccgccgaggcctccgagggttaaggggcgtgggaggtggggtcctgtagtttatttagtagacgtatcggaacccgcaaccgtaccgttcgaccaaggaccttaccggacggaacggggggccaaaggtacctttaccgaaccctaacttccctacccgaaggaacggtaaacctaaactttaacccgaaaacggtaaaccctaaacccccgttttacttacctttaccaagtaattacgaaactacggtaccttaaggaagacggacccggaagggaccgtccgggtacttcgtacttaattaccgttggttggacggaggtagtaccaccgtggtccgttagggccaggaccgtacgggttcggtttccggacccccggttacggggg

SEQ ID NO: 232341 - DNA, 543 bp, Homo sapiens
  misc_feature: GYAE6OF02GSWEV.5.27.C05.1.454.CMB.1.raw
  modified_base (444)..(444): a, c, t, g, unknown or other
  misc_feature (444)..(444): n is a, c, g, or t
  modified_base (491)..(491): a, c, t, g, unknown or other
  misc_feature (491)..(491): n is a, c, g, or t
  modified_base (513)..(513): a, c, t, g, unknown or other
  misc_feature (513)..(513): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagcctggggggtccctgagactctcctgtgtagcctctgcgttcaccgtcagtagcaattacatgagctgggtccgcaggctccagggtaagggctggagtgggtctcagttatttatagcgatggaaccgcacacttcgcagacctccgcgaggggcagacttcacctatctccagagacaattccaaagaaccaccctttatcttcagatgaacacnctgagacgccgaggaccgtcgtctcgtctattacgtgtacgcgtagngtcaacgtggtacgtggtaccnggtcgaggttcggttccgaccccgtcgggg

SEQ ID NO: 232342 - DNA, 711 bp, Homo sapiens
  misc_feature: GYAE6OF02H1U38.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtcgtgggggaaccttggtccagccgtgggggtccctgagactctcctgtgtagcctctgcgttccaccgtcagtagacaattacatgagcgtcgggtccgccgaggcctccgagggtaggggcgtggaggtgggtctcgtagtttattagtagcgacgtacggaccgacactacgttcgacacgtaccgtcccggacgggacggggacgaaggtactttaccgaaccctattaccgtacccgaaaggacgtaaactaaactttacccgaaaacgtaaaccctttaaccccgtttttaaattccgttaacaaggttaactacggtaaacctccggacctaggaacggaccgaccgggaacggtacccgtcgggtacctttaacgggtcctttaaacgttacgtggtacggtacggtaaggtacgttaccgacggttcgggtaccgttacgggtaccaagggtccggtacggggtttcccggttaccccggaccccgggtacggggg

SEQ ID NO: 232343 - DNA, 593 bp, Homo sapiens
  misc_feature: GYAE6OF02JEN2X.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtcgtgggggaaccttgggtccagccgtggggggtccctgagactctcctgtgtagcctctgcgttcaccgtcagtagcaattacatgagctgggtccgccgaggcctccgagggtaacggggctgggaggtcgggtctcgtagtttatttagtaggcgagtggaaccgcacacttcgcagacctccgcggaggggcagacttcaccatccacagacgacaacttccaaagaacctaccctttatccttacagtaactgaaacacgcctagaggacgccggaggaccgtcggcttcgtacttaattacgtgtacgacgtaggtacgtcctacgtggcttacgggtaccgacggtccgtagggttcggttacccgacccggtaccgggg

SEQ ID NO: 232344 - DNA, 556 bp, Homo sapiens
  misc_feature: GYAE6OF02GSG8L.5.27.C05.1.454.CMB.1.raw
  modified_base (349)..(349): a, c, t, g, unknown or other
  misc_feature (349)..(349): n is a, c, g, or t
  modified_base (402)..(402): a, c, t, g, unknown or other
  misc_feature (402)..(402): n is a, c, g, or t
  modified_base (489)..(489): a, c, t, g, unknown or other
  misc_feature (489)..(489): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagcctggggggtccctgagactctcctgtgtagcctctgcgttcaccgtcagtagcaattacatgagctggggtcccgccaggctccgagggtaaggggctgggagtgggtctcagttatttanagcgatcggaaccgcacacttcgacagactccggcgaggggcagacttcaccntcctcagagacaattccaaagaacctaccctttatcttacagactgaaccagcctagagacgccggagacgtcggctgtctattacngtgacgagtcgtcacgtggcgttcggtccgaggccgtagggttcgggttacccgccccggtacgggg

SEQ ID NO: 232345 - DNA, 724 bp, Homo sapiens
  misc_feature: GYAE6OF02JO58U.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgcttatttaaaggtgtccagtgtgaggtgctagttggtggagtcgtgggggtaaccttggtccagccgtgggggtccctgacgactctccgtgtgtacgcctctgtcgttcaccgtcagtacgactaattacagtgagcgtacggtcccgacgacggcttaccgagggtaacgggcgtagggtacggtcggtactcgtagtttatttagtagcgtagtacggaaccgtacacgtacttccgactacgtaccgtccggacgggtaggggtaccaacggtacttaccgacctacgttaccgtaccgaagtaacgaactaaccttaccgaaagtaaacccttaccctttaactacttaccgaagttacgtaccgtaaaccacgtaccgttaggaacgtaccggtaccccggtaagtacccggtacggtccgtttaacgtacgttaacttaaccggttcggtacggtacggtacggtaaccggttaccgacgggtcggtaccgttcggtaccgtaggtccggttaacggggtttcccgttacccgggaccccgggttaccgggg

SEQ ID NO: 232346 - DNA, 661 bp, Homo sapiens
  misc_feature: GYAE6OF02JIETI.5.27.C05.1.454.CMB.1.raw
  modified_base (305)..(305): a, c, t, g, unknown or other
  misc_feature (305)..(305): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctatttaaaaggtgtccagtgtgaggtgcagttggtggagtcgtgggggaaccttggtccagccgtgggggtccctgagactctcctgtgtagcctctgcgttcaccgtcagtagctaattacatgagcgtcgggtcccncgaggcctccgaagggtaacgggctgggaggtcggtctacgtagttatttagtagcgagtacggaaccgcacacgttcgacacgacgtccgcggagggcagtactcgacctagtcctacgaagtacgaactaacttaccgaaagtaacctacccttataccttacgaagtactaacgaactacgtaccgtaggtaacggacggacccggtaaggtaccgtacgggtaccttacggtacttaaacgttacgtcggtacgacggtacggtaacgttcgtaacggttcggaccgtttacgggaccgttaacggccggttaacggggttccggttaccccggacccccgggttacggggg

SEQ ID NO: 232347 - DNA, 634 bp, Homo sapiens
  misc_feature: GYAE6OF02F99GS.5.27.C05.1.454.CMB.1.raw
  modified_base (303)..(303): a, c, t, g, unknown or other
  misc_feature (303)..(303): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtcgtgggggaaccttggtccagcctggggggtccctgagactctcctgtgtagcctctgcgttcaccgtcagtagcaattacatgagctggggtccnccaggctccgagggtaagggctgggagtgggtctcgtagtttatttatagcgatggaaccgcacacttcgacagtacctccggcggacgggggcaaggtacttacccacctactcctacccaaggtaacgactaaactttacccaaaacgtaaaccctaaccccttttaacttcctttacgaacgtaacgtacgtaaaaccacggtccgttaggaacggacggacccggaagggtacccgtcggacttgtccttaagttaccgtgtgacgagtacgtcgacgtggtcgtcggtccaggtccgagggtcggttcccggacccggtaccgggg

SEQ ID NO: 232348 - DNA, 266 bp, Homo sapiens
  misc_feature: GYAE6OF02G8524.5.27.C05.1.454.CMB.1.raw
  modified_base (261)..(266): a, c, t, g, unknown or other
  misc_feature (261)..(266): n is a, c, g, or t
tcagatcagacacgcacgaccggtgctcgatttagacgcgatcgaagggtttgggaacacggccaccctgaccatcagcagggtcgaagccggggatgaggccgactattactgtcaggtgtggaatggtgattatgattatgtcttcggaactgggaccaaggtcaccgtcctaggtcagcccaaggcccaaccccactgtcactctgttccccaccctcctccgtgtctgatctgagcgggctgggcaaggcgcatagnnnnnn

SEQ ID NO: 232349 - DNA, 676 bp, Homo sapiens
  misc_feature: GYAE6OF02IZJFS.5.27.C05.1.454.CMB.1.raw
  modified_base (369)..(369): a, c, t, g, unknown or other
  misc_feature (369)..(369): n is a, c, g, or t
  modified_base (395)..(395): a, c, t, g, unknown or other
  misc_feature (395)..(395): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggtttccttgttgctatttaaaaggtgtccagtgtgaggtgcagttggtggagtcgtgggggaaccttggtccagccgtgggggtccctgagactctcctgtgtagcctctgcgttcaccgtcagtagcctaattacatgagcgtcgggtccgccaggcctaccgagggtaagggctggacgtcgggtctcgtagttatttagtagcgatcggaaccncactacgttcgacacgaccgtaccgngacggggcagtcttacaccgtatcctaccgagactaacgtaacttccgaaagtaaccgtaccctttagtaccttacgaacgtaattacgaaacctacgacccgtagaaccgtaccggaccggtaacgtaccgtaccggacgttacgtaccgttaagttaccgttcggtaccgacgggtaacgtacgggtaccgttacggtacgggtaccgttaccgggtacccgtaagggtacccggtcgggtttaccggggttaccccggtaccccccggttacgggggg

SEQ ID NO: 232350 - DNA, 671 bp, Homo sapiens
  misc_feature: GYAE6OF02FZT96.5.27.C05.1.454.CMB.1.raw
  modified_base (277)..(277): a, c, t, g, unknown or other
  misc_feature (277)..(277): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttcctgttgctattttaaaaggtgtccagtgtgaggtgcaggttggtggagtcgtgggggaaccttggtccagccgtggggggtccctgagactctcctgtgtagcctctgcgttcaccgtnagtagctaattacatgagcgtcgggtccgcaggctccgagggtaaggggctgggagtcgggtctcgtagtttatttagtagcgagtcggaaaccgcactacgttcgacacgacgtccgcggaggggcagattcgacctatcctcacgaacgaactaagttacccaaacggtaacctaaccccgttttattaccctttacgaagtaacgttacgaaaccgtaacggtccgttacggaacggtacggaccggaacgggtaccgtcggtaccgttacggttacttaacgtttacgttggtacggtacgtaggtacggtacctacggtaccggtcgttaccgggtaccgtaacgggtacgtacgggttaccgggttaccggaccccccggtacggggg

SEQ ID NO: 232351 - DNA, 556 bp, Homo sapiens
  misc_feature: GYAE6OF02FKBBU.5.27.C05.1.454.CMB.1.raw
  modified_base (447)..(447): a, c, t, g, unknown or other
  misc_feature (447)..(447): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagccgtggggggtccctgagactctcctgtgtagcctctgccgttcaccgtcagtagcaattacatgagctgggtcccgccaggctccgaggtaagggctggaggtgggtctctagttattagtagcgatggaaccgcactacttcgcacgacctccgcggaggggcagtacttcaccatctccagacgaactaatccaaagaacctaccctttatccttanagatacgaacacgcctgagacggccgaggacgtcgctcgtactattacgtgtcgcgagtcgtcacgtggcgtggtaccagtccgaggttcggtaccgtacccgtcgggg

SEQ ID NO: 232352 - DNA, 832 bp, Homo sapiens
  misc_feature: GYAE6OF02JVMYZ.5.27.C05.1.454.CMB.1.raw
  modified_base (282)..(282): a, c, t, g, unknown or other
  misc_feature (282)..(282): n is a, c, g, or t
tcagatcagacacgcacgaccggtgctcgatttagacgcgatcgaagggtttggggcgtgggagaggagcccgagcactgggattccgaggtgtttccattcagtgatctgcactgaacacagaggactcgccatggagtttgggctgagctgggttttccttgttgcttattttaaaaggtgtccagtgtgaggtgctagttggtggagtctgggggaaccttggtccagccgtgggggtccctggagactctcctgtgtagcctcgtgccgttcaccgtnaacgtagcgtaattacatcgaagcgttcgggtcccggaccaggccttaccgaagggttaacggggcttgggaaggttcggggtactcgtaagggtttatttacgtaggtccgtaagttcgggaaaccccggtctaaccgtaccgtttacggaccaacggtaccgttaccccggacgggtaacgggggggcctaacgggtaactttccgaaccccgtaagttacccgtacccgtaaaggaaccggaaaccgttaaacttaccccgtaaaacggaaaccctaacccctttttaagtacccgtttaacgtaacgtaacttacgggtaaaaaccaccgggtaccttacggaacggtaaccgacccgggtaaacgggtaccgttaccggggtccttaaccggttaccgttttaaacttaaccggtttacgggttgtaacccggtaaggttaaccggttaccgtaccgttccggggaacccgtttacggggtaccctacggggaccgtttacgggggttaccgggtttaccccgggtacccccgggtaccgggggg

SEQ ID NO: 232353 - DNA, 595 bp, Homo sapiens
  misc_feature: GYAE6OF02I4A2A.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtcgtgggggaaccttggtccagcctggggggtccctgagactctcctgtgtagcctctgcgttcaccgtcagtagcaattacatgagctgggtcccgccgaggctccgagggtaaggggctgggaggtgggtctcgtagtttatttagtagcgatacggaaccgcaactacgttcgacacgactccggacgaggggcagacttccgaccagttacctcaagaacgactaacttaccaaagtaacctaccctttagtaccttacaagatacgaacacgcctagagacgcggagccgtcggctgtcttaattccgtgtcgcgtaggtcgtccgtagtcggtcgtcggtaccacgggcgtacgggttcggttacccggccccggttacgggg

SEQ ID NO: 232354 - DNA, 615 bp, Homo sapiens
  misc_feature: GYAE6OF02FGVF2.5.27.C05.1.454.CMB.1.raw
  modified_base (387)..(387): a, c, t, g, unknown or other
  misc_feature (387)..(387): n is a, c, g, or t
  modified_base (409)..(409): a, c, t, g, unknown or other
  misc_feature (409)..(409): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagccgtggggggtccctgagactctcctgtgtagcctctgccgttcaccgtcagtagcaattacatgagctgggtccgccaggctccgagggtaaggggctggagtcggggtctcgtagttatttatagcgatcggaaccgcactacttcgcagactccggngaggggcagacttcacctatcnccgagacgaactaacttaccaaacgaaccctaaccctttatccgttacagtatagtaaaccgagccgtaggaacgacggcccggaaggtaccgtcgggacttcgttcttaagttacgtggtagcggaggtacgtaccgtacgttcgggtaccttgggtaccctaggtccgtaagggtccgggtttacccggaccccggttcggggg

SEQ ID NO: 232355 - DNA, 647 bp, Homo sapiens
  misc_feature: GYAE6OF02JHEOO.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagcctggggggtccctgagactctcctgtgtagcctctgcgttcaccgtcagtagcaattacatgagctgggtccgccaggctccgaggtaggggctgggagtgggtctgtagttatttatagcgagtcggaaccgcacaccgttacgcacgactccgcggaaggggcaggtactcaccatcctaccgagacgaacaacttccaaagaaacctaccctttataccttcaagtaacttcgaaactacgaccttaggaacggtacggacccggaaggtaccgtccggtaccttaggttacccttaaagtttacctaggttacggacggtaggtaaccggtaccgtacgttcggaccgttacgggtacccgacgggtaccggtacggggtttacgggtttaccccggaaccccgggtccgggggg

SEQ ID NO: 232356 - DNA, 629 bp, Homo sapiens
  misc_feature: GYAE6OF02HHHE4.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagccgtggggggtccctgagactctcctgtgtacgcctctgtcgttcaccgtcagtagcaattacatgagcgtcgggtccgccaggctccgagggtaaggggctgggaggtgggtctcgtagtttattatagcgatacggaaccgcactacttcgacacgactccgcgagggcagtactcacctatcctaccagacaactaacttaccaaagtaacctacccttttatccttacgaagtatacgaaacacgtaccgtagacgtacgaccggaggtaccgtcgggacttggtaccttacgttaacgttggtacgcggtaacggcgttaccgacggttcggacgttcgggtacccgagggtaccgttacggggtttcccggttacccggacccccgggttcggggg

SEQ ID NO: 232357 - DNA, 553 bp, Homo sapiens
  misc_feature: GYAE6OF02GKCFG.5.27.C05.1.454.CMB.1.raw
  modified_base (358)..(358): a, c, t, g, unknown or other
  misc_feature (358)..(358): n is a, c, g, or t
  modified_base (432)..(432): a, c, t, g, unknown or other
  misc_feature (432)..(432): n is a, c, g, or t
  modified_base (449)..(449): a, c, t, g, unknown or other
  misc_feature (449)..(449): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaacttggtccagcctgggggtccctgagactctcctgtgtagcctctgcgttcaccgtcagtagcaattacatgagctgggtcgccaggctccgaggtaagggctgggagtgggtctcgagtttatttatagcgatggaaccgnacacttcgcacgactaccgcgaggggcagattcaccgatctccagagacaattaccaaagaaaccaccctttanctttacagtatgaaacngcctgagtagccgaggtaccgtcgctgtactattactgttgccgaggacgtcacgtggtctcggtaccgagccggaaggttcggttaccggaccccgtcggggg

SEQ ID NO: 232358 - DNA, 706 bp, Homo sapiens
  misc_feature: GYAE6OF02HHHS9.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctatttaaaggtgtccagtgtgaggtgcagttggtggagtcgtgggggaaccttggtccagccgtggggggtccctgagactctcctgtgtagcctctgcgttcaccgtcagtagcaattacagtgacgtcgtcgggtcccgccgaggcctaccgaggggtaacggggctgggaggtgggtctacgtaggtttatttatagacgagtacggaaccgcacaccttcgcacgacctccgacggaggggcaggacttccaccatcctaccgaagacgactaattacccaaacgtaaccctaacccttttatacctttacgaacgtaacttcgaaacctcgtacccttaggaacgggaacggaccccgggtaaagggtacccgttacggggtcctttacgggttacctttaaacgtttacgtacggttacggtaccggtaacggtaacggttaccgtaaccggtttcgggaccgtttacgggtaccccgagggtaccggttacggggttccgggttttaccccggacccccgggttaccgggggg

SEQ ID NO: 232359 - DNA, 638 bp, Homo sapiens
  misc_feature: GYAE6OF02JGJ59.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagccgtgggggtccctgagactctcctgtgtagcctctgcgttcaccgtcagtagcaattacatgagcgtgggtccgccgaggctccgagggtaacgggctggagtgggtctacgtagttattagtagcgtatcggaaccgcactacttcgacagacctcggcggagggcagactcgaccatcctaccgagaacgactaataccaaagaacctaccctttatcctacgaagtactacgaaactacgtccgtagaacggacgtacccggaagggtacctaccgggtcttacgtaccctttaagttacccgtgtacgaccggtaaaggtccgtaaccacgttcggggaccttaccggggtaccaacgggtccgttaacggggttccgggttaccccgacccccggggtacggggg

SEQ ID NO: 232360 - DNA, 806 bp, Homo sapiens
  misc_feature: GYAE6OF02JW73O.5.27.C05.1.454.CMB.1.raw
  modified_base (267)..(267): a, c, t, g, unknown or other
  misc_feature (267)..(267): n is a, c, g, or t
  modified_base (285)..(285): a, c, t, g, unknown or other
  misc_feature (285)..(285): n is a, c, g, or t
  modified_base (561)..(561): a, c, t, g, unknown or other
  misc_feature (561)..(561): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctggttttcctgttgctatttaaagtgtccagtgtgaggtgcaggttggtgagtcgtggggtaaccttggtccaggccttggggggtccctggagacctcgtccgtggtgtacgcctcngtcgttcaccgtcaggtncgtaacttacatggagtcgtcggtcccgcagggtccttaccgaagggtaacgggggtccgtagggtacgggttcgggtacctcgtaaggttttagtttacgtaagcgtaacgttacggggaacccctacgtaacctacgtttccgacgaagtacccgttccgggaccgggtagggggaccctaaggtactttacccgaaccgtaattcccgtacccgtaaaggtaaccgacctaaaaacttccccgaaaaacgttaaacccctaccctttttaacnccgttaaccgaaaggttactaacggtaaccgtaccgacccgttaggaacggtaaccggtacccggtaaccgggtacgtttacccgggttcttacggtttaacccttaacggtttaccgttaagggtaccgtaagggtaacggtacccggttacgttacccggtgggttaccgtttacccgggtccgtaacggtccggtaacccggggttttaggttacccccggggtaccccggtaaccgggggg

SEQ ID NO: 232361 - DNA, 801 bp, Homo sapiens
  misc_feature: GYAE6OF02IYLU1.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcttgggttttccttgttgcttaattttaaaaggtgtccagtgtgaggtgcagttggtggagtcgtgggggaaccttggtccagccgtgggggtccctgagactctcctgtgtagcctctgccgttcaccgtcagtagcaattacatggagtcgtcgggtcccgccgacgggcctaccggaaggggtaacggggctggggaggtgggtctcgtaagtttatttagagccgagtcggaaccgctaacgacttcgacgacgtacccgtccggacgggacggggactaacggtaccttccgaaccgtaactcccgtaacccgaaggaaccgtaacctaaaccgtttaacccaaaaccgttaaaccctaaccccgtttttaactcccgtttaacgaacggttaacttacgaaaacccgttacggaccccgttagggaaaccggaccgggtacccgggaaaggggtaccccgttcggggtacccgttttacggttaacccgttttaacgttaccggtttacgggtacggtaccggtaacgggttaacgttacccggtaacgggttccgggttacccggttaccgggttaacccgacggttacccgggttaacgggggtttccccgggtttaccccgggacccccggggttaccgggggg

SEQ ID NO: 232362 - DNA, 735 bp, Homo sapiens
  misc_feature: GYAE6OF02H4NOG.5.27.C05.1.454.CMB.1.raw
  modified_base (263)..(263): a, c, t, g, unknown or other
  misc_feature (263)..(263): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtcgtgggggaaccttggtccaggccgtgggggtccctgagactctctgtgtagcctntgtcgttcaccgtcagtagctaattacatgacgtcgtcgggtccgccgaggcctaccgagggtaacggggctaggacggtcgggttctcgtagtttattacgtaggacgtagtacgaacccgctaactaccgttcgacgacggtaaccgttccgggacggacgggggtacacggtactttcccgaacgtactcccgtaccgtaacggaacgtaacctaaacgtttacccgaaaacgttaaccccttaaccgttttaataccctttacgtaacgtaacgttaacgtaaccgtaaccggtccgttaaggacgtaaccggaccggtacgtaccgtacgggttccttacggttaacttaacgtttaccgcggttacgtaccggtaaggtacgtacccgtacggtacggttccggtacggttcccgaaggttcccggtaacgggtttccggtaccccggtaccccgggttaacgggg

SEQ ID NO: 232363 - DNA, 803 bp, Homo sapiens
  misc_feature: GYAE6OF02IVV7J.5.27.C05.1.454.CMB.1.raw
  modified_base (309)..(309): a, c, t, g, unknown or other
  misc_feature (309)..(309): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctatttaaaggtgtccagtgtgaggtgcagttggtggagtcgtggggaaccttggtccagccgtgggggtccctgagactctctgtgtacgcctctgcgttccaccgtcaggtagctaaattacagtgacgcgtcggggtcccnccgacggctaccgaagggtaacggggctgggagtgggtctcgtaagtttatttagtaggacgtagtacggaacccgcgtaactaccgtttacggaccgtaacggacccgtccgggacgggaacgggggcctaaaggtacctttacccaacccgtacttacccgtacccgaaaggtaaaccggtaacctaaacgtttaacccgaaaacgtaaacccgtttacccccgttttaattccctttaacgaaacgtaattacggaaaacctacggacccttagggaaacggacggtacccggtaaacgggtaccgttcccgggacgtttacgttaccgttttaaacgtttacgttcgggttaccggtaaccggtaacgggttaccgtttaaccgtaccgggttaaccgggtacccgtttacggttaccccggaagggttacccggttaacgggggttttcccgggtttaccccgggtacccccgggttaacccggggggg

SEQ ID NO: 232364 - DNA, 696 bp, Homo sapiens
  misc_feature: GYAE6OF02GH31Z.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagcctggggggtccctgagactctcctgtgtagcctctgcgttcaccgtcagtagctaattacatgagctgggtcccgcaggctccgagggtaaggggctgggagtgggtctcgtagtttatttagagcgatacggaaccgcactacttcgacacgaccgtccgcggaggggcaggtactttccgacctatccctaccgagtaacgaactaaacttacccgaaagtaacccttaaccccttttataccttacgaagtaacgtacgaaaccacggtacccgtaggaacgtacggacccgggtaaggtacccgttcgggacctttcggttaccttaacgtttaccgtggttacggaccgtagggtaaaccgttccgtaaaccgttcgggttaccgttacggggttacccaagggttccggttaaccggggggtttcggttttacccccgggacccccggtttaaccggggggg

SEQ ID NO: 232365 - DNA, 851 bp, Homo sapiens
  misc_feature: GYAE6OF02HMI4C.5.27.C05.1.454.CMB.1.raw
  modified_base (536)..(536): a, c, t, g, unknown or other
  misc_feature (536)..(536): n is a, c, g, or t
  modified_base (743)..(743): a, c, t, g, unknown or other
  misc_feature (743)..(743): n is a, c, g, or t
tcagatcagacacgcacgaccggtgctcgatttagacgcgatcgaagggtttggggctgggagacggagcccagcactgggattccgaggtgtttccattcagtgatctgcactgaacacagaggactcgccatggagtttgggctgagcttgggttttccttgttgcttatttaaaggtgtccagtgtgagtgctagttggtggagtcgtagggggaaccttggtccagccgtgggggtccctgacgactcctctgtgtacgcctcgtcgccgttcgaccgtcagtacgctaacgttacagtaggtacgcgttacgggcccgccgaacgggtccttccggaaggggtaaacgggggtcctaggggtaacgggtttcggggttcctacccgttaaaggtttactttttaacggaagggtaccgtaagttaccgggaaaacccggctaaccgtaaccgttttaccgggactaacgtaacccgtccggggaaccggaacgggggggacccaagggtaacctttacccggaaacccgtnttaccccgttaacccaaggaaccgggtaaaacccttaaaacccgttttaaccgaaaaaacccggttaaaaccccttaaccccgttttttaaactcccggtttaactaacggttacctaacgtaaacgttacgggacccgttaggtaaacgaccggaccgggtaagaacccgttgggaacccttggtttaaccttacgttttaaccgnggtttacggacggtacggttaacgtcgtaccggtcggtacgtaccgggttccaacgggttaccggtacgggtttacccgggttccccggttaaccccgggtccggggg

SEQ ID NO: 232366 - DNA, 562 bp, Homo sapiens
  misc_feature: GYAE6OF02GOR7U.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctatttaaaaggtgtccagtgtgaggtgcagttggtggagtcgtgggggaaccttggtccagccgtggggggtccctgagactctcctgtgtagcctctgcgttcaccgtcagtagcaattacatgagctgggtccgccaggcctccgagggtaaggggctggagtgggtctcagtttattagtagcgagtggaaccgcacacttcgcagactcgcgaggggcagcttcaccatctccagacgacaattaccaaagaacctaccctttatcttacagtactacgaacacgtcctaggagacgccggagtaccgtcggtcttgtcctaattacgtgtcgcgtacggtagtcacgtcggcgttcggccaggcgtaggtcggttaccgacccggtcgggg

SEQ ID NO: 232367 - DNA, 561 bp, Homo sapiens
  misc_feature: GYAE6OF02GEYGS.5.27.C05.1.454.CMB.1.raw
  modified_base (395)..(395): a, c, t, g, unknown or other
  misc_feature (395)..(395): n is a, c, g, or t
  modified_base (400)..(400): a, c, t, g, unknown or other
  misc_feature (400)..(400): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagcctggggggtccctgagactctcctgtgtagcctctgcgttcaccgtcagtagcaattacatgagctgggtccgccaggctccaggtaaggggctggagtgggtctcgagttatttatagcgatggaaccgcacacttcgcagactccgcgaggggcagatcacatcncaganacattccaagaacctaccctttatccttcagtatacgaacagccctggaacgacggcccgagggaaccttccgggccttggtccttaattactggttgcggagtaggtacacgtggtcctggtccaggtccgtagggttcggttccggaccccgtcggggg

SEQ ID NO: 232368 - DNA, 644 bp, Homo sapiens
  misc_feature: GYAE6OF02HRH1D.5.27.C05.1.454.CMB.1.raw
  modified_base (300)..(300): a, c, t, g, unknown or other
  misc_feature (300)..(300): n is a, c, g, or t
  modified_base (345)..(345): a, c, t, g, unknown or other
  misc_feature (345)..(345): n is a, c, g, or t
  modified_base (360)..(360): a, c, t, g, unknown or other
  misc_feature (360)..(360): n is a, c, g, or t
  modified_base (447)..(447): a, c, t, g, unknown or other
  misc_feature (447)..(447): n is a, c, g, or t
  modified_base (467)..(467): a, c, t, g, unknown or other
  misc_feature (467)..(467): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttcctgttgctatttaaaaggtgtccagtgtgaggtgcagttggtggagtcgtgggggaaccttggtccagccgtgggggtccctgagactctcctgtgtagcctctgcgttcaccgtcagtgacaattacatgagctaggtccncaggctaccgaggtaagggctggagtgggtctactagttatttanagcgatacggaaccncactactcgacagactccggacggagggacaggtacttcacatcctaccaagacgaactaattaccaaagtaaccctaaccctttanccttacaagattagaaaccngtacctaggacgtacggccgaaggtcccgtacgggtacttccggtacttaacgttaccgtggtacgtaaccggtaacggtacgtacccgtaacggtcgggtaccgttccgggtaacccaagggtcccggtaacgggggtttacccggtttaccccgggacccccgggttaccggggg

SEQ ID NO: 232369 - DNA, 744 bp, Homo sapiens
  misc_feature: GYAE6OF02J0H5X.5.27.C05.1.454.CMB.1.raw
  modified_base (178)..(178): a, c, t, g, unknown or other
  misc_feature (178)..(178): n is a, c, g, or t
  modified_base (186)..(186): a, c, t, g, unknown or other
  misc_feature (186)..(186): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagttggctgagctggtttcctgtgctatttaaaggtgtcagtntgagtgcngtgtgagtcgtggggaaccttggccagccgtgggggtccctgagtactcgtcctgtgtgtcctctgtccgttcaccgtcaggtagccaattacattcgagtcgtcggtccgaccaggtcctaccgaggtaacgggtccaggtaggtcgggttcctcggtaagtttagttaagtagaccggtataccggaaaccgcgtacaaccgtttccggcgtaacgtaacctacccggtcggacggggggtaaccaacgggtacctttaccggaacccgtaacttacccgtaaccggtaggaaaccggtaaacaaaccgttttaaacccgaaaacggtaaacccttaacccggtttaacttaccgttaacggtaactacgttaacgaaaccttcggaacccttaggaccgaaacgcccgtaagaacccgtacgggtccttcggtttaacgtaaccgtttacgcgggttaacaccggtaggtaacgtaacccgtgtaaccgcggttacccggtaccgaggttacccgtaaggggtccggtttacccggaccccgggttaacccgggg

SEQ ID NO: 232370 - DNA, 837 bp, Homo sapiens
  misc_feature: GYAE6OF02HB6GP.5.27.C05.1.454.CMB.1.raw
  modified_base (264)..(264): a, c, t, g, unknown or other
  misc_feature (264)..(264): n is a, c, g, or t
  modified_base (306)..(306): a, c, t, g, unknown or other
  misc_feature (306)..(306): n is a, c, g, or t
tcagatcagacacgcacgaccggtgctcgatttagacgcgatcgaagggtttggggcgtgggagaggagcccagcactgggattccgaggtgtttccattcagtgatctgcactgaacacagaggactcgccatggagtttggctgagctggtttcctgttgctattttaaaggtgtccagtgtgaggtgctagttggtggagtcgtgggggtaaccttggtccagccgtggggggtccctggagactcgtcctgtgtagcctntcgcgttcaccgtcagtagctaattacatgagcgtgggtccncgaggcctccgaaggtaagggctagggagtcgggtctcgtagtttactttatagcgtagtacggaaacccgctaacgacctttcggaccaacggtaaccgtcccgggacggtaacggggggcctaaaggttaccttaccgaaccctaacgttcccgttaaccgaaacgggtaacgaaaccttaaacgtttacccaaaaacggtaaacccttaaacccgtttttactaccgtttaacccgaaagttaacgttaaccggaaaacgtaaccgtaccgttaacggaacgggtaaacccgtacccgggtaaaccgggttaacccgttccgggtaaccgtttaacggtttaacccgttaaacgttttaccgttccggtttacgggaaccgggtaaccgggttaaaccggtcccggttaaacccggttcggggaacccgtttttcgggggtaacccccgtaacggggttacccggttaaaccgggggttttcccggggtttttaccccccggaacccccccggggtttacccgggggg

SEQ ID NO: 232371 - DNA, 545 bp, Homo sapiens
  misc_feature: GYAE6OF02F0Z6P.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagcctggggggtccctgagactctcctgtgtagcctctgcgttcaccgtcagtagcaattacatgagctgggtccgccaggcctccgagggtaaggggctgggagtggggtctcagttatttatagcgatggaaccgcacacttcgcagactccgcgaggggcagacttcaccatcctcagacgacaattccaaagaacctacccttatcttacagtatagaacagcctagacgacgccgagactcggctgtcttattacgtgtcgcgagacgtcacgtggcgtcggccaggcgtagggtcggttccgacccggtcgggg

SEQ ID NO: 232372 - DNA, 648 bp, Homo sapiens
  misc_feature: GYAE6OF02IYDY4.5.27.C05.1.454.CMB.1.raw
  modified_base (304)..(304): a, c, t, g, unknown or other
  misc_feature (304)..(304): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctatttaaaaggtgtccagtgtgaggtgcagttggtggagtcgtgggggaaccttggtcagccgtcgggggtcctgagactctccgtgtgtagcctcgtgcgttcaccgtcagtagcaattacatgagcgtcgggtccnccgagcctccgaagggtaagggctggaggtgggtctcgtaagttattagtagcgagtacggaaccgcacacttcgacgacgaccgtccggacgacggggcaacggtacttcgaacctactacgtaccgaagaacgaacaaattaccgaaaacgtaaaccttaacccgtttaatccttacgaacgtaataacgaacacgtacctagaacgaccggaccgtaaggtacccgtacggcttacggtaccttaacgttacgtgtacgtcggtaaggtacgtacctacgtcggtacgttacggtaccgtacggtacgtacgggttcggttacccggacccgtaccggggg

SEQ ID NO: 232373 - DNA, 717 bp, Homo sapiens
  misc_feature: GYAE6OF02I26ME.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcttgggttttccttgttgctatttaaaaggtgtccagtgtgaggtgcagttggtggagtcgtgggggaaccttggtccagccgtgggggtccctgacgactcctcctgtgtacgccctcgtgtccgttccacccgttcaggttacgacctaaattaccagtgacgtcgtcgggtcccgccgacggccgtacccggaaggggtaacgggggtcgtaggggacggttcggggtccttacgttaagttttatttagtaaggcgtagtacggaacccgccaacctaccgttcgacgacgtaccgtcccggacgggtacggggacctaagtctttacccacctacgtccctaccgaggaacgaactaacgttaccaaacgtaaccttacccctttattccttacaagtagtacgaacgtacgaccgtagaacggacggaccggtaagtaccgtccggtcgttagtactttaacgttcgtagtacgaccgtaggtacttaccgtacggtcggtacccgttggacccgtacgggtaccgtacggggtcccggtttacccggccccggttaacgggg

SEQ ID NO: 232374 - DNA, 597 bp, Homo sapiens
  misc_feature: GYAE6OF02JAZ5O.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggtttccttgttgctattttaaaggtgtccagtgtgaggtgcagttggtggagtcgtgggggaaccttggtccagcctggggggtccctgagactctcctgtgtacgcctctgcgttcaccgtcagtagcaattacatgagctgggtcccgccaggcctccgagggtaaggggctgggagtgggtctcagtttattatagcgatggaaccgcacacttcgcagacctccggcgaggggcagacttcgacctatcctaccgagacgactaacttcccaaagtaacctacccttttactccttacagtattgaaactgccgtagacgacgccgaggactccggcttcgtacttattaccgtggtcgcgtaggtcttacgacgtggccgtttcgggtacccgtaggtccgtacggggttccggtttacccggacccccggttacggggg

SEQ ID NO: 232375 - DNA, 774 bp, Homo sapiens
  misc_feature: GYAE6OF02IINBE.5.27.C05.1.454.CMB.1.raw
  modified_base (307)..(307): a, c, t, g, unknown or other
  misc_feature (307)..(307): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagccgtgggggtccctgagactctcctgtgtagcctctgcgttccaccgtcagtagcaattaacatgagtcgtcggggtccncccgaacggcctaccgtaaggggtaacggggtcctaggggaggttggggtacctcgtaaggtttaattttaagacggtacgtagttacgggaaacccgtctaacctacctttccggaacgaacgacccgttacccgggacgggaacgggggtccaaagtacgtttcccaacccgtaacttccgtacccgaaggaacggaaccttaaactttaacccgaaaacggtaaaccccttaacccctttttaactccctttaacgaagtaaccgttacgaaacccgtacggtacccgttaaggacggaacgggtacccggaacggggtaccgtccgggtacctttacggttacgttaacgtttaaccgttgggtacgtaccggtaagtacgttaccgaccgttcgggtacttaccgggtaccgacgtaccgggtacgggttacgggtttccccggaccccggttaccgggggg

SEQ ID NO: 232376 - DNA, 723 bp, Homo sapiens
  misc_feature: GYAE6OF02GJYGT.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaggtgtccagtgtgaggtgcagttggtggagtcgtgggggaaccttggtccagccgtgggggtccctgagactctcctgtgtacgcctctgccgttcaccgtcagtagactaattacatgacgcgtcgggtcccgccgaggtcctccgaaggggtaacggggcgtagggtaggtcggggtcctcgtagtttatttagtagcgtagtacggaaaccgcaaccgtacttcgacacggtaccgtccgggacgggacgggggacaacgtaccttaccaacctacgttccctacccgaagaacgtaaactaacttacccgaaaacgtaacccttacccttttatacctttacgaacgtataacgaactacggaccttagggaacgacggacccggtaaggtacccgttccgggtaccttcgttaccgtttaacttaccgttggttacggacggtaacggtacggttaccgtacggtcggtaccggttaccggtacccgtacggtaccggttaccggggtttccggttacccccgggaccccgggttaccggggg

SEQ ID NO: 232377 - DNA, 578 bp, Homo sapiens
  misc_feature: GYAE6OF02FWIVQ.5.27.C05.1.454.CMB.1.raw
  modified_base (525)..(525): a, c, t, g, unknown or other
  misc_feature (525)..(525): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtcgtgggggaaccttggtccaggccgtggggggtccctgagactctcctgtgtagcctctgcgttcatcgtcagtagcaattacatgagcgtggggtccgccgaggctccgagggtaaggggctgggaggtgggtctcgtaagtttatttatagcgtagtgggaaccgcacactttcgacagacgtccgacggacgggcagattccacctatccaccgaagacgaactaacttaccaacgaacctaccctttatccttacagatacgaacacgccgtagacgacggaccgacggccgtcgctgttactattcgtgtcgngtagagtcctagtcggtgtcggtccgagcgtacggttcggttccgtacccggg

SEQ ID NO: 232378 - DNA, 636 bp, Homo sapiens
  misc_feature: GYAE6OF02HMMHU.5.27.C05.1.454.CMB.1.raw
  modified_base (294)..(294): a, c, t, g, unknown or other
  misc_feature (294)..(294): n is a, c, g, or t
  modified_base (309)..(309): a, c, t, g, unknown or other
  misc_feature (309)..(309): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctatttaaaaggtgtccagtgtgaggtgcagttggtggagtcgtgggggaaccttggtccagccgtggggggtccctgacgactctcctgtgtagcctctgcgttcaccgtcagtagcaattacatgancgtgggtcccgccgnggcctccgagggtaacggggctgggaggtgggtctctagttattatagcgatcggaaccgcactactcgacacgacctcggcggacggggacagtacttaccgaccactcctaccgagaacgactacttaccaaacgtaacctaccctttatccttacgtagacgtacgaaacgcgccgttagaggaccgaccgggaaggaccgtccgggtcttcgggttaccttaacgttccgttggtcggaccgtaggtaaccgtcgtacggtggttcgtccggtacggacggtccggttaggggttcccggttacccggacccggtccgggggg

SEQ ID NO: 232379 - DNA, 553 bp, Homo sapiens
  misc_feature: GYAE6OF02GVGWG.5.27.C05.1.454.CMB.1.raw
  modified_base (453)..(453): a, c, t, g, unknown or other
  misc_feature (453)..(453): n is a, c, g, or t
  modified_base (464)..(464): a, c, t, g, unknown or other
  misc_feature (464)..(464): n is a, c, g, or t
  modified_base (507)..(507): a, c, t, g, unknown or other
  misc_feature (507)..(507): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtcgtgggggaaccttggtccagcctggggggtccctgagactctcctgtgtagcctctgcgttcaccgtcagtagctaattacatgagcgtcgggtccgccaggcctaccgagggtaaggggctgggagtgggtctcagtttattagagcgagtggaaccgcactacttcgcagacgtcgcggagggcaggactcacctatcctccaagacgactaacgttaccaaagaacctacccttatccttanagactagaacngtcctgagacgccgagctcggctgtcttatacgtgtgcgaggntctactggtcctggtccagcgtagggtcggtaccgacccgtcgggg

SEQ ID NO: 232380 - DNA, 688 bp, Homo sapiens
  misc_feature: GYAE6OF02I0IMY.5.27.C05.1.454.CMB.1.raw
  modified_base (354)..(354): a, c, t, g, unknown or other
  misc_feature (354)..(354): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttcctgttgctatttaaaaggtgtcagtgtgaggtgcagttggtggagtcgtgggggaaccttggtccagccgtgggggtccctgagacgtctcctgtgtagcctctgcgttcaccgtcagtagctaattacatgagcgtcgggtccgccaggccttaccgagggtaagggctgggagtgggtacctcgagtttattanagcgtaagtacggaaccgtcacacgttcgacacgactcccggacggaacggggtcaaggtacgtttccaaccgtactaccgtaccaagaacggtaaaccaaagtttacccaaaacggtaaaccctaacccttttaagttaccttacgaacgtacttaacgaaacctacgtaccgtacggagaaccggaccgaagggtaccttaccgggcttacgtcgttaacttaccgtgttaccgacggaaggtaacggtccacggttaccgggtacgttacgggtaccctaacgggtacctaagggggtttcccggttaccccggtaccccgtaccgggggg

SEQ ID NO: 232381 - DNA, 801 bp, Homo sapiens
  misc_feature: GYAE6OF02I3DM5.5.27.C05.1.454.CMB.1.raw
  modified_base (262)..(262): a, c, t, g, unknown or other
  misc_feature (262)..(262): n is a, c, g, or t
tcagatcagacacgcacgaccggtgctcgatttagacgcgatcgaagggtttggggctgggagaggagcccagcactgggattccgaggtgtttccattcagtgatctgcactgaacacaggaggactcgccagtggtaggttcggctgacgtcgtttcgggttttccttgttgtactttaaagttttaaaggtgtccgtagttgtagtaggtgcgtaggttgggtggtagtccggtacgggggtaacctttcgggtaccgnggtcccgggttacgggggttccctaggacgtcttcctccgttggtacgtacgtcctcgtcggtacgttaccgaccggtgtaacggttacgactaaaccttatagtacggtacgtcggtccgggtacccgtaccgacgggttacccgtacggtaaggggttaacggggcgtaggtacgggttcgggtactacgtagttaacgtagtttacgacggagttacggtaccggaccgcgtaacctacgtcgacgtaccgcgtccggacggtacgggactacgtaaccctcgtaacctactaccgtaacgagtaaccgtaaccttaaccgtaaccgaaacgttaacccttacctttccttaaccgtacgtaacgttcaaacgaacctaccgttacgaacgaacggtaccgaccgtaacggtcccgtacgtacgttacgtttaccgttaagtttcgtagacggtaaccggtcggttacgtacgtaccgtcgggttaccgtacgggtcaccggttcgggtaggtttccccgggacccgtacccgggg

SEQ ID NO: 232382 - DNA, 552 bp, Homo sapiens
  misc_feature: GYAE6OF02GKBCE.5.27.C05.1.454.CMB.1.raw
  modified_base (395)..(395): a, c, t, g, unknown or other
  misc_feature (395)..(395): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagcctggggggtccctgagactctcctgtgtagcctctgcgttcaccgtcagtagctaattacatgagctgggtccgcaggctccaggtaaggggctggagtgggtctcagttattatgcgatggaaccgcacacttcgcagacctccgcgaggggcagacttcacatcncagagacattccaaagaacctacccttatccttacagtatcgaacagcctagagagaccgagacgtcgctgtctattacctgtcgacgagtacgtacacggtcggcgttggtacccgaggtccgtacggggttcggttacccggacccggtacgggg

SEQ ID NO: 232383 - DNA, 274 bp, Homo sapiens
  misc_feature: GYAE6OF02HTHQT.5.27.C05.1.454.CMB.1.raw
  modified_base (252)..(252): a, c, t, g, unknown or other
  misc_feature (252)..(252): n is a, c, g, or t
  modified_base (257)..(274): a, c, t, g, unknown or other
  misc_feature (257)..(274): n is a, c, g, or t
tcagatcagacacgcacgaccggtgctcgatttagacgcgatcgaagggtttgggaaaacggccaccctgaccatcagcagggtcgaagccggggatgaggccgactattactgtcaggtgtggaatggtgattatgattatgtcttcggaatgggaccaaggtcaccgtcctaggtcagcccaaggcccaacccatgtcactctgttccccgccctcctccgtgtctgactctgagcgggctggcaaggcnatagnnnnnnnnnnnnnnnnnn

SEQ ID NO: 232384 - DNA, 732 bp, Homo sapiens
  misc_feature: GYAE6OF02JSG3E.5.27.C05.1.454.CMB.1.raw
  modified_base (272)..(272): a, c, t, g, unknown or other
  misc_feature (272)..(272): n is a, c, g, or t
  modified_base (568)..(568): a, c, t, g, unknown or other
  misc_feature (568)..(568): n is a, c, g, or t
tcagatcagacacgcacgaccggtgctcgatttagacgcgatcgaagggtttggggcgtgggagaggagcccagcactggattccgaggtgtttccattcagtgatctgcactgaacacagaggactcgccatggagtttgggctgagcttgggttttccttgtgtcttattttaaaggtgtccagtgtgaggtgctaggttggtggagttcgtgggggaaccttgggtcctaggccgtgggggtccctgacgaccgtctctgtgtcgcctntcgtcgttcaccgtcagtagctaagttcagtcgagtcgtggtccgccgaggccttaccgaggtaacgggcgtagggtaggtcggggttacttacgtagttttaacgtttagtacggtacgaacggttacgggtaaacccgcgttaacgtacgtttaccggactaacggtaccgtccggtacggacggggtccaaggtactttcccgacctatccctaccgaagaaccgtaactaaccgttaccaaacgttaactacccgtttactaccgttacacgtacttacgaacacggtccgngtaacggaccgacgtaacggtccgtaccgagttaccgttccttaaagttaccgttcggttacggaccggtacggttaacgtcccggtaaggttccggtttacgcggttaacccgacgggtcgtttaaccgggggtcggtttaaccccggccccggttaacgggg

SEQ ID NO: 232385 - DNA, 596 bp, Homo sapiens
  misc_feature: GYAE6OF02G83QX.5.27.C05.1.454.CMB.1.raw
  modified_base (410)..(410): a, c, t, g, unknown or other
  misc_feature (410)..(410): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttcctgttgctattttaaaaggtgtccagtgtgaggtgacagttggtggagtcgtcgggggaaccttggtccagtccgtggggggtccctgacgactctcctgtgtagcctcgtgcgttcaccgtcagtagcaattacatgagctgggtcccgcaggctcagggtacgggctggcgtgggtctcagtttatttagtagcgagtacggaaccgcactacttcgcagacctccggcgaggggcaggtacttcgaccntcctcgagacgacaacttaccaaagtaccctacccgtttatccttacacgtattacgaactgacccgtagacggaggccgaaggacgtcggtactcggtacttagttaccgtgtcgacgtagacgtcacgtcggtaccgttcggtaccaggtccgtaggttccggttacccggacccgtaccgggg

SEQ ID NO: 232386 - DNA, 653 bp, Homo sapiens
  misc_feature: GYAE6OF02GCHUX.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttcttgttgctatttaaagtgtccagtgtgaggtgcagttggtggagtcgtgggggaaccttggtccagccgtgggggtccctgagactctcctgtgtacgcctctgcgttcaccgtcagtagactaattacatgagcgtcgggtccgccgacggcctccggaagggtaaggggcgtagggaggtcgggtctcgtagtttatttagagcgtagtacggaaccgctaacacgttcgacacgacctcggcggacggggcaggacttccacctactcctaccagaacgtaacaacttaccaaacgtaaccctaccctttactacttacagtactacgaactacgactacgacggacggaccgaacggaccgtccgggtcttacggttcttaacgttacgttgtacgtggtacggtacgttccaaccggtcggtacgttccgggtaccgtacggtccggttaacgggtttccgggttaccccgggtacccgggtaccggggg

SEQ ID NO: 232387 - DNA, 586 bp, Homo sapiens
  misc_feature: GYAE6OF02FG8FT.5.27.C05.1.454.CMB.1.raw
  modified_base (423)..(423): a, c, t, g, unknown or other
  misc_feature (423)..(423): n is a, c, g, or t
  modified_base (543)..(543): a, c, t, g, unknown or other
  misc_feature (543)..(543): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggtttttccttgttgctatttttaaaaggtgtccagtgtgaggtgcagttggtggagtcgtgggggaaccttggtccagccgtggggggtccctggagactctcctgtgtacgcctctgcgttcaccgtcaggtagctaattacattgagcgtcgggtccgccaggctccgagggtaagggctgggagtgggtctctagttatttagtagcgatcggaaccgcacacttcgacacgactccgcggaggggcaggacttcaccatccacaganactaataccaaagaacctacccttatcttacatatacgaacagtcctagagacggaccgacgacgtcgtctcgtctagttacgtgtcgaggcgtacgtactacgtggccgttggtacccnggtaccggtacgggttcgggttacccgtacccgggtaccgggg

SEQ ID NO: 232388 - DNA, 757 bp, Homo sapiens
  misc_feature: GYAE6OF02II6I5.5.27.C05.1.454.CMB.1.raw
  modified_base (289)..(289): a, c, t, g, unknown or other
  misc_feature (289)..(289): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcttgggttttccttgttgacttaattttaaaggtgtccagtgtgaggtgctagttggtggagtcgtgggggaaccttggtccagccgtgggggtccctgacgactccgtcctgtcgtacgcctcgtcgtcgttccaccgtnagtacgctaattacatgagcgtcggccgaccgaggtcctacggagggtaacgggcgtagggaggtgggtcctagtagtttaagtttagaggacgtagtacggaacccgactactacgttacgacgaacgtaacccgtcccgggacggtaacggggactaacggtactttacccgaacccacgttcccgtaaccgaaggaacgtaaacccgtaacctttaaccgaaacccgtaaacccttaaacccttttttacgaaccgtttacccgtaaagtaaccgttaacggtaaacccctggtacccttaagggacggttaaaccggcccgtaaggtaccgttcggaacttcggttaaacgttaccgtttaacgcgggtataacccggtagacccggttaactacggtccgtcggttaaccggccgtaacgccgggttaccggtacccggttccccgaacccgggtacccgggg

SEQ ID NO: 232389 - DNA, 632 bp, Homo sapiens
  misc_feature: GYAE6OF02GENBC.5.27.C05.1.454.CMB.1.raw
  modified_base (277)..(277): a, c, t, g, unknown or other
  misc_feature (277)..(277): n is a, c, g, or t
  modified_base (311)..(311): a, c, t, g, unknown or other
  misc_feature (311)..(311): n is a, c, g, or t
  modified_base (592)..(592): a, c, t, g, unknown or other
  misc_feature (592)..(592): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaggtgtccagtgtgaggtgctagttggtggagtcgtgggggaccttggtccagccgtgggggtccctggagactctccgtgtgagtcctctgcgttcaccgtnagtagactaattacatggagtcgtcggggtcccnccgtacggcctaccgtaaggggtaacggggcgtgggtaggttcgggtcgttacgtagtttattagtaggtcgaagtcggaaaccgcaactacgttccgctaacgaccgtaccggacggacggggacacgtacttccacctagttccctaccgaggaacgaacctaattacccgaaagtaccctaaccccttttagcttaacgagtataccgaactcgcctagacacgcccgtagaccgtcgatcgtactatttacgcgtgacgagtcgtacacggttcggngtcgacccgtgaccggtggttcgtacccggacccggtggg

SEQ ID NO: 232390 - DNA, 566 bp, Homo sapiens
  misc_feature: GYAE6OF02IXEDD.5.27.C05.1.454.CMB.1.raw
  modified_base (287)..(287): a, c, t, g, unknown or other
  misc_feature (287)..(287): n is a, c, g, or t
  modified_base (311)..(311): a, c, t, g, unknown or other
  misc_feature (311)..(311): n is a, c, g, or t
  modified_base (381)..(381): a, c, t, g, unknown or other
  misc_feature (381)..(381): n is a, c, g, or t
  modified_base (426)..(426): a, c, t, g, unknown or other
  misc_feature (426)..(426): n is a, c, g, or t
  modified_base (436)..(436): a, c, t, g, unknown or other
  misc_feature (436)..(436): n is a, c, g, or t
  modified_base (463)..(463): a, c, t, g, unknown or other
  misc_feature (463)..(463): n is a, c, g, or t
  modified_base (465)..(465): a, c, t, g, unknown or other
  misc_feature (465)..(465): n is a, c, g, or t
  modified_base (471)..(472): a, c, t, g, unknown or other
  misc_feature (471)..(472): n is a, c, g, or t
  modified_base (475)..(475): a, c, t, g, unknown or other
  misc_feature (475)..(475): n is a, c, g, or t
  modified_base (478)..(478): a, c, t, g, unknown or other
  misc_feature (478)..(478): n is a, c, g, or t
  modified_base (489)..(489): a, c, t, g, unknown or other
  misc_feature (489)..(489): n is a, c, g, or t
  modified_base (534)..(534): a, c, t, g, unknown or other
  misc_feature (534)..(534): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcttgggttttccttgttgcttaattttaaaaggtgtccagtgtgaggtgcagttggtggagtcgtgggggaaccttggtccagccgtggggggtccctgagactctcctgtgtacgcctctgtcgttcaccgtcagtancaaattacatgagcgtgggtcccnccgaggcctccgagggtaacggggctgggagtggggtctcgtagtttattagtagacgactcggaacccncaacctacttcgactacgacctccgcggagggctagacttcaccntcctacaganactataccaataacctcccttatcttnanatgacnnccnganacgcgagtacncgtctgtacttagtactgcgacgagcgtacacgtgcgtcgtacgngtcggtacggtcggttacccgccggtccgggg

SEQ ID NO: 232391 - DNA, 592 bp, Homo sapiens
  misc_feature: GYAE6OF02I8F7A.5.27.C05.1.454.CMB.1.raw
  modified_base (306)..(306): a, c, t, g, unknown or other
  misc_feature (306)..(306): n is a, c, g, or t
  modified_base (339)..(339): a, c, t, g, unknown or other
  misc_feature (339)..(339): n is a, c, g, or t
  modified_base (348)..(348): a, c, t, g, unknown or other
  misc_feature (348)..(348): n is a, c, g, or t
  modified_base (362)..(362): a, c, t, g, unknown or other
  misc_feature (362)..(362): n is a, c, g, or t
  modified_base (450)..(450): a, c, t, g, unknown or other
  misc_feature (450)..(450): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggtttccttgttgctattttaaaaggtgtccagtgtgaggtgcagttggtggagtcgtgggggtaaccttggtccagccgtggggggtccctgagactctcctgtgtagcctctgcgttcaccgtcagtagactaattacatgagcgtgggtccnccaggctcgagggtaaggggctggagtggctanagttattanagcgtatcggaacncacacttcgcacgactccgacggaggggcagactcacctatcctaccagaagactaacttacaaacgtaacctaaccttactccttanactaactgaactacgcctaggacgacgaccggaggaccgtacgcgttcgttactacgttactggtcgacgtaacgtacgttccgacgtggtcgtcggtaccgagtaccgtagggttccggttacccggacccggtaccgggg

SEQ ID NO: 232392 - DNA, 726 bp, Homo sapiens
  misc_feature: GYAE6OF02GI5OT.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagttgggctgagctgggttttccttgttgctatttaaaaggtgtccagtgtgaggtgcagttggtggagtcgtgggggaaccttggtccagccgtggggggtccctgagactctctgtgtagcctctcgcgttcaccgtcagtacgctaatacatgagccgttcgggtcccgaccgacgggcctaccggaaggggtaacggggtcgtagggaggttcggggtcctacgtagtttagtttaagtaggtacgtaggtacggaaacccgtactaactaccgttccgactacggtaccgtcccggacgggacggggactaacggtactttaccaaccgtactaccctaccggaacgtaacgaaacctaaacgttaaacccgaaaacgtaaacccttaaccccttttaattaccgttaccgtaacgtacgtaaacgaaccgtacgtaccctagggaacgaccggtacccgggaaacggtccgtaccgggtacgtacgttacttaacgttacgtagtcggtacgaggtcctacgtacgtcggtcgttcggtaccgtcggacggtagggttccgggtacccggtacccgggtccgggg

SEQ ID NO: 232393 - DNA, 866 bp, Homo sapiens
  misc_feature: GYAE6OF02IYPDN.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcttgggttttccttgttgctattttaaaaggtgtccagtgtgaggtgcagttggtggagtcgtgggggaaccttggtccagccgtgggggtccctgagactctcctgtgtacgcctctcgcgttccaccgtcagtacgactaattaccatgagtcgtcgggtcccgccgacggtcctaccggaaggggttaacgggggcgtaggggtaggttcgggggttccttacgttaaggttttaagttttaacggtacggtacggtaagtaaccgggtaaaccccgaccgtaaaccgttaccgtttaccggaccgtaacggtaacccggttcccggaccggggaacgggggtaccgtaaacggttacctttacccgaacccgtaaacgttcccgtacccgaaaaggaaccgtaaaccctaaacctttaacccgaaaacgtaaaccctttaacccccgttttaattcccgttaaacaacggttaactaacggtaaaccctacgtaccgttagggaacggtaaccgggtaccgggaaacgggtaccgttacccggggtacctttaccggttaacctttaactttaaccgggtacggttacggaaccggtaacggttaacgttacccggaaaccggtttcgggtacccgtttacgggtaccccgtaacggtaccgggttaacgggggtttccccgggtttaccccgggacccccgggtaacgggggg

SEQ ID NO: 232394 - DNA, 660 bp, Homo sapiens
  misc_feature: GYAE6OF02FY569.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtcagtgtgaggtgcagttggtggagtcgtgggggaaccttggtccaggccgtggggggtccctgagactctcctgtgtagcctctgccgttcaccgtcagtagctaattacatgagtcgtcgggtcccgccgaggcctccgaggggtaacggggctagggagtcgggtctcgtagtttatttagtagcgtagtcggaaccgcaactacttcgacgacgaccgtcccggacggacggggcacggtacttaccgacctatcctaccgaagaacgaacctaacttaccaaacgtaaccctacccgtttactccttaacagttacacgaacctcggtcctaggaacgacggaccggaacggtccgtcggacttgtacttaagttcgtgtcggacgtacgtcggtacctacgggtcggtccgttacgggtccccgagggtaccgtagggggtttcccggttacccgggtaccccggtccgggggg

SEQ ID NO: 232395 - DNA, 646 bp, Homo sapiens
  misc_feature: GYAE6OF02H2DFP.5.27.C05.1.454.CMB.1.raw
  modified_base (280)..(280): a, c, t, g, unknown or other
  misc_feature (280)..(280): n is a, c, g, or t
  modified_base (306)..(306): a, c, t, g, unknown or other
  misc_feature (306)..(306): n is a, c, g, or t
  modified_base (448)..(448): a, c, t, g, unknown or other
  misc_feature (448)..(448): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgtgctattttaaaggtgtccagtgtgaggtgcagttgtgagtctggggaccttggtccagccgtgggggtccctgagacgtctcctgtgtagcctcgtgccgttacaccgttcaggtanacgaattacatgacgtctggggtccncgaggctccgaggtagggctggagtgggtctcagtttattatagcgtagtcggaacccgcacacttcgcaagcctcggcgtaggggcagtactcacatctaccgagacgaactaactaccgaacgtaaacctaccttttaanctttaaccgataacgtacgaaacctaggcccgttagaacggtaggaccggacgaaccgttcgggacgtttcggtaaccttacgtttaaccgtcgtcgggtaacgaacgttaaacggtcccttaggttacggtccggttacggttacccgacgtaccgggagggtttccggggtacccggtaaccccccggtcgggggg

SEQ ID NO: 232396 - DNA, 681 bp, Homo sapiens
  misc_feature: GYAE6OF02FIL9J.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctatttaaaaggtgtccagtgtgaggtgcaggttggtggagtcgtgggggaaccttggtccagccgtggggggtccctgagactctcctgtgtacgcctctgcgttcaccgtcagtagcaattacatgagctgggtccgccgaggctccgagggtaaggggctgggtagtcgggtctcgtagtttagttataggcgtatacggaaccgtcacgtaccttcggacaggacctccggacggagggggccagtactacaccactcctaccgaagacgaactaactaccaaagtaaccctaccctttattacttaccagtacttagaaactcgtacccgtagaacggacgcccgggtaacgggaaccgttccgggccgttacgttacgttaaccgtttacgtcggtaggtacggtaacggtaacggtacccgttaacggtcgggtccgttaccgggtacccgtacggtaccggttaggggtttacccgggttacccgtacccccggggttaaccgggggg

SEQ ID NO: 232397 - DNA, 754 bp, Homo sapiens
  misc_feature: GYAE6OF02HX1BP.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcttgggttttccttgttgctaattttaaaaggtgtccagtgtgaggtgcagttggtggagtcgtgggggaaccttggtccgagccgtgggggtccctgagactctccgtgtgtacgcctctcgcttccgaccgttcgagtagactaattacgtagtgagtcgtcgggtcccgccgacggtccgtccgtaagggtaacggggcgtagggaggttcgggtctacgtagttttatttagacggtcgtagtcggaaacccgtctaaccgtaccgttccgacgtaacgtaccgtcccgggacgggtacggggaccgagtaccgtttacccgaacctacgttcccggtaccaaagggttaaccgaaaccttaaacttacccgaaacggtaaacccttaccctttttaacgccttaacgaagtacttacggaaacctcgtaccgtggaaccgtacggtccgaaggtacgtccggtacttacggttacttaacggttcgtcgggtacgtacggtaaggtacgttaccgtaacggttgggtacccgtttccgggtaccaacgggttcccggtaacgggggtttcccggttaccccggggtccccggttacggggg

SEQ ID NO: 232398 - DNA, 703 bp, Homo sapiens
  misc_feature: GYAE6OF02G65KF.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcgtgggttttccttgttgctattttaaaaggtgtccagtgtgaggtgctagttggtggagtcgtgggggaaccttggtccaggccgtcgggggtccctgacgactctccgtgtgtacgcctctgtccgttccaccgtcgtagtacgactaactacagtagacgtcgtcggtcccgcgacggctccgagggtaagggtcgtaggtaggtcgggtcgtcgtagttagttagtagacgacgtacggaccgactacgtaccgttcgacacgaccgtccggacggacgggacgtttttagacttaccacctactcctaccgacgtaacgaactaactacgtaaaccgtaaacccttacccttacttaccttacgtaacgtaacgtacgtaaccgacgtaccgtacgaacggaaccggaccggaacgtaccggtaccggtacgttacgttaccgttacgttacgtggtacggtacggtacggtacggtacgtacggttcggtaccggttcgaccgtacggtaccggtacgggttccgggttacccggacccggtaccgggg

SEQ ID NO: 232399 - DNA, 568 bp, Homo sapiens
  misc_feature: GYAE6OF02F98TC.5.27.C05.1.454.CMB.1.raw
  modified_base (410)..(410): a, c, t, g, unknown or other
  misc_feature (410)..(410): n is a, c, g, or t
  modified_base (421)..(421): a, c, t, g, unknown or other
  misc_feature (421)..(421): n is a, c, g, or t
  modified_base (507)..(507): a, c, t, g, unknown or other
  misc_feature (507)..(507): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtcgtgggggaaccttggtccaggccgtggggggtccctgagactctcctgtgtagcctctgcgttcaccgtcagtagcaattacatgagcgtggtccgccgaggcctaccgagggtaacggggctgggaggttgggtctcgtagttatttagtagcgagtcggaaccgcaccacttcgacagacctcgcgaggggcagatcacntctcagacganaacttaccaagaacctacctttatcttacagatacgactacgccgtagagagccgaagccgtcgcttcgtactagttacgtgtcgngtagcgtcctacgtggtcctaggtccgaggccgtagggtcggttaccggacccggtcgggg

SEQ ID NO: 232400 - DNA, 637 bp, Homo sapiens
  misc_feature: GYAE6OF02F6OSF.5.27.C05.1.454.CMB.1.raw
  modified_base (309)..(309): a, c, t, g, unknown or other
  misc_feature (309)..(309): n is a, c, g, or t
  modified_base (482)..(482): a, c, t, g, unknown or other
  misc_feature (482)..(482): n is a, c, g, or t
  modified_base (575)..(575): a, c, t, g, unknown or other
  misc_feature (575)..(575): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgtgctattttaaaaggtgtccagtgtgaggtgcagttggtggagtcgtgggggaaccttggtccagccgtggggggtccctggacgactctcctgtgtagcctctgcgttccaccgtcagtagctaattacatgagcgtcgggtcccnccgaggcctaccgaggggttaacgggctgggtagtcgggtctacgtagtttaattagtagacgtagtacggaaccgcactaccgttcgacaggacctcgcggagggcagactacgacatctacagagaactatccaaataaccctacctttatcttacgaatactagaaaccngtacctaggtaacgagacccgggttaagacccgtacgggtaccttgtaacgtttacttaaccgtgaccggtaccgaaggttaacgtctacggnggtaccttacgtaccgaggtaccgttagggggttccgttacccggtaccccggtacgggggg

SEQ ID NO: 232401 - DNA, 700 bp, Homo sapiens
  misc_feature: GYAE6OF02GE9IY.5.27.C05.1.454.CMB.1.raw
  modified_base (276)..(276): a, c, t, g, unknown or other
  misc_feature (276)..(276): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtcgtgggggaaccttggtccagccgtgggggtccctgagactctctgtgtagcctctgtcgttcaccgtnagtagactaattacatgagtcgtcgggtccgccgaggtcctaccgaaggggtaacggggcgtgggtacggtggggttactcgtagtttatttagtagacgtagtacggaacgcacgtacttcgacgtaacgccgtccgcggacgggcaggtactcgaccattccctacgagacgtaacctaacgttaacccgaaagtaaaccccgtacccttttaagtcccgttaacgaacgttacgttaaccgaactacgtacccttaggaacggacgtaccggacggtacgttcccggtacgttccgttacgtttaacgttcgttacggtcggaccgtaacggtacggttccaaccggttcgggtacttcgggtaccccagggtccggttaacgggtttcccgggttaccccggacccccggttaacggggg

SEQ ID NO: 232402 - DNA, 673 bp, Homo sapiens
  misc_feature: GYAE6OF02ICVO6.5.27.C05.1.454.CMB.1.raw
  modified_base (417)..(417): a, c, t, g, unknown or other
  misc_feature (417)..(417): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtcgtgggggaaccttggtccagccgtggggggtccctggagactctcctgtagtcgcctctgccgttaccaccgtcagtagacaattacaatgagtcgtcggggtccgccaggcctaccggagggtaacgggtctgggaggtcggggtctacgtagtttagttacgagacgtagtacggaacccgcactacgttcgactacgacgtccggnggaacggggccaggtacttacacacttcaccagagaactaacgttaccaaacgtaacctaacctttactacttacgagtactacgaaacacgcccttagacggtaaccggaccggaacggaccgtccggtcttacggttacttaaccgtttagtacggtcggtacggtacggtaacgtaccggtacggtcggtccggtacgggttccacgggtgtaccggggtttacggttcccgggtacccccggttaccggggg

SEQ ID NO: 232403 - DNA, 754 bp, Homo sapiens
  misc_feature: GYAE6OF02I3YQ2.5.27.C05.1.454.CMB.1.raw
  modified_base (344)..(344): a, c, t, g, unknown or other
  misc_feature (344)..(344): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcttgggttttccttgttgctattttaaaaggtgtccagtgtgaggtgcagttggtggagtcgtgggggaaccttggtccagccgtggggggtccctgacgactctccgtgtgtacgcctctggtcgttccaccgtcagtagactaattacagtgagcgtcgggtccgccgacggcgttccggaagggtaacggggntgggaggttcgggtctactagtttattagtagacgtagtcggaaccgacactaccgtcgactaacggacctaccgggcggacggggcgagtacttacccacctacgtactaccctaagaacgtaactaacttaccaaaagtaaccttaacccctttaattacccttacgaacgttaagtacgtaaaaccgaccgtcccggttaagaacggacggtaaccccggtaacgggtacccgttaccgggaacctttacggttaccgtttaaacgttaccgttacgggttacgggtaaccgtaacgggttaccggtttaccgaacggttcgggtaccgttacccgggttaccgaacggtacccggttaaggggtttccccgggttttaccccgggacccccggggtaacccggggg

SEQ ID NO: 232404 - DNA, 720 bp, Homo sapiens
  misc_feature: GYAE6OF02JQRGQ.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagtcgttgggtttttccttggttgtcttaattttaaaaggtgtccagtgtgtaggtgctagttggtggagtcgtggggaaccttggtccagccgtgggggtccctgagactcgtcctgtgtagcctcgtgtccgttcaccgtctagtagactaattacatggagtcgtcgggtcccgtaccgacgggtcctacccggtaagggttaaccggggcggtagggtacggtcgggttcgtacgttaagtttaacgttttagtacggtacggtacggttaacggtaaccccgacgtaaccgtaccttcggaccgacgtaccgttccgggaccgggtacggggagtaccggtataccgaccgtacgtccaccgtaagaacgtaactaaccttacctaaacgtaacccttaaccgtttaactaccgttacgtaactaagtacaacgtacgtcgtacgaggaccgtacggtacgacgtcgtactcgttacgtacgttacgtcgtagtacgtacggtaacgtcgtacgtacggtccgtaggtcctacggtcgttacgggtcgtacccggtcccgggtaccggg

SEQ ID NO: 232405 - DNA, 925 bp, Homo sapiens
  misc_feature: GYAE6OF02G6G1H.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagttgggctgagtcgttcgggttttccttgttgtacttaagttttaaaaggtgtccgagtggtgaggtgctagtggtggagtcgtggggaacttggtaccgagccggtcgggggtccctgagtacctcgtcgtgtgtacgtcctcgtcgtccgttaccgaaccgttccgaaggtacgtaactaaagttactagtaccggaggtccggttcggggtcccgacccggtaacggtcccgtacccgggtaaacggggttaaagggggtccgtagggggtacggttggggttaccttacgtaaaggtttttaactttaagtacgggtaaccgtaaggttaaccgggaaaccccgtccgtaaacccgtaccgtttacggaacccgttaacggaacccggttccccggggacggggttaaaacggggggacccaaacggtttacgtttaaccccgtaaaccgtaaccgtttacccgacccggaaacggtaaaccgtaaaacccgtaaacccgtttaaacccggaaaaacccgtaaacccgtttaaaccccttttactttaccgttaaacccgtaaaggtaacgttaacggaacctaaccggacgttacggaaaccggtaccgggacccggtacgggtaacccgtccggtacgtttaccgtacggtttacctttaacgtggttacccgggacgtaacgggtaacgttacccgacggttaccggttccggtaaccgggtccgtaacggtccgggttaaccgggttcccggggtttaaccgccccccggggtaaccgggg

SEQ ID NO: 232406 - DNA, 530 bp, Homo sapiens
  misc_feature: GYAE6OF02GGF86.5.27.C05.1.454.CMB.1.raw
  modified_base (493)..(493): a, c, t, g, unknown or other
  misc_feature (493)..(493): n is a, c, g, or t
  modified_base (500)..(500): a, c, t, g, unknown or other
  misc_feature (500)..(500): n is a, c, g, or t
  modified_base (507)..(507): a, c, t, g, unknown or other
  misc_feature (507)..(507): n is a, c, g, or t
  modified_base (510)..(510): a, c, t, g, unknown or other
  misc_feature (510)..(510): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggtttccttgttgctattttaaaaggtgtccagtgtgaggtgcagttggtggagtcgtgggggaaccttggtccagcctgggggtccctgagactctcctgtgtagcctctgcgttcaccgtcagtagcaattacatgagctgggtccgcaggctccaggtaaggggctggaggtggggtctcagttattatagcgatggaccgcacacttcgcacgactccgcgaggggcagtacttcacctatcctcagacgaacaacttcaaacgaacctaccctttatccttacagatagaacacgctgagaggccgagacgtcggcttgctagtactgtgcgaggtnctagtgntggaccngcngggtcgttcgacccgtcggg

SEQ ID NO: 232407 - DNA, 611 bp, Homo sapiens
  misc_feature: GYAE6OF02G7BBB.5.27.C05.1.454.CMB.1.raw
  modified_base (276)..(276): a, c, t, g, unknown or other
  misc_feature (276)..(276): n is a, c, g, or t
  modified_base (304)..(304): a, c, t, g, unknown or other
  misc_feature (304)..(304): n is a, c, g, or t
  modified_base (337)..(337): a, c, t, g, unknown or other
  misc_feature (337)..(337): n is a, c, g, or t
  modified_base (400)..(400): a, c, t, g, unknown or other
  misc_feature (400)..(400): n is a, c, g, or t
  modified_base (529)..(529): a, c, t, g, unknown or other
  misc_feature (529)..(529): n is a, c, g, or t
tcagatcagacacgcacgaccggtgctcgatttagacgcgatcgaagggtttggggctgggagaggagcccagcactgggattccgagtgtttccattcagtgatctgcactgaacacagaggactcgccatggagtttgggctgagctgggttttccttgttgctattttaaaaggtgtccagtgtgaggtgcagttggtggagtcgtgggggaaccttggtccagccgtggggggtccctgagactctcctgtgtagcctctgcgttcaccgtnagtacgcaattacatgagcgtgggtccncaggctccgagggtaacgggctggagtggtctnagttattatagcagtacggaccgcactacttcgcacgtactccgcggagggcagtactcaccntcacagacgactaacttaccaaacgtaacccttaccctttatccttacgagtaatacgaaaccgtccgtaccgtagaacggaccgtacccggaggtaaccgtccgtacttcgtaacctaagtttaccgnggttcgacggttagtcgtaccgacgtcggtccgttaaggccctaggccgttacgggttccggttaccgaccccggtacgggg

SEQ ID NO: 232408 - DNA, 595 bp, Homo sapiens
  misc_feature: GYAE6OF02FXKTQ.5.27.C05.1.454.CMB.1.raw
  modified_base (481)..(481): a, c, t, g, unknown or other
  misc_feature (481)..(481): n is a, c, g, or t
  modified_base (495)..(495): a, c, t, g, unknown or other
  misc_feature (495)..(495): n is a, c, g, or t
  modified_base (522)..(522): a, c, t, g, unknown or other
  misc_feature (522)..(522): n is a, c, g, or t
  modified_base (524)..(524): a, c, t, g, unknown or other
  misc_feature (524)..(524): n is a, c, g, or t
  modified_base (534)..(534): a, c, t, g, unknown or other
  misc_feature (534)..(534): n is a, c, g, or t
  modified_base (546)..(546): a, c, t, g, unknown or other
  misc_feature (546)..(546): n is a, c, g, or t
  modified_base (565)..(565): a, c, t, g, unknown or other
  misc_feature (565)..(565): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctatttaaaaggtgtccagtgtgaggtgcagttggtggagtcgtgggggaaccttggtccagccgtgggggtccctgagactctcctgtgtagcctctgcgttcaccgtcagtagctaattacatgagcgtacgggtccgccaggcctaccgaggggtaaggggctagggaggttgggtctacgtagtttattagtagcgtagtacggaacccgcacctacttcgacacgaccgtccggacggaggggacaggtacttaccactactccgtaccaagacactaaacttcccaaagtaaccctacctttatccttanaacgtatacgaacncgtcctaggagacgccggaagtctcgntntctaagttcngtgcgtagtacnctacgtggaccttggaccnggtcgcggttccggtcccgacccggtcggg

SEQ ID NO: 232409 - DNA, 710 bp, Homo sapiens
  misc_feature: GYAE6OF02FIW4G.5.27.C05.1.454.CMB.1.raw
  modified_base (419)..(419): a, c, t, g, unknown or other
  misc_feature (419)..(419): n is a, c, g, or t
tcagatcagacacgcacgaccggtgctcgatttagacgcgatcgaagggtttggggctgggagaggagcccagcactgggattccgaggtgtttccattcagtgatctgcactgacacagaggactcgccatggagttgggctgagctgggttttccttgttgctaattttaaaaggtgtccagtgtgaggtgcaggttggtggagtcgtgggggaaccttgggtccaggccgttggggggtcccctggacgtacctccgtccttggttcgtacggccttcgtgtccgttccacccggttcgagtagctaaattaccatggagccgtgggttcccgccgaggcctacccgtaagggtaacggggtccgtagggaggttcgggtctcgtaaggttatttagtacgcgtagtggaacccgnacctacgttcgaccgacgtaccgtccggcggacggggacgacgtaacttccacccgtattcccgtaccgaacggaacgtaacctaaacgttacccaaaacgtaaaccctaacccgtttaacttccgttacaacgtaataccgtaacgacgtaccgtgaacgacggccgaacggtaccgtcggcttcgtacgttacgttaccgtgttcgacggagtaacgttcgaccgtcggttcgtaccggtccgacggtccggtagggtttcccggttaccggaccccgggtaaccgggg

SEQ ID NO: 232410 - DNA, 844 bp, Homo sapiens
  misc_feature: GYAE6OF02ITON9.5.27.C05.1.454.CMB.1.raw
  modified_base (337)..(337): a, c, t, g, unknown or other
  misc_feature (337)..(337): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggtttccttgttgtcttattttaaaagtgtccagtgtgaggtgctaggttggtggtagtcggtggggtaaccttggtccgacgtccggtcgggggtccctggacgactcctccgtgtcgtacgtccctctcgtcgttccgaccgtacgagtacgacctaattacagtagacgtccgtcgggtcccncgacggtcctaccggaaggggtaacgggcgtagggtaggttcgggtcttacgtaagttttaacttagtacggtacgaagttacggaaaccgcctaaccgtaacccgtttaccgacgtaaccggtaccgtaccccgggacgggaaacggggtactaagttaccgtttaaccgaacccgtaaccgtaccgtaaccgaaacggaaacgtaaaaccgtaaacctttaaaacccgaaaaccgtaaaccctttaaaccccttttaacgtttaacccttaaacccgaaaggtaacttaaacggaaaacccgtacccggtaccgtaaacggtaaacgggaacgggtaccccgggtaaacggtacccggtacggttacgttttaacgtaccgttttaaacgttcgtacggtagggtacccggtaagtaaccggtccgtaacggttcggtaccgttacggtaccgacgggtaccggtacggggttacccggttcccggaaccccgggttaccggggg

SEQ ID NO: 232411 - DNA, 663 bp, Homo sapiens
  misc_feature: GYAE6OF02I26NR.5.27.C05.1.454.CMB.1.raw
  modified_base (188)..(188): a, c, t, g, unknown or other
  misc_feature (188)..(188): n is a, c, g, or t
  modified_base (260)..(260): a, c, t, g, unknown or other
  misc_feature (260)..(260): n is a, c, g, or t
  modified_base (274)..(274): a, c, t, g, unknown or other
  misc_feature (274)..(274): n is a, c, g, or t
  modified_base (391)..(391): a, c, t, g, unknown or other
  misc_feature (391)..(391): n is a, c, g, or t
  modified_base (590)..(590): a, c, t, g, unknown or other
  misc_feature (590)..(590): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcgtggtttctgtagctatttaaaggtgtcagtgtgaggtncaggttggtggagtccgtgggggaacctttggtccaggccgtgggggtccctgagactctcctggtgagccntgccgttcaccgtnagtacgctaaattacaatgagcgtgggtaccgccaggctaccgaggggtaacggggctagggacgttaggggtctacgtaaggtttaatttaattaggacgtaagttcggaaaccgngtaaccaactttccggacaacgaaccgtccggacggaacgggggcacgaactttaccaacccaacttccgaccgaaggaaacgaactaaaccttaccgaaaacgtaaaccttaaccctttactctttacaacgtactaacgaactacgctagaaggacgaccgaagtacgtcgacgttcggtactacttactggtacgngaacgtacgtactaacggtggtacgtacgggtaccaggccgtaggggtccgggttcccgtaccccggtcgggg

SEQ ID NO: 232412 - DNA, 638 bp, Homo sapiens
  misc_feature: GYAE6OF02G11PX.5.27.C05.1.454.CMB.1.raw
  modified_base (240)..(240): a, c, t, g, unknown or other
  misc_feature (240)..(240): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctatttaaagtgtccagtgtgaggtgcagttggtggagtcgtgggggaaccttggtccagccgtggggggtcccngagactctcctgtgtagcctctgcgttcaccgtcagtagacaattacatgagcgtcgggtccgcaggcctaccgagggtaacggggctgggagtgggtctcgtagtttatttagagcgagtcggaacccgctaacaccttcgacacgaccgtccggcggacggggcaggtacttccacctactcctaccagaacgactaacttaccaaacgtaaccctaccctttatccttacgagtactacgaaccacgtccgtagaacggacggaccggaaggtaccgtccgggcttacgttacttacttacgtgtcgacggtagtacggttcacggtcggtcgttaccgggtacccgaggtccggtacggggttccggtttaccccggaccccgggtaccggggg

SEQ ID NO: 232413 - DNA, 632 bp, Homo sapiens
  misc_feature: GYAE6OF02JNM0J.5.27.C05.1.454.CMB.1.raw
  modified_base (292)..(292): a, c, t, g, unknown or other
  misc_feature (292)..(292): n is a, c, g, or t
  modified_base (358)..(358): a, c, t, g, unknown or other
  misc_feature (358)..(358): n is a, c, g, or t
  modified_base (495)..(495): a, c, t, g, unknown or other
  misc_feature (495)..(495): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctggttttccttgttgctatttaaaggtgtccagtgtgaggtgcagttggtggagtcgtgggggaaccttggtccagccgtgggggtccctgacgactctcctgtgtacgcctctgcgttcaccgtcgagtagtactaattacntgagtcgtggtcccgcgacgcctccgagggtagggcgtggaggtggtctcgtagtttagtttaacnggtcgagtcggtaccgctacaccgttccgctacggccgtaccggcgggtaacggggcaagtactttccgaccgtactccgaccaggtacacgtaacttccaagaaccctacctttactcttacagactacgaactcnccgtgaacgtcgacggtacgacgttacgtcgttctaccgttaattccgttgacggtcggtactacggttccaggttccggtcttaccgggaccgtagtccggtaagggtttcccggttacccgtacccggacggggg

SEQ ID NO: 232414 - DNA, 613 bp, Homo sapiens
  misc_feature: GYAE6OF02GDRYZ.5.27.C05.1.454.CMB.1.raw
  modified_base (307)..(307): a, c, t, g, unknown or other
  misc_feature (307)..(307): n is a, c, g, or t
  modified_base (541)..(541): a, c, t, g, unknown or other
  misc_feature (541)..(541): n is a, c, g, or t
tcagatcagacacgcacgaccggtgctcgatttagacgcgatcgaagggtttgggggctgggagaggagcccagcactgggattccgaggtgtttccattcagtgatctgcactgaacacagaggactcgccatggagtttgggctgagctgggttttccttgttgctattttaaaaggtgtccagtgtgaggtgctagttggtggagtcgtggggaaccttggtccagccgtgggggtccctgagacctctcctgtgtacgcctcgtgcgttcaccgtcagtagctaatacatgagcgtgggtccnccgaggctaccgaggtaagggcgtggaggtcgggtctcgtagtttatttagagcgtagtcggaaccgtcgactaccgttcgacagtacctaccggacgggacgggcagtacttccaccatcctacgaagacgtacctaacgttccaaacgtaaccctaccctttatccttacagtaactacgaactacgtccgtagacgacggacccgagaccgtcgtcgtactcttagttacncggtgacgaggtactacgtccgtggaccttcggcctagccggttacggtcggttacccgaccccggtcgggg

SEQ ID NO: 232415 - DNA, 707 bp, Homo sapiens
  misc_feature: GYAE6OF02IP0DI.5.27.C05.1.454.CMB.1.raw
  modified_base (310)..(310): a, c, t, g, unknown or other
  misc_feature (310)..(310): n is a, c, g, or t
  modified_base (386)..(386): a, c, t, g, unknown or other
  misc_feature (386)..(386): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcttgggttttccttgttgctaattttaaaaggtgtccagtgtgaggtgcagttggtggagtcgtgggggaaccttggtccagccgtgggggtccctgagactcctctgtgtagcctctgcgttcaccgtcagtagactaattacatgagtcgtcgggtcccnccgacggcctccggaaggggtacggggcgtgggtaggtgggtctacgtagtttactttagagtcgagtcggaaccncacacgttcacacgtaccgtccgcggagggacagtacttccacctattccaacgagtaacgaactaacttaccgaaacgtaacccttacccttttagtaccttacgaacgtaacgtcggtaactcgacccgtaggaaacgaccgggaccggaacggtaccgttcccgggactttaggtaaccctttaagtttacccgttagggtccggtaacgggtaccgtaacgggttacccgaacggttccggggtactttacccggggtacctaaggggtcccggtttagggggttacccgggttacccgaacggttaccccgggggg

SEQ ID NO: 232416 - DNA, 666 bp, Homo sapiens
  misc_feature: GYAE6OF02IUYPL.5.27.C05.1.454.CMB.1.raw
  modified_base (608)..(608): a, c, t, g, unknown or other
  misc_feature (608)..(608): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcgttgggttttccttggttgcttaagttttaaaaggtgtcctagtgtgaggtgcgtagttggtggtagtcgtaggggtaaccttggtcagccggtgggggtccctggagtacctctccgtgtgtacgtcctgtcgtcgtccaccgtgagtagctaatacagtgacgcgtcggtccgcgaggctaccgaggtaagggctaggtaggtggtctacgtagttattagtagacgtacgtacggaaccacgaacgtaccgtacgacgaacgtactccgggaggtagggacagtactccgaacctagtccacgaaaggctaaacctaattacccaaagtaacccttaaccgtttactcgttaaccgaagtacgtaacgaaacctcggtaacgttagaaaccggtaccgaccggacgtacccgtcgtacgtagttacctagttacgtgcggtacgacgtgtacccgngtccggtacctagggaccgtaggtccgtagggtttccggtcccggtaaccggtcgggg

SEQ ID NO: 232417 - DNA, 680 bp, Homo sapiens
  misc_feature: GYAE6OF02I5R0A.5.27.C05.1.454.CMB.1.raw
  modified_base (362)..(362): a, c, t, g, unknown or other
  misc_feature (362)..(362): n is a, c, g, or t
  modified_base (431)..(431): a, c, t, g, unknown or other
  misc_feature (431)..(431): n is a, c, g, or t
tcagatcagacacgcacgaccggtgctcgatttagacgcgatcgaagggtttggggctgggagaggagcccagcactgggattccgaggtgtttccattcagcgatctgcactgaacacagaggactcgccatggagtttgggctgagctgggtttccttgttgctattttaaaaggtgtccagtgtgaggtgcagttggtggagtctgggggaaccttggtccaggccgtcgggggtccctgagactctcctgtgtacgcctctgccgttcaccgtcagtagcaattacatgagcgtgggtccgccgaggcctccgagggtaacggggctagggaggttcgggtactctagtttagtttanaggacgtagtcggaaccgcactaacgttcgacagtccgtccgacgggaggggaccaggtactcgacccngttaccgtacaaggacaccgtaattacccaaagtaccccttaaccctttagtccttacgaagttctaacgacgtcgaccgttagacgaacggaccgggagtacccgttcgacgtttccggttacttaacgtttacgttggaccgtacgggtaagtaccggttccgaacgggttcggtcggtttccggacgtaccgggtaccggttaggggtttaccccggttaccccgggaccccggttaaccgggggg

SEQ ID NO: 232418 - DNA, 616 bp, Homo sapiens
  misc_feature: GYAE6OF02HHVTT.5.27.C05.1.454.CMB.1.raw
  modified_base (358)..(358): a, c, t, g, unknown or other
  misc_feature (358)..(358): n is a, c, g, or t
  modified_base (368)..(368): a, c, t, g, unknown or other
  misc_feature (368)..(368): n is a, c, g, or t
  modified_base (391)..(391): a, c, t, g, unknown or other
  misc_feature (391)..(391): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtcgtgggggaccttggtccagccgtgggggtccctgagactctcctgtgtagcctctgcgttccaccgtcagtagcaattacatgagcgtgggtcccgccgaggcctcgagggtaacgggctgggaggtgggtctcgtagtttattagtagngatggaaccncacacttcgacacgacctccggnggaggggcagtacttcgaccatcctaccgagagactaacttaccaaacgtacctaccctttactcttacgacgatacgaacgcgtaccgtagacgacgaccggaaggtcccgtcggtacttgtacctatttacgtagtcgaccggtagtcgttacgtcgtacgggtccgttacgggtcccaggtccggtcgggttacggttaccccggtaccccgggtccggggg

SEQ ID NO: 232419 - DNA, 667 bp, Homo sapiens
  misc_feature: GYAE6OF02I3FEI.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttcctgttgctattttaaaaggtgtccagtgtgaggtgcagttggtggagtctgggggaaccttggtccagccgtggggggtccctgagactctcctgtgtagcctctgcgttcaccgtcagtagcaattacatgagcgtcgggtcccgccgaggcctccggagggtaaggggcgtgggaggtcggggtctacgtagttttatttaagtaggcgtagtacggaaccgcctactacttcgacgacgacctccggcggagggacgagtacttcaacctatcaccgaagacgaactaacttaccaaagtaaccctacccttttagtaccttacaacgtactacgaacgcgtaccgtagaacgacggaccggtaggaccttcgggtcttacggttcttaacgtttacgtggttacgacggtacgttacggtcctaacgggtcggtaccgtttcggacccgagggttaccggtacggggtttaccgggttccccggacccccgggttacccgggggg

SEQ ID NO: 232420 - DNA, 847 bp, Homo sapiens
  misc_feature: GYAE6OF02HW0G4.5.27.C05.1.454.CMB.1.raw
  modified_base (286)..(286): a, c, t, g, unknown or other
  misc_feature (286)..(286): n is a, c, g, or t
  modified_base (323)..(323): a, c, t, g, unknown or other
  misc_feature (323)..(323): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcgtggttttccttgttgtcttagttttaaaaggtgtcctagtgtgaggtgctagttggtggagtcgtggggaaccttggtccagccgtcgggggtccctgacgacctctcctgtcgtagcctcgtgccgttcaccgtnagtacgtactaattaccagtcgagtcgtcgggtaccnccgacggtcctaccggtaaggggtaacgggcctgggtaggttcgggttactacgttaagtttatttaaggtacgtacgtaacgtaccggtacccgtaccgaacctaccgttccgacgtaaccggtaccgtaccggaccggggtacggggtaccaacggttaccttacccgaaccgttactcccgtaaccgaaacggtaacgtacctaaacgtttacccaaaacgttaacccttaccgttttaatccgttaaccaaggtaaccttacgaaaaccgtccggttaacccgtggaacccgggtaccgtaaccgggtaaccgtaccgttcccggtaatttaccggttaaaccggttaaacttttcggggaacccggtagggtaccccggttaaacgggtacgggtttacccctaagggttacccggggtacctttaacccggggtaaccccgttacggggttaacccggtttaccccggggggggtttacttttacccccccggggaaaccccgggtttcccggggggg

SEQ ID NO: 232421 - DNA, 644 bp, Homo sapiens
  misc_feature: GYAE6OF02IXDBX.5.27.C05.1.454.CMB.1.raw
  modified_base (379)..(379): a, c, t, g, unknown or other
  misc_feature (379)..(379): n is a, c, g, or t
  modified_base (581)..(581): a, c, t, g, unknown or other
  misc_feature (581)..(581): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggtttccttgttgctattttaaaaggtgtccagtgtgaggtgcgagttggtggagtcgtggggaaccttggtccagccgtgggggtccctgagactctcctgtgtagcctctgcgttcaccgtcagtagcaattacatgagcgtcggtccgccgaggtcctccgagggtaacggggtctgggtaggtcgggtcttcgtagtttatttagagtcgtaagtacggaaccncgacctacgttccgactaaggacctccggacggacggggcaggtactttaccgaccgtacgttcctcccgaagtacgaaccgtactttaccgaaacgtaacccttaccctttacgttccttacgagtactaagaacgtacgccgttagaacggagaccggagtaccgtcggatggttactagttactcgtagtcgaacggtntccgaaggtcgccgttggtaccgaggtaccgacgggtttcggttcccgaacccggttccgggg

SEQ ID NO: 232422 - DNA, 649 bp, Homo sapiens
  misc_feature: GYAE6OF02GS7OR.5.27.C05.1.454.CMB.1.raw
  modified_base (391)..(391): a, c, t, g, unknown or other
  misc_feature (391)..(391): n is a, c, g, or t
  modified_base (395)..(395): a, c, t, g, unknown or other
  misc_feature (395)..(395): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggtttttccttgttgctattttaaaaggtgtccagtgtgaggtgcagttggtggagtcgtgggggaaccttggtccaggccgtcgggggtccctgacgactctcctgtcgtacgcctctgccgttcaccgtcagtacgactaacttacatgacgtcgtggggtcccgccgacggcctccgaggggtaaggggcgtgggtaggtgggttcctcgtagtttatttatagcgagtcggaaccncacncgttcgacacgactccggcggacggggcacggacttccacctactcctaccagaacgacgtaaacttaccaaacgtaaccttaccctttattccttacgaagtacacgaaccgtagacccgtgaacggacgaccggaacgtccgtacggtccttagttactttaagttactcggtcgacggtagtacgtcgtacgtcggtccgtacgggtccgacggtcgtagggtttccggttaccggtccccggtacggggg

SEQ ID NO: 232423 - DNA, 847 bp, Homo sapiens
  misc_feature: GYAE6OF02GIV8P.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtcgtgggggaaccttggtccagccgtggggggtccctgagactctcctgtgtagcctctgcgttcaccgtcagtagcaattacattgagtcgtcgggtcccgccgaggcctaccgaaggggtaacggggcgtgggaggtgggtctacgtaggtttatttagtaggcgtagtcggaaccgctaactaccgttcgacgacgtaccgtcccggacgggtacggggacgtaaggtactttaccgaaccctacttcccgtaccgaaaggaacgtaaaccctaaactttaacccgaaaacgttaaacccttaaccccgtttttaactccgttttaacgaacgttaacttaaccgggtaaaccaccggtaccgttaacgggaaccgggtaaaccgggtaccccgggtaaacggggtaccccggtttacccgggggttacctttaccgggtttaacccgtttaaacgtttacccggttacggggttacgggttaaccggggtaaaccgggttacgggttaccccggtaaccgggttcggggttaccccggtttaccgggggtaccccgtagggttaccccggggttaacgggggtttccccgggggtttaaccccccgggaaccccccgggtttaaccccggggggggg

SEQ ID NO: 232424 - DNA, 760 bp, Homo sapiens
  misc_feature: GYAE6OF02G18RW.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtcgtgggggaaccttggtccagccgtgggggtccctgagactctcctgtgtacgcctctgcgttcaccgtcagtagcaattacatgagctgggtccgcgaggctccgagggtaaggggctgggagtcgggtctcgtagtttatttaagagcgtagtggaacccgcacacgttcgcacgacctccggcggacgggggcaaggtacttaccacctagtacccgtccgaaggaacgtaaccgtaaactttaccgaaaacgtaaaccctaacccctttttaacgttaccctttaaccgtaaaggtaacctttaacgggaaaaccctacggtacccccgttagggaaaccgggtaaccgggaccccgggtaaacgggtaacccggttaccgggttacgttcgggttaaccttttaaagttacccgtttagggtccggtacgggtaaacggtccggaccgttaaccgtggggtaccggttcccggggttaaccgaacgggttaccggtacggggttttacccggggtttcccccgggaacccccgggttacccggggggg

SEQ ID NO: 232425 - DNA, 689 bp, Homo sapiens
  misc_feature: GYAE6OF02HA1DY.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttcctgttgctattttaaaaggtgtccagtgtgaggtgcgagttggtggagttcgtgggggaaccttggtccagccgtggggggtccctgagactctcctgtgtagcctctgccgttcaccgtcagtagactaattacatgagcgtcgggtcccgacacggctccgaagggtaagggcgtggacggtcgggtctcgtagtttattagagacgtagtacggtaaccgcaactacgttccgactacggtaccgtcccgggacggtaaggggcgaacgtacgtttacccaacctacgttaccgtaccgaagtaacgtaaacttaaacgttaacccaaacgtaaccctaaacccttttactaccgtttacaaacggtacttaacgaaaccgtagtacccgttaggaacgtaccggaccggtaaccggacctccgggtacctacgtttaccgtaagtttaccgtggtagaccggtagtcgtcctacgtcggtacgtcggtcacgtcggtacgggtttccggtacccggcccggtacggg

SEQ ID NO: 232426 - DNA, 655 bp, Homo sapiens
  misc_feature: GYAE6OF02HDU1R.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcgttggttttccttgttgcttaattttaaaaggtgtccagtgtgaggtgctagttggtggagtcgtgggggaaccttggtccgagccggtcgggggtccctgacgacctctccgtgtgtacgccttcgtcgtccgttaccgaccgtcgagtacgactaaattacataggacgtcgtcgggtcccgccgacggtccgtaccggaagggtaacgggcgtagggaggttcgggtctcgtagtttatttagtacggcgtagtacggaacccgacgtactacgttcgacgtacgaccgtccggacggaggggcacgtacttccactctacctcgaagacgtaactaactaccgaacgtaaccttacccttatcttacaatactacgacacaccgtagacgacgcggaagtaccgtgccttcgtactacgttacgtgtacgagtacgtcgtctacggtcgacgttcggtaccgtaggtccggttaggtccggttacccgaccgggtcccgggg

SEQ ID NO: 232427 - DNA, 678 bp, Homo sapiens
  misc_feature: GYAE6OF02F03UT.5.27.C05.1.454.CMB.1.raw
  modified_base (522)..(522): a, c, t, g, unknown or other
  misc_feature (522)..(522): n is a, c, g, or t
tcagatcagacacgcacgaccggtgctcgatttagacgcgatcgaagggtttgggactgggagaggagcccagcactgggattccgagtgtttccattcagtgatctgcactgaacacagaggactcgccatggagtttggctgagctggtttcctgttgctagtttaaagtgtccagtcgtgaggtgcagttggtggagtcgtgggggaaccttggccagccgtgggggtccctgagacctctctgtgtacgcctctgccttcaccgtcagttagctaagttacagtgagccgttgggtcccacgaggccttacgaggtaaggctggagtgggtctcgtaggttactttagacgcgtaagttaccggaacccgtcaaccgtacgtttacggacctacggtaacccgttccggacggtacgggggtacctaacggtactttccggaaccttagtccctacgtaacggacgtaactaaccgttcccgtaaaacggtacccttaacccgtttagtccccgttanacggtaactttacgaaaccgttcgaccgtaggtaccgacgtacggacgacgttccgatccgtagtacgttacgtaggtcgagaggtccttacgacgtcggtacgtcggtaccgtcggaacggttccggtacggtttacccggccggttaacccggg

SEQ ID NO: 232428 - DNA, 752 bp, Homo sapiens
  misc_feature: GYAE6OF02GNRF2.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtcgtgggggaaccttggtccagccgtggggggtccctgagactctcctgtgtagcctctgcgttcaccgtcagtacgcaattacatgagcgtcgggtcccgccgaggctccgagggtaaggggctgggagtgggtctcagtttattagtagcgatcggaaccgcactacttcgcagacctccggcggacggggcaaggtcttacaccgtatcctaccgaagacgtaactaaacttacccgaaacgtaaaccccttaaccccttttaacttaccgttttacgaacgtacgtaacgaaaccctacggtaccccttagggtaaacgaccgggtaccccggtaacggggttaaccggttcccgggaccgtttcggttaacccgtttaacgttttaacccgtgggttacggaacccgggttaaggttaacggttacccgtaaccggtttcggggtacccgttttcgggggtaacccaaccgggttaccgggttaacgggggttttacccgggtttaccccccgggaccccccggggtttacccgggggggg

SEQ ID NO: 232429 - DNA, 701 bp, Homo sapiens
  misc_feature: GYAE6OF02HE80E.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtcgtgggggaaccttggtccaggccgtggggggtccctgagactctcctgtgtagcctctgtcgttcaccgtcagtacgctaattacatgagccgttggtcccgaccgaggcctccgagggtaacggggctgggacgttggggtcctcgtagttttatttagaggcgtagtacggaaccgcacctacgttccgacgacgtaccgttccggacgggacggggacacggtactttaccgaccctagttaccctacgtaacgacgtaacctaaactttacccgaaacgtaaacccttaccccgttttaactcctttacaggtactacggaaactcgacccgtggaacgaccggccggaacggtaccgtaccggtcgttcgttactttagttacgtgttaccgggacgtagggtagttccgtaccggtgggtcccttcggtacccgtaagggcccgttagggggtttccggttaccccgggaccccgggttaccggggg

SEQ ID NO: 232430 - DNA, 751 bp, Homo sapiens
  misc_feature: GYAE6OF02IR49N.5.27.C05.1.454.CMB.1.raw
  modified_base (293)..(293): a, c, t, g, unknown or other
  misc_feature (293)..(293): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcttgggttttccttgttgacttattttaaaaggtgtccagtgtgtaggtgctaggttggtggagttcgtgggggaaccttgggtaccaggccgtggggggtccctgacgtactctccgtgtgtacgcctctgccgttcaccgtcngtagctaattacagtgagcgtgggtccaccgaggcctcgaagggtaaggcgtggacggttagggtcctacgtagtttaatttagtaacggcgtaacgtacggaacccgacaccgtaccgttcggacgacggtctaccgggacgggacggggtaccaacggtactttaccaaccgtacgttccgtaccgaacggaaccgtaactaaacgttaaccgtaaaaccggaacccttaacccgttttacttccgtttaacgaactaacgtaaccggaaacctccgggaacccttacggaaacggaccggtaaccgggacgtacccggttaccggtccgttacgttaacgttaagttacccgtttgtacggacggtaggtacgttacctaaggtccggtacgttcggttaccgaacgggtccgtaaggggtttcccggttacccggtaccccgggttacccgggg

SEQ ID NO: 232431 - DNA, 585 bp, Homo sapiens
  misc_feature: GYAE6OF02FLPL2.5.27.C05.1.454.CMB.1.raw
  modified_base (362)..(362): a, c, t, g, unknown or other
  misc_feature (362)..(362): n is a, c, g, or t
  modified_base (376)..(376): a, c, t, g, unknown or other
  misc_feature (376)..(376): n is a, c, g, or t
  modified_base (421)..(421): a, c, t, g, unknown or other
  misc_feature (421)..(421): n is a, c, g, or t
  modified_base (551)..(551): a, c, t, g, unknown or other
  misc_feature (551)..(551): n is a, c, g, or t
tcagatcagacacgcacgaccggtgctcgatttagacgcgatcgaagggtttgggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtcgtgggggaaccttggtccagccgtggggggtccctggagactctcctgtgtagcctctgcgttcaccgtcagtagactaaattacatgagtcgtggggtcccgcaggctccgaagggtaaggggctgggaggtgggtctcgtaggttatttanagcgaatggaaccnctacacttcgacacgactccgcgtaggggcagacttcaacactcncagacactatacaacgaacctaccttatcttcatatacaacagccctagacgtaacgccgaacgggtacctcggtctcgttacttacgttacgtgtcgacgaggtacgtcacgtggtaccgtggtaccgngtccgacgggttcggttaccgccccggtaacggg

SEQ ID NO: 232432 - DNA, 692 bp, Homo sapiens
  misc_feature: GYAE6OF02G4C1X.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttcctgttgctattttaaaaggtgtccagtgtgaggtgcagttggtggagtcgtgggggaaccttggtccagccgtgggggtccctgagactctcctgtgtagcctctgcgttcaccgtcagtagctaattacagtgagcgtcgggtccgccgacggcctaccgagggtaacggggctgggaggtcgggtctacgtagtttattagtagcgtagtacggaaccgcactacgttcgacgtagaccgtccgacggaggggcaagtacttccgaacctactccgtacccgaagaacgtaacctaacgttacccaaaggtaaaccctaccccttttataccgtttacaagttaactacgaaacacgtacccgtagacggtaacgcccggaagggtaccgtccggtacttcgtaccttaagttaccgtaggtcgtacggtaggtaaccggttacctaccggttgggtacccgttgggtacccgaacgggttacccggtagggtttacccgggttaccccggtcccccgggttaaccgggggg

SEQ ID NO: 232433 - DNA, 775 bp, Homo sapiens
  misc_feature: GYAE6OF02GON36.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccaagtggagtttgggctgagctgggtcttccttgttgcttaagtttaaaaggtgtccagtgtgaggtgcgtaggttggtggagtcggtaggggtaaccttggtccgagtccggtcgggggtcccctggacgtacctcgtccgtgtcgtacgcctcgtcgtcttcgaccgtctagtagactaacttacatggacgcgtcggaccgccgtacggccgtaccggaagggtaacgggcgtaggtaggtcggtacgttagtaagtttagttaacgtagacggtaagtacggaaccgactaaccgtaccgttacgacgaacgtaccgtacccggacggacgggccgaagtaccttaccgaacctacgtccctaacgaaggtaaacgtaacttaaaccgtaaacctaaaacgtaaacccttaacccgttttaactaccgttaacgaacgtaacgtaaccgtaaaccgtacgtaacccgtaggtaaacccgtcgggtaaccccggaaggtacccgttacggtacttaccggttaactttaacgttaccgtgggtaccggtaccggtaaggtacctaacccggtagttccggtaccgttccggtacgtaaccggtcggtaaccgggtttcccgggtacccggtaacccccgggg

SEQ ID NO: 232434 - DNA, 648 bp, Homo sapiens
  misc_feature: GYAE6OF02H3S1Z.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtcgtgggggaaccttggtccagcctggggggtccctgagactctccgtgtgtagcctctgcgttcaccgtcaaggtagcaattacatgagcgttcgggtccgccgaggcctccgaaggggtaaggggctagggaggtggggtctacgtagtttatttaagtacggtagacgtaggaacccgcaactaccttcgcagtaccgtccgcggaggggcaagtacttaccaccactctaccagaacgactaaataccaaacgaacctaccctttaatccttacgacgaatcgaacacggccctaggagaacgacccggaaggtaccgtaccggtctacgttactaacgtttacgttgtacgtacggagtacgtaccgtaaccggtggtaccgtcgggtaccctaggacccgtacggggttcggttccccggaccccgtaccgggggg

SEQ ID NO: 232435 - DNA, 775 bp, Homo sapiens
  misc_feature: GYAE6OF02FZQI0.5.27.C05.1.454.CMB.1.raw
  modified_base (184)..(184): a, c, t, g, unknown or other
  misc_feature (184)..(184): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagtcttgggttttccttgttgtcttattttaaaaggtntccagtgtgaggtgctaggttggtggagtcggtgggggtaaccttggtccacggccggttcggggggtccctggacgtacctccgtccgtgtagtacgtcctcgtcgtcgttccaccgtcagtagactaaattacatgacgtcggtcgggtcccgccgtaggcctaccggtaaggggtaacgggcgtgggacgtcgggtctacgttaagtttatttaagtagtcgaagtaccggaaacccgctaaccgtaccgttaccgacgaccggtaccgtaccgggtacgggaacggggtacctaacggtaccttacccgaccttaccgtacccgtaaccgaacgtaaacggtaaccttaaaccgttaacccgaaaacgttaacccctttaaccgttttaccttaccgtttacaagttacgtaacgtaaaccgtcgaccgttacgaaccggaacggtaccccgggtaacgtaccggttccggtaccttcggttaaaccgttcgttaaccgtggtacggtacgtaggtaccgtacgtccggtcggtccgtccggtaccgaggtccggtacggttccggttaacccggcccggtcccggg

SEQ ID NO: 232436 - DNA, 773 bp, Homo sapiens
  misc_feature: GYAE6OF02F0BGN.5.27.C05.1.454.CMB.1.raw
tcagatcagacacgcacgaccggtgctcgatttagacgcgatcgaaggggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtcgtgggggaaccttggtccaggtccgtgggggtccctgacgtactctccgtgtcgtacgcctcgtcgcgttcaccgtcagtacgcaatacatgagtcgtggtccgcaggctcgaggtacgggctggagtgggtctacgtagtttaacttagtacgcggtacgtacggaacccgtacaactaccgtttacgccgtaacgaccgtacccggcgggaacggggtaccgtaaggtacttccgaccgtaactccgtaccgagtaacgaactaacgttaccaaacgtaaacctacccgtttattaccgttaaccgaacgtaacgttaccgaaacgtccgtaaccttaacggttaacggaaccggtacccgggtaaacggaaccggtttacccgggaccgtttacggtaacccgtttaacgtttaaccggttcgggtaccggttaccggtaacgggttaacggtaccttaacccgggttgggtaccctttaccggggttaaccgtacgggttaccccggtaacggggttttcccggggttaacccccggtaccccggggttaacccgggggg

SEQ ID NO: 232437 - DNA, 830 bp, Homo sapiens
  misc_feature: GYAE6OF02G0EC3.5.27.C05.1.454.CMB.1.raw
  modified_base (196)..(196): a, c, t, g, unknown or other
  misc_feature (196)..(196): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagttgggctgagctgggttttccttgttgcttaattttaaaaggtgtccagtgtgaggtgntagttggtggagtcgtagggggaaccttggtccagccgtgggggtccctgagactctccgtgtgtacgcctctgcgttcaccgtcagtacgactaattacatgagtcgtcgggtcccgcgacggtcctaccgtaaggggtaacggggctagggtacggttcgggtactacgttaagtttaatttaacgtaggtacgtagtacggaaacccgcaactaccttccgacaacgtaccgtccggacgggtagggacctaggtaccttacccgaaccgtactttacccgtaacccgaaaggtaaccgtaaaacccgttaaacgttaaaccccgaaaccggtaaaaccccttttaccccgttttaacgttaccctttaacgaacgttaacgtaacggtaaacccgtaccgtacccgttaaggaaacggggtaaccccggccgggtaaacgggttaacccgtcgggggtttaacctttacggtttaaccgtttaaacgtttccggttacgggtacgaaccgggtacgttaaaccgggtttcctacggggttaacccggtccgttacccgggtaccgtacgggttaccgggtaacccgggggtttcccggtttaacccccgggaccccgggttacccggggg

SEQ ID NO: 232438 - DNA, 836 bp, Homo sapiens
  misc_feature: GYAE6OF02I84GA.5.27.C05.1.454.CMB.1.raw
  modified_base (167)..(167): a, c, t, g, unknown or other
  misc_feature (167)..(167): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgtnttattttaaaaggtgtcagtgtgaggtgcgagttggtggagtcgtagggggaaccttggtccagccggttggggggtcctggagctcctcctgtgtacgcctctgtcgttcaccgtcagtataccaatacatgagtcgtcgggtcccgcgacggctaccggaagggtaacggggtccgtgggtacggttcgggtacttacgttacgttttaagtttaaggtacgtacggtaaggtaccggtaaaccgaccgtaaccgtaccgtttaccggaaccgtaacggtacccgttaccccggggcggggtaaacgggggccgtaaacggtacctttaccaacccgtaacgttccccgtaaccgaaacggtaaccgtaaaccttaaaaccgttaacccgaaaaacgttaaaccccctttaccccttttaaacgttaccgttaacctaacgtaaacgttacgaaacccgtaaccggttaacgtaacgggtaagggaacccggtacccggggttaaccggaacccgtccgggttaacgttcccgtttaacgttaacttacgtcggttaccggacgggtaaccggtcggtactaaccgggttcgggtaccggttagggcccgtaaggtacccgggttcgggtttacccggggtccccgtaacccgggggtaccccgggg

SEQ ID NO: 232439 - DNA, 930 bp, Homo sapiens
  misc_feature: GYAE6OF02G0ZMQ.5.27.C05.1.454.CMB.1.raw
tcagatcagacacgcacgaccggtgctcgatttagacgcgatcgaagggtttggggctgggagaggagcccagcactgggattccgaggtgttccattcagtgatctgcactgaacacagaggactcgccatggagtttgggctgagcgttgggttttccttgttgacttaagttttaaaaggtgtaccagtcgtgaggtgcgtagttggtggagtcgtagggggtaaccttggtccgaggtcccggtggggggtcccctaggacgtaccttccgtccgttgttacggtacgtcctcgttcggtccgtttaccgtaccgttacaacggttacgactaacttaacagtcggaacgtccggtacgggtacccgcccgtaaggtcccgtaccggtaacggggtaaggggtccgtaggggtaacggttcggggtaccgttacggttaaaggttttaagtttaacgtaacggtaccggtaacggttaacccgggaacccgtaccgaaaccggttaccgttaccggacgaaacggtcccgtaccgggtacgggaacggggactaacggtacgtttacccaaccttagtacccgtacgaaacggtacgtaaaccgtaactttaacccgaaaaacgtaaccctttaacccttttaagttacccgttaacaacggttaacttaaacccgaacgttaccggtcccgtaaaggtacccgggtaaacggtcccccggtaagggttacccggttacccggtactttaacgggttaaccctttaacgggtttaaccgttcggggaccggttaccggaaggtttaacccggtacccgtaccggggttcggtttacccggttaaccgggtacccctttaaggggaacccgttttcccgggggtttaccccgggttaaccccgggtacccccggttaacccgggggg

SEQ ID NO: 232440 - DNA, 805 bp, Homo sapiens
  misc_feature: GYAE6OF02HLVUI.5.27.C05.1.454.CMB.1.raw
  modified_base (295)..(295): a, c, t, g, unknown or other
  misc_feature (295)..(295): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtcgtgggggaaccttggtccagccgtgggggtccctgagctctcctgtgtagcctctgccgttcaccgtcagtagacaattacagtgancgtgggtcccgccgacggccgtccgaagggttaacggggcgtgggaggtgggtccgtcgtagtttaagtttatacggcgtagtcggaaacccgccaacgtaccgtttccgaccacggaacccttcccgggaccgggtacggggaccgtaacggtaacttttcccgaaccctacgtccctcccgaaaggaaccgtaactaaaacgtttacccgaaaaacgtaaacccctttaaacccctttttaacgttaccctttaaccgtacgttaaaccgtttaacgaaaccctaacggtacccttaggggaaacggaaccggggtaacccgggaacgggtaacccggttccgggtacgttacggtttaccgtttaaacgttaccgtttacggtaccggttaacggtaacggttacggttaccgtaaccggttacgggtccgtttaccgggtacccgtacgggtaccggttaggggtttcccgggtttacccccgtaccccggggttaaccccggggg

SEQ ID NO: 232441 - DNA, 761 bp, Homo sapiens
  misc_feature: GYAE6OF02IV31S.5.27.C05.1.454.CMB.1.raw
  modified_base (722)..(722): a, c, t, g, unknown or other
  misc_feature (722)..(722): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggtttcctgttgtcttatttaaaggtgtccagtgtgaggtgctagttggtggagtcgtggggtaaccttggtccaggccgtgggggtccctggagaccttctccgtgtaggtcgcctcgtcgtcgttcaccgtcaggtacgactaattacagtcgacggtcgtcgggtcccgtacccgacggtccgtaccggtaaggggtaaacggggccgttaggggtacggttcggggttacctacgtaggtttaactttacggtacgacggtaagtacggaacccgaccgtacctacgttaccgacgaacgttaacccgtccggaaccggggtacggggtaccgtaacggtaccgtttaacccgaacccgtacgttaacccgtacccgaaacggttaaccgtaaactaaaccgttaaacccgaaacggtaaaaccctttacccctttaagtttaacccgttacgaaacgttaccgtaacgttaaacaccgtacgtacgaacggacgtaccggagtaccgtcgaactgtacctagtcctgtaccgtcgaagtcgtacgtcggtacgtcgtaccgtacgngtaccggtagggttccgtaccccggtacccggtaccggg

SEQ ID NO: 232442 - DNA, 589 bp, Homo sapiens
  misc_feature: GYAE6OF02IKVU9.5.27.C05.1.454.CMB.1.raw
  modified_base (549)..(549): a, c, t, g, unknown or other
  misc_feature (549)..(549): n is a, c, g, or t
  modified_base (553)..(553): a, c, t, g, unknown or other
  misc_feature (553)..(553): n is a, c, g, or t
  modified_base (558)..(558): a, c, t, g, unknown or other
  misc_feature (558)..(558): n is a, c, g, or t
  modified_base (567)..(567): a, c, t, g, unknown or other
  misc_feature (567)..(567): n is a, c, g, or t
  modified_base (569)..(569): a, c, t, g, unknown or other
  misc_feature (569)..(569): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcgagttggtggagtcgtgggggaaccttggtccagccgtggggggtccctgagactctcctgtgtagcctctgcgttcaccgtcagtagcaattaacatgagtcgtcgggtccgcacggcctccgagggtaaggggctgggaggtggtctctagtttattatagcgtagtcggaacccgcacaacgttcgacaacggaccgtccggcgggacgggacaggtaacttcccgaacctatccgtaccagaacgaacctaaacttaacccgaaagtaaaccctacccgttttataaccttaccgaagtactaacgaactacgcctaggacgacgaccgagctcggctgtactgtactgngacngcgcngtgctggcngngtggtcgtccgccgtacggg

SEQ ID NO: 232443 - DNA, 845 bp, Homo sapiens
  misc_feature: GYAE6OF02HZY05.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgaccagtggtagtttgggctgagtcgttgggttttccgttgttgtacttaagtttaaaaggtcgtccgtaggtgtaggaggtgtcgtaggttgggtgggtacggtcggtacgggggtaaccgttcgggtccgacggtccgggttcggggggttcccgtaggtacgtacttccgtccgttggtacggttacgtcccgttcgtcggtccggttaccgtaccgtcgtaaggtacgtacgtaacttacgtagttggacgtccggtcggggtacccgaccgacggtccgtacggtaacgggtaacggggtcggtacgggtagggtcgggttccgttacgttagttttaagttaggtaacggtacggtaacgtacgggacccgtaacgtaccgttacgttaccgacgtaacggtaacccgtccgggtaacggggaccggggtacgtaacggtaacctaccgaaccgtacgtacccgtaccggaacgtaaaccggtaactaacttaacccgaaacgtaaacccttacctttactacctacgtaagtaacgtaacgaactacgaccgtaggaacggtaaccgaccggtaacggtcccgtacggtacttaccgttacttaacgtacgttagacgtacggtaacggcggttaccgtacgggtcgtccggtagttcccgaaggtcccggtttacggggtcccggttaccccggaccgggtacccgggg

SEQ ID NO: 232444 - DNA, 747 bp, Homo sapiens
  misc_feature: GYAE6OF02J1344.5.27.C05.1.454.CMB.1.raw
  modified_base (263)..(263): a, c, t, g, unknown or other
  misc_feature (263)..(263): n is a, c, g, or t
  modified_base (278)..(278): a, c, t, g, unknown or other
  misc_feature (278)..(278): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgcccatggagtttgggctgagcgttgggttttccttgtgtctattttaaaggtgtccagtgtgaggtgcagttggtgagtcgtggggaaccttggtccagccgtgggggtccctgagctctcctgtgtacgcctntgtcgttccaccgtnagtgctaagttacagtgagcgtacggtcccgcgaggtccttaccgagggtaacggggtctagggtaggtcggtactacgtagtttacgtttatacggagtacgtacggaaccgtcgaactacttcggacaacgtaccgtccgacgggacggggactacggtacttacccgaacctacgtaccgtccggaacgtaccgtaaacgtaaccgtttaacccaaaacggttaacccttaaccccgttttgttaaccgttacgaagttaaccggttaaacgaaccgtacgtacccgtacgggaacgtaccgaccgggtaacggtccggtacccggtattacggtttacctaagtttacccggtggtaccgaccggtaggtaccgttaccgtacggtaccggttccgttaccggtacccggaacggtacggggttacccggttccgggtttacccccggaccggggttaccccggg

SEQ ID NO: 232445 - DNA, 653 bp, Homo sapiens
  misc_feature: GYAE6OF02IKNSS.5.27.C05.1.454.CMB.1.raw
  modified_base (302)..(302): a, c, t, g, unknown or other
  misc_feature (302)..(302): n is a, c, g, or t
tcagatcagacacgcacgaccggtgctcgatttagacgcgatcgaagggtttggggctgggagaggagccccagcactgggattccgaggtgtttccattcagtgatctgcactgaacacagaggactcgccatggagtttgggctgagctgggttttccttgttgctattttaaaagtgtccagtgtgaggtgcgagttggtggagtcgtgggggaaccttggtccagccgtgggggtccctgagactctctgtgtagcctctgcgttcaccgtcagtagcaattacatgagctgggtccncgaggcctcgagggtagggctggagtgggtctagagtttatttagagcgatacggaacccgacacctaccgttcgacaggacctccgacgggacggggcagtacttccacctatccctacaggaacgaactaacttaccgaaagtaacccttaacccttttatacccgtttacacgttaacgttacgaaacctaggacccgttagaacggacggacccgaaggaccgttcgggcttcgttacttaaacgtttctcggttaggaccggtaagtacgtaccgaacggttccgggtacgtcgggtaccgaggtaccgttacgggtcggtttccccggaccccggttaccggggg

SEQ ID NO: 232446 - DNA, 638 bp, Homo sapiens
  misc_feature: GYAE6OF02GN3XS.5.27.C05.1.454.CMB.1.raw
  modified_base (308)..(308): a, c, t, g, unknown or other
  misc_feature (308)..(308): n is a, c, g, or t
  modified_base (362)..(362): a, c, t, g, unknown or other
  misc_feature (362)..(362): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtcgtgggggaaccttggtccagccgtgggggtccctgagactctcctgtgtacgcctcgtgcgttccaccgtcagtagctaattacatgagcgtgggtcccnccgaggctccgagggtaacgggctgggaggtgggtctcgtagttaattagtagngtagtacggaaccgcaactacttcgacacgacctccggacgggacggggcaagtacttaccacctatccgaccaggaacaacaacttccgaaaagtaacccttaccctttaatccttacaagtaacgtacgaaactcgtacccgtaggaacgtacggacccggtaaggtaccctcgggtacttcggttacttaagttacgtgtacgacgagtacgtcctacgtcgggtcttcggtaccgaggccgttagggtccggttacccggcccgtacggggg

SEQ ID NO: 232447 - DNA, 836 bp, Homo sapiens
  misc_feature: GYAE6OF02IWB79.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccagtggtaggtttgggctgagtcgtttgggttttccgttgttgtactttaaagttttaaaaggtgttaccgtagttggtggtaggtgtcgtaggttgggtgggtacggttcgggtacgggggtaaccgtttcgggtccgacggtccgggttcggggggtcccgtggacgtaccttccgttccgttgttcggtacgtccgtcgtcggtccgttaccgtaccgtacgtacgtacgtactaacttacgagtaggacggtcggttccgggtaccgaccggtacggtccgtaccgggtaaggggtacggggtcggtagggtacggttcggttacgttacgttagttttagtttaggtacggtacgtacggtaccggtaacccgtacctaaccgtaccgttaccggacgtaccgtaccggtaccgggacgggacgggtacgtaacgtacccttaccgaccgttacctacccgaccgaaaggaaccctaacttaaccgttaaaccgaaaccgttaaccctttaaccccgtttactacgttacgaaacgttacgtaaccgaccgtacgtacgacggtaaccggtccggaccggtacgtaccggtcgttacgttacgttaccgttagtacgtgggtacgacgttacgtcgttaccggtggtcgtacgtcggtactcggtccggttaggtcccggtcccgggtaccgggtacccgg

SEQ ID NO: 232448 - DNA, 737 bp, Homo sapiens
  misc_feature: GYAE6OF02HWYBD.5.27.C05.1.454.CMB.1.raw
  modified_base (204)..(204): a, c, t, g, unknown or other
  misc_feature (204)..(204): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcttgggttttccttgttgcttaattttaaaggtgtccagtgtgaggtgcagttggnggagtcgtgggggaaccttggtccagccgtgggggtccctgacactctcctgtgtagcctctgcgttcaccgtcagtagactaattacatgagtcgtggtcccgcgacggtcctaccggaagggtaacggggctaggacggttgggcttacgtagtttatttagacggcgtaggtacggaccgctaccgtacgttccgacgacgtacccgtaccggacgggacgggactaacgtacttccaaccgtactcccgtaccgaagaacgtaactaaacgttaacgaaaaacgtaccctttaaccccttttagtacccgttacgaagtacgttaacgaaaccgtcgtacccgtaggaaccggtaccggaccgggaacgttaccgtaccggtacctttcgggttaaaccttaggtttacccgtagggtcggaacgtaaccgggtagttacccgtaacggtcgggttaccgttaccgggttacccaggtacccggtaacggggttttacccggtacccgggtaccccccggtaacggggg

SEQ ID NO: 232449 - DNA, 780 bp, Homo sapiens
  misc_feature: GYAE6OF02IHUND.5.27.C05.1.454.CMB.1.raw
tcagatcagacacgcacgaccggtgctcgatttagacgcgatcgaagggtttggggctgggagaggagcccagcactgggattccgaggtgtttcccattcagtgatctgcactgaacacagaggactcgccatggagtttgggctgagtcgtgggttttccttgttgctaattttaaaaggtgtccagtgtgaggtgcaggttggtggagtcgtgggggaaccttggtccagtccgtgggggtccctgacgtactctcctgtgtagcctctgcttccaccgtcaagtagctaaattacattgagtcgtcgggttccgcccgaggccttaccgaagggtaacggggcgttagggaggtcggggttctaccgtagtttaattttaagtacggtacgtataccgggaacccgtacaaaccgtacgtttacgacgtaacgaccgttaccggaccggaaggggggctaacggtaactttacccgaaccctaacgttacccgttaaccgaacggaaacggtaacctaaaaccttaaccaaaacggtaaacccttaaccccttttaaacgttaccgtttaaccaagtacgtaacgaaccgtacgtaccgtacgaacgacggtaccggtaaggtaccggttacggaccttgtacctttacgttaacgtaggtacgaccggtaaggtaaccggtacctaaaccgggttcggtaccggttccggtacccgtaaggtaccgggttacggtttaccgggttacccccggaaccccgggttaccccgggggg

SEQ ID NO: 232450 - DNA, 305 bp, Homo sapiens
  misc_feature: GYAE6OF02IA6LT.5.27.C05.1.454.CMB.1.raw
  modified_base (267)..(267): a, c, t, g, unknown or other
  misc_feature (267)..(267): n is a, c, g, or t
  modified_base (273)..(305): a, c, t, g, unknown or other
  misc_feature (273)..(305): n is a, c, g, or t
tcagatcagacacgcacgaccggtgctcgatttagacgcgatcgaagggtttgggaacacggccaccctgaccatcagcagggtcaagccggggatgaggccgactattactgtcaggtgtggaatggtgattatgattatgtcttcggaactgggaccaaggtcaccgtcctaggtcacgcccaaggcccaacccccactgtccactcgtcgttcccccgcccttcctccgtgtctgacttcgtgagcgggctcggacaaggccgnagtagnnnnnnnnnnnnnnnnnnnnnnnnnnnnnnnnn

SEQ ID NO: 232451 - DNA, 634 bp, Homo sapiens
  misc_feature: GYAE6OF02H59OD.5.27.C05.1.454.CMB.1.raw
  modified_base (548)..(548): a, c, t, g, unknown or other
  misc_feature (548)..(548): n is a, c, g, or t
  modified_base (556)..(556): a, c, t, g, unknown or other
  misc_feature (556)..(556): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcgtggtttcgtcgtaggctatttaaaagtgtcagtgtgaggtgcagttggtggagtcgtgggggaaccttggtccagccgtggggggtccctgagactctcctgtgtagcctctgtcgttcaccgtcagtagctaattacagtgagtcgtggtccgcctaggctccgaagggtaacgggctggagtcgggtctacgagtttatttagagcgatcggaacccgctacgacttcgacacgactccgcggagggcaagtctaccgactatcctaccagtacgaacctaagttacccgaaagtaaccctcccgttttaatccgttaaccaagagtaccgaaacaccgttaccaggaacgacggccggtaaggtcctccgggacttcgtaaccttagtttaccgnggttaccnggtagtacgtccgtagtcggccgttacggaccgtacgggcgttacggggttacggttccccggaaccccgggtcgggg

SEQ ID NO: 232452 - DNA, 779 bp, Homo sapiens
  misc_feature: GYAE6OF02FPZAL.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcgtggttttccttgttgtctattttaaaaggtgtcagtgtgaggtgcagttggtggagtcgtggggtaaccttggtcctagccgtggggggtccctgacgtactcgtcctgtgtacgcctcgtgcgttcaccgtcagtacgactaattacatggaagtcgtcgggtccaccgtacgggctacccggagggtaacggggctaggggtaagtcgggtacctacgtaagttttaactttagtaacggtcgaagttacggaaacccgtccgtactaccgtttacgacgtaacgtaccttacccggggacgggtacgggggactaaacggttaaccttttaccgaacccgtaaccttacccggtaacccgtaacggaaccggtaaaccgtaaaccgttaaccccgaaaacggtaaaccccttaaacccttttaaccgttacctttaccgaagttaaccgtaacgtaaacccgtaagtcccctaagggacgtaaccggtaaccggaacgggttacgccggtacgttacggttaaccttcgtaaaccgttggtacggtacgtaacgttacggtacgtccggtacggttcgtacggtccgagtacggtcggttaccggttcccgaccggtaacccgggg

SEQ ID NO: 232453 - DNA, 713 bp, Homo sapiens
  misc_feature: GYAE6OF02H6B5B.5.27.C05.1.454.CMB.1.raw
  modified_base (260)..(260): a, c, t, g, unknown or other
  misc_feature (260)..(260): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcttgggttttccttgttgcttaattttaaaaggtgtccagtgtgaggtgcagttggtggagtcgtgggggaaccttggtccagccgtgggggtccctgagactctctgtgtncctctgcgttcaccgtcagtcgactaattacatgagcggttacggtccaccgaggcctaccgaagggtaacggggcgtggacggttgggtcctacgtagttttacttagaggcgtagtacggaacccgctactacgttccgacgacgtaccgtccggacggacgggggccaaggtacctttaccgaacctatcccgtacgagtaacgaactaaacgttaccaaacgtaacctacccttttataccgttacgtaacgtaacttacgaaacgtacgtaccgtaggaacggaaccggtacccggaacgggtaccgtcgggtaccgttacgttaacgttaagtttaccgtacggtacggtacggacggtacgttaccgtacggttaccggtcgttaccgggtccgtaaggtccggttaacgggtttccgggtaccccggtaaccccgggtccggggg

SEQ ID NO: 232454 - DNA, 671 bp, Homo sapiens
  misc_feature: GYAE6OF02GNZIC.5.27.C05.1.454.CMB.1.raw
  modified_base (521)..(521): a, c, t, g, unknown or other
  misc_feature (521)..(521): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagccgtgggggtccctgagactctcctgtgtagcctctgtccgttcaccgtcagtacgacaattaccatgagtcgtgggtcccgcaggcctacgagggtagggctggagttgggtctacgtagtttattagtagcggtaatcggaaccgtacaacctacttcgactaaggccttaccggcggaggggaccaggtaactttacccgaaccctacttcctaccgtagaacgaacccttaaagttcccaaaaacggtaacccttaacccttttaaacttaccgttaccgaaacgtttanaaccggtaaaccacggtaccccgtagtaaaccggaccgaccgggacttacgggttgtccttagttacgttaacgttacgttgtacgccgtaggtcctcgagtcggtacgtgtaccgagtccggtggtaccgtttccggaccccgtcgggg

SEQ ID NO: 232455 - DNA, 604 bp, Homo sapiens
  misc_feature: GYAE6OF02FSA5H.5.27.C05.1.454.CMB.1.raw
  modified_base (484)..(484): a, c, t, g, unknown or other
  misc_feature (484)..(484): n is a, c, g, or t
  modified_base (574)..(574): a, c, t, g, unknown or other
  misc_feature (574)..(574): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtcgtgggggaaccttggtccaggccgtcggggggtccctgagactctcctgtgtacgcctctgcgttcaccgtcagtagcaattacagtgagcgtggccgccaggcctccgagggtaaggggctggagttcgggtctcgtagttatttaagtacgcgagtacggaaccgcgacacttccgcacgtactccgacgagggcagacttccacactctccgagacgaactacgttaaccaacgtaaacctacccgtttaattccttacagtactacgaaacncgtaccgtagacggagacccggaggaccgttcggacttgttaccgttacgttacgtcgtgacggagtacgttacacgtgtccctggtccncgtcgtagggtccgtacccgcccggtcggg

SEQ ID NO: 232456 - DNA, 804 bp, Homo sapiens
  misc_feature: GYAE6OF02GIVB0.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagttgggctgagcgttgggttttccttgttgctaattttaaaggtgtccagtgtgaggtgctaggttggtggtagtcgtagggggtaacctttggtccgaggccgtcggggggtccctggacgactctcctgtgtacgtcctcgtcgtccgttcaccgtctaagtacgactaacttacagtggacgcggtacgggtcccgacccggtaagggcccttacccggaaggggttaacggggtcgtaggggtaacgggttcgggttaccgttacttaagggttttaattttaagtaacggacggttaacgtaacggaacccgtccgaaccgttaccttacggtaccgaacgtaaccgtcccgggtaacggggacgggggacctaacggtcctttaacccgaaccgtaacgttacccgttaccgaaaggtacctaaaccgtaaactttaacccgaaaacgtaacccttaaaccccgtttttactaccgttaaccgaagttaacgttaacaaacgtcgtacccgtaggaaccggtacgcccggtaacgggtccgttccgggtacgttgtacctttaacggttactggtacggaccgtaaggtcctacggtaccgtcggtaccgtggtacctacgggacgttacgggttccgtacccgggtacccgtaaccggggg

SEQ ID NO: 232457 - DNA, 726 bp, Homo sapiens
  misc_feature: GYAE6OF02IFN9X.5.27.C05.1.454.CMB.1.raw
  modified_base (273)..(273): a, c, t, g, unknown or other
  misc_feature (273)..(273): n is a, c, g, or t
  modified_base (291)..(291): a, c, t, g, unknown or other
  misc_feature (291)..(291): n is a, c, g, or t
  modified_base (435)..(435): a, c, t, g, unknown or other
  misc_feature (435)..(435): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcgttgggttttccttgttgcttaattttaaaaggtgtccagtgtgaggtgcaggttggtggaggtcgtgggggtaaccttggtccaggccgtgggggtccctgagacttcgtctgtgtacgcctntgcgttcaccgtcagtancgtaattacagtgagtcgtcgggtccgccaggtccttcggaaggtaggggcgtgggtaggtcgggtactcgtagtttaatttacgtagcgtacgtacggaacctcgaaccgtacttccgacgtaacgtaccgtaccggacgggngggacgtaacgtacgtaccgtaacctacttcccgtaaccgaagtaacggaactaacgttacccgaaaacgttaacccctaacccttttacttaccgttacgtaacgaacgttacgaaccacggtaccgtacggtaaacgacgggtacccggtaacgtacccggttcggtaccgttcggttaactttacgttaacggttgtacggtacggtacgtacgtaacggtcgtcggtcgttacgggtcctaacggtccgttaacggggtccggttacccggtaacccgggtccgggg

SEQ ID NO: 232458 - DNA, 628 bp, Homo sapiens
  misc_feature: GYAE6OF02GXXAE.5.27.C05.1.454.CMB.1.raw
  modified_base (277)..(277): a, c, t, g, unknown or other
  misc_feature (277)..(277): n is a, c, g, or t
  modified_base (392)..(392): a, c, t, g, unknown or other
  misc_feature (392)..(392): n is a, c, g, or t
  modified_base (439)..(439): a, c, t, g, unknown or other
  misc_feature (439)..(439): n is a, c, g, or t
  modified_base (501)..(501): a, c, t, g, unknown or other
  misc_feature (501)..(501): n is a, c, g, or t
  modified_base (529)..(529): a, c, t, g, unknown or other
  misc_feature (529)..(529): n is a, c, g, or t
  modified_base (545)..(545): a, c, t, g, unknown or other
  misc_feature (545)..(545): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcttgggttttccttgttgctattttaaaaggtgtccagtgtgaggtgctagttggtggagtcgtgggggtaaccttggtccagccgtgggggtccctgagactctccgtgtgtacgcctctgtcgttcnccgtcagtagactaattacatggacgcgtcgggtcccgccgacggcctccggagggtaacggggcgtgggtaggtgggttctacgtagtttatttagtacgcgtagtacggaccncgactacgtcgacacgaccgtccggacggagggcaagtctacaccgntccgacaagacgtaactaactaccaaacgaaccttaccctttatccttacagtactagaacncgtacaggacgcgaccgtagcctcggtntcgtacttacgttcgnggtacgacgagtaccgtctacggtcggtccttcgggacctaggcggttacgggttccggttacccccggacgttacccggggg

SEQ ID NO: 232459 - DNA, 736 bp, Homo sapiens
  misc_feature: GYAE6OF02F6VXQ.5.27.C05.1.454.CMB.1.raw
  modified_base (197)..(197): a, c, t, g, unknown or other
  misc_feature (197)..(197): n is a, c, g, or t
  modified_base (301)..(301): a, c, t, g, unknown or other
  misc_feature (301)..(301): n is a, c, g, or t
tcagatcagacacgcacgaccggtgctcgatttagacgcgatcgaagggtttggggctgggagaggagcccagcactgggattccgaggtcgtttccattcagtgatctgcactgaacacagaggactcgccatggagtttggctgagcttgggttttccttgttcgcttattttaaaaggtgtccagtgtgaggtncgtaggttggtggagttcggtagggggtaaccttggtaccaggtccgtcgggggtccctggacgtacctctccgtgtcgtacgtcctcgtcgccgttcaccgtnaggttacgactaattacatcgacgtcggttccggtcccacggacgtccgtaccggtaaggggtaacggggtcgtacgggacggttcgggtccttacggttaagttttaacgtttaagtacggtcggtacgtacggtaacccgcgtaacctacgttccgacgtacgaccgtccggaggtaacggggctaacgtcttaaccaaccgtacgtaccctacgaaggaactacctaaacgttacccaaacgttaaacccttaaccctttaatccttaaccgagaccgtaacaaccgacgtacgtaggaaccgtaacggccgtaacgtccgtacgtcgttacgtacttaccgttactacggttcgacgtacgtacgtcgtacggtcggtacgttaccgtcgcggtaacgtcgggttaccggttccccggaccggtaccgggg

SEQ ID NO: 232460 - DNA, 624 bp, Homo sapiens
  misc_feature: GYAE6OF02H6LLB.5.27.C05.1.454.CMB.1.raw
  modified_base (283)..(283): a, c, t, g, unknown or other
  misc_feature (283)..(283): n is a, c, g, or t
  modified_base (380)..(380): a, c, t, g, unknown or other
  misc_feature (380)..(380): n is a, c, g, or t
  modified_base (394)..(394): a, c, t, g, unknown or other
  misc_feature (394)..(394): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcttgggttttccttgttgctattttaaaggtgtcagtgtgaggtgcagttggtggagtcgtgggggaaccttggtccaggccgtggggggtccctggagactctcctgtgtgcctctgcgttccaccgtcagtanacaattacatgagtcgtcgggtccgccgaggctccggagggtaacgggggctgggaggtgggttctacgagtttatttacaggtcagtcggaacccncactacgttccganacgactccggcgaggggcagacttcgactatcctaccgagagaacctaaacttaccaaagaacctacctttataccttactaacgatacgaacgacgtccgttaggacgacgtaccgaacggactccgggacttcggtacttacgttacgttagacgtcgtaaggcgtactacggtcgtacgcggttaccgacggtccgtagggttcggttacccggacccggtcggggg

SEQ ID NO: 232461 - DNA, 685 bp, Homo sapiens
  misc_feature: GYAE6OF02GJV0T.5.27.C05.1.454.CMB.1.raw
  modified_base (441)..(441): a, c, t, g, unknown or other
  misc_feature (441)..(441): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcgtgggttttccttgttgctaattttaaaaggtgtccagtgtgaggtgcaggttggtggagtcgtgggggaaccttggtccagccgtgggggtccctgacgactctccgtgtgtacgcctcgtcgtcgttcaccgtcagtagactaattacatgagcgtggtcccgcgaggtccaccggtagggtaaggggctaggaggtgggtctcgtagtttattagagcgagtcggaacccgcaaccgtacgttcgacgacgaccgtccgggaggacggggacacgtacttccaaccctntaccctcgaagtacgtaaacctaacttaaccgaaaacgtaacccttaacccgtttactaccgtttaacaaggtaactaacgaaaccgtacgtaccgtaggaacgaccggaccgggacgtacccgttggtcttacgttaccgttaacttcgtagcggtacgacgtacgttaccgacgtccggtacgttacgggtccgtacggtccggtacggtttccgggttaccccggtacccggtaccggggg

SEQ ID NO: 232462 - DNA, 763 bp, Homo sapiens
  misc_feature: GYAE6OF02H3O4F.5.27.C05.1.454.CMB.1.raw
  modified_base (285)..(285): a, c, t, g, unknown or other
  misc_feature (285)..(285): n is a, c, g, or t
  modified_base (296)..(296): a, c, t, g, unknown or other
  misc_feature (296)..(296): n is a, c, g, or t
  modified_base (527)..(527): a, c, t, g, unknown or other
  misc_feature (527)..(527): n is a, c, g, or t
  modified_base (594)..(594): a, c, t, g, unknown or other
  misc_feature (594)..(594): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttggctgagcttgggttttccttgttgcttaagttttaaaaggtgtcctagtgtgaggtgctaggttggtggagtcgtagggggtaaccttggtccaggccggtcggggggtccctaggacgtaccttctccgtggtcgtcgtcctntcgtcgttccnccgtcgtagtacgtactaacttacagtaggacgtcgttccggggtcccacccggacggtaccgtaccgggtaaggggtaacgggggtccgttaggacgggtttcgggtaccttacggtaagtttttagtttaagtacggtacgtaggtaccggaacccgtcctaaccgttaccgttccggactacggtaccgtccggacgggaacgggtacacgtacgttaccaacccgtntacccgtacgaacgtacgaaccttaaacgtacccgaaacgtaaacccttacccttttataccgttanaaggtactacggaacctggtacccaaggtacggaccggtaccgtaacggcccgttacggcctttcgttacgttaaacttcggcggtaggacgttcgacggtaccttcggaacggttcgtccggcgtaagtccgggttaaggggttcccgtcccggtacccgggtccggg

SEQ ID NO: 232463 - DNA, 825 bp, Homo sapiens
  misc_feature: GYAE6OF02JFAAV.5.27.C05.1.454.CMB.1.raw
  modified_base (269)..(269): a, c, t, g, unknown or other
  misc_feature (269)..(269): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgcttaattttaaaaggtgtccagtgtgaggtgctaggttggtggagtcgtgggggaaccttggtccagccgtgggggtccctgagtactctcctgtgtacgcctntcggtcgttccaccgtcagttacgactaagttacagtgacgtcgtcgggtcccgcgtaacggcctaccggaaggggtaacggggtccgttagggtagggttgggttccgtaacgtagttttaattttaacgtacggtacggtagttaccggaaccgtacctacgtaaccgttccggactacggtaccgtcccgggacgggtaacggggaccaacggttaccttacgaacccgttacgtttacccaaccgaaggtaaacccgtaacttaaaccgtttaaccccgaaaacggtaaacccctttaaccccttttacgtttacccttaacgtaaccgttaaacgtaaccgtaaaccgtaccggtaccttaacgggagtaaccgggtaccccgggaaggtaaccgtccgggttacgtttacgtaaccgttttaagttaccgggttaggtacggtacggtaggtaacgtacccggtacggttacggtcccgttaccggtaccgtaacggttaccgggttcggttttacccggggtacccccggtaccggggtaccccggggg

SEQ ID NO: 232464 - DNA, 691 bp, Homo sapiens
  misc_feature: GYAE6OF02J04MV.5.27.C05.1.454.CMB.1.raw
  modified_base (353)..(353): a, c, t, g, unknown or other
  misc_feature (353)..(353): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctggtttcctgttgctatttaaaggtgtccagtgtgaggtgcagttggtggagtcgtggggaaccttggtccagccgtgggggtccctgagacctctctgtgtacgtcctcgtcgtcgttacaccgtcgagtagctaattacatgagcgtcggtccgcgaggctcgaggtacgggtcaggtggtggtctgtagttattagtacgnggagtacggaccgctacacgtcggactacgtactccggacggacgggcgacgtacgtaccgaccgtacttccgaccaagtacgtaaaccaacgttacccaaacggtaacccttaaccgttattccttagacgtaatacgaaaccgtcgaccgttacggacgtaaccggacccggtacgggtacctaccgggtacgtacggtttacgtaaccgtttcgtacggtacgggtacgtacggtaacgttaccggtacggtaccggttcggtaaccggttccggacgggtacccggttagggggtttaaccccgggtccccgttaacccgggggtacccggggg

SEQ ID NO: 232465 - DNA, 901 bp, Homo sapiens
  misc_feature: GYAE6OF02GUAJ3.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacgagacggactcgccagtggagtttcgggctgagcgttgggttttccttgttgcttaagttttaaaaggtgtccagtgtgaggtgctaggttggtggagttcggtcgggggtaacctttggtaccgaggtcccggttggggggtccctggacgtaccgttccttccgtggtcgtacgtcctcgtcgtccgtttaccgaccgttgaacgtacgactaacgtttaacagtggagtccgttcggggtcccgaccgacggccgtaccggtaagggtaacggggctcggggtaaggttcggggtaccttacgtaagttttaacgtttaagtcggtacggtaacggtaccggtaacccgtacgtaaccgttaccgtttacgaccgaacggtacccggtaccggaccggggaacggggtctaacggtaccctttacgaaccttaccgttacccgtaccgaaacggaacttaaacccgtaaaccgtttaacccgaaaacggttaaaacccctttccccttttaaagtttcccgttaacggaaacgtttacgaaacggtaaacccgacggtaaccggttacgggtaaccgaaccgggttacccggtaacgggtacccgttaccggtcgtttaacggttttaccctttaacggtttaaccggtcgttacggccggtaaacggttcggtaaaccgttcgggtaaccgggtaccgttccgggtaaacccgtgggtttacccgggttaaccgggtttacccggttaccccccgggtacccggggttaaccccgggg

SEQ ID NO: 232466 - DNA, 768 bp, Homo sapiens
  misc_feature: GYAE6OF02GAOSE.5.27.C05.1.454.CMB.1.raw
  modified_base (398)..(398): a, c, t, g, unknown or other
  misc_feature (398)..(398): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagttgggctgagctgggttttccttgttgctattttaaaaggtgtccagtgtgaggtgcagttggtggagtcgtgggggaaccttggtccaggtccgtggggggtccctggacgactctcctgtgtacgcctcgtgtccgttcaccgtcagtagctaattacatggagtcgtgggtcccgaccgaggcctaccgaagggtaaggggctgggtaggttcggggtctcgtaagtttatttatacgacggtactacggaacccgtnaccgtacgttcggacaacgtacgtaccgggacgggacgggggacctagtactttaccaacccgtaacttacccgtacccgaaggaacgtaaacccgtaaacttacccgaaaacgtaaacccgttaaccccttttaacgtcctttaacgacgtaaatacggtaaacaccggtaccctagggaaccggtaacgggacccggtacgggtaaccggtccggtacgttcggttaacttaacgttaaccgtggttaccgacggaaacggttacggtacccgttaacggtcgggttacccgttaccgggtaccctaacgggtacccgggttaaggggtttaccgggtttaccccgggacccccggttaaccgggggg

SEQ ID NO: 232467 - DNA, 928 bp, Homo sapiens
  misc_feature: GYAE6OF02ISWSJ.5.27.C05.1.454.CMB.1.raw
tcagatcagacacgcacgaccggtgctcgatttagacgcgatcgaagggtttggggctgggagaggagcccagcacgtgggattccgaggtgtttccattcagtgatctgcactgaacacagaggactcgccatggagttggctgagcgttgggttttccttggttgtacttaagttttaaaggtgtacctaggtgtgtaggtgcgtaggttggtggagtcggttggggtaaccgttggtacctaggcccggttcggggttaccctggtacgtaccgtccgttccgttagtacggtacgtccctacgttcggtccgtttaccgtacccggttacgtaacggtagtaacctaaacgttacgaactacggtacggtaccggttacggggtaccccgaccggtacggtacccgttaccggtaaggggtaaccgggggtccgttaaggggtaccgggttgggttaccgttaccggttaagtttttacgttaacggtacggtaaccgtaggtaccggtaacccgtccgaaccgttaccgttaccgcgtaacggtacccggtccggtacgggtaccgggacgtaacggttaccgtttaacccaccgtacggtacctaaccggaacgggtaaacgtaaacccgttaaaccgtttaaacccggaaacgttaaaccccgtttaaccccttttaacgttacctttaacgtaacggttaaccgtaaagtaaccccgggacttaacccgggttacggaaaccggttaaccgggaccggtaacgggttacccgttaccgggtacccgtttcgttaaacgttaaaccgtttccgttcgggtaacgtacggtaaccggtacggtacctacggttggtaccggttacgacccggttagtaccggtacgggttttacgtacccgggtaccccggttaacccgggg

SEQ ID NO: 232468 - DNA, 678 bp, Homo sapiens
  misc_feature: GYAE6OF02GW4X3.5.27.C05.1.454.CMB.1.raw
  modified_base (308)..(308): a, c, t, g, unknown or other
  misc_feature (308)..(308): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaggtgtccagtgtgaggtgcagttggtggagtctgggggaacttggtccaggcctggggggtccctgagtactctcctgtgtagccgtctgccgttcaccgtcagtacgcaattacatgagcgtggtccgccgnggcctcgaggtaagggctggagtgggtctcgtagtttagttatagacgagtacggaacccgcactacgttcgacaacgaccgtaccggcggaggggactaggtacttaccgacctacgttccctaccgaggaacaacgtaaccttaccaaaacgtaaccctacccttttagtccttaacagtaactacgaactcggtcctaggaacgacggacccgtacgggacctccgggtcttacggttacttaacgttcgttacgggtacggtacggtacggttacgtaccgtaacggttcgggtcccgtttagggtacccgacggttacggtaccggggtttccgggttaccccgggacccccggttaccgggggg

SEQ ID NO: 232469 - DNA, 930 bp, Homo sapiens
  misc_feature: GYAE6OF02GGQH6.5.27.C05.1.454.CMB.1.raw
tcagatcagacacgcacgaccggtgctcgatttagacgcgatcgaagggtttggggctgggagaggagcccagcactgggattccgaggtgttccattcagtgatctgcactgaacacagaggactcgcatggagttgggctggagtcgttgggttttccttagttgtcttaagttttaaacggtgtccagtgtgtagtgctaggttaggtggagtcggtaggggtaaccttggtccaggtccgtgggggtccctaggtacgtaccttctccttagtcgtacgtccttcgtcgtcgttaccgaccggtccgtaaggttacgaaccttaaacgtttacgagtttcggaacggtccggttaacggggttcccgacccggttacgggcccgtttacccggaaacgggggttaaacggggggtcccgtagggggtaacgggttgggggttacccttaccggtaaggttttaaacttttacggtaaacggtaccggttaaacgggtaccgggtaaaccccggtacctaaaccggtaccgtttaaccgggacgtaaaacgggtacccgttcccgggacggggtaaacgggggaccctaaacgggtaaccttttacccaaaccggtaaccgttacccgtaacccgtaaacgggtaacctaaaaccgtaaacctttaaccggaaaaacgttaaaccccgttaaacccttttagttaacccctttaacggtaacgtaaacgtaccggtaaaaccctacgggtaacccgttaaggaccggtaaccggtacccggaacgttacccggtacgggtcttacggtaacttacgttaacgtcggtcgtaaaccggtgtaaccggtaacggttacgtcgggttacccgttagggttacccgaggtaccgtacggggtttaccggtacccgtaccccgggtacgggg

SEQ ID NO: 232470 - DNA, 697 bp, Homo sapiens
  misc_feature: GYAE6OF02JS7VT.5.27.C05.1.454.CMB.1.raw
  modified_base (228)..(228): a, c, t, g, unknown or other
  misc_feature (228)..(228): n is a, c, g, or t
  modified_base (282)..(282): a, c, t, g, unknown or other
  misc_feature (282)..(282): n is a, c, g, or t
  modified_base (372)..(372): a, c, t, g, unknown or other
  misc_feature (372)..(372): n is a, c, g, or t
  modified_base (446)..(446): a, c, t, g, unknown or other
  misc_feature (446)..(446): n is a, c, g, or t
  modified_base (486)..(486): a, c, t, g, unknown or other
  misc_feature (486)..(486): n is a, c, g, or t
tcagatcagacacgcacgaccggtgctcgatttagacgcgatcgaagggtttggggctgggagaggagcccagcactgggattccgaggtgttccattcagtgatctgcactgaacacagaggactcgccatggagtttgggctgagctgggtttccttgttgctatttaaaaggtgtccagtgtgaggtgcagttggtggagtcgtgggggtaacctttgggtccgngccgtggggggttccctgacggactctccgtgtgtagcctctgcgttcaccgtnacgtagcctaaattaccagttgagcgttcgggcccgccgaaggcctccgagggtaacggggctagggtagtggggtcctacgtaggtttnttagtaagccgagttacggaaaccgctactacgttcgacgacgaccgtcgacgggagggcaggacttcgaactntcgtaccaggacacaaacgttaccaacgaactacctttanacgttacacgtaaatcgaaatcccgtagacgtaaggacgaccgaacggtaccgttacggacctttacggacctttaagtaacccgttgggttaccgtaacccgggtaagtcgggttaaaccccttaggtccgggttacccgttacgggtcccctaaggggtccccttaaggggtttcccgggtttaaccccgccccggggttaacccgggg

SEQ ID NO: 232471 - DNA, 752 bp, Homo sapiens
  misc_feature: GYAE6OF02GKPCZ.5.27.C05.1.454.CMB.1.raw
  modified_base (318)..(318): a, c, t, g, unknown or other
  misc_feature (318)..(318): n is a, c, g, or t
  modified_base (399)..(399): a, c, t, g, unknown or other
  misc_feature (399)..(399): n is a, c, g, or t
tcagatcagacacgcacgaccggtgctcgatttagacgcgatcgaagggttgggcgtgggagaggagcccagcactggattccgaggtgtttccattcagttgatctgcactgaacacagagactcgccatggtagtttgggctgaggtcgttggttttccgttgttgtcgttaatttttaaaaaggtgtcctagtgtgtaggtgtcgtaggttggtaggaggttcgtagggggtaaccgttgttaccgaggtccggttgggggtcccttaggacgtaccgtcgtccgttgtagtcgtcctcgtcgtcgtactaccgngtagtacgctaacgttcaagtgacgcgtcggtccgcgaggcctacgaggtaggcgtggtagtcggtccgtgttaaggtttntacgtagcgtagaccgtaacgctacgtacgttccgcgtaacgtaccgtccgcggtaacgggtacctacggttacctacgaaccttacgtacctaccggtaagaacgtaaccgtaacgttaccctaaacgtaaacccgtttacccttaacgtttccgttaacgtacgtaagtaaccgacgtaactaccgtagacgaccggaccgtacgtaacccggtccgttagtaccttacgttagttacgtcgtacgtaccgtaggtaccgtacggtaccgtaacggttcccgtacggtaacccgttaacgggtcccgttaagggtttacccccgggtacggtacccccgggttacccgggg

SEQ ID NO: 232472 - DNA, 752 bp, Homo sapiens
  misc_feature: GYAE6OF02JYG5R.5.27.C05.1.454.CMB.1.raw
  modified_base (436)..(436): a, c, t, g, unknown or other
  misc_feature (436)..(436): n is a, c, g, or t
  modified_base (604)..(604): a, c, t, g, unknown or other
  misc_feature (604)..(604): n is a, c, g, or t
tcagatcagacacgcacgaccggtgctcgatttagacgcgatcgaagggtttggggctgggagaggagcccagcactgggattccgaggtgtttccattcagtgatctgcactgaacacagagactcgccatggagttgggctgagcgttcgggttttccttggttgtacttaagttttaaaagggtcgtaccgtaggttggtacggaggttcggtacgtaggttgggtacggagttcggtacgggggtaaccttggtaccgaggtccggttcggggtccgtgacgtactcctcctgtgtacgtccgtcgtcgtccgttacgccgtgtacgtaagtctaaacgttacagtcgtaggtcgtacgggtcccgcgtacggcctaccggagggttaacgggcgtaggtacggttcggtccgttagtagtttagttaacgnggtacgtaggacggaccctcgtacctcgtccgtagacgtaccgacgggtacggaggacgtaacgtacgtcacgtacctcgtaaccgagaccaacgtaaccttaacgaaccttaaccctaacccttatacccgttaagtactaggtacccaactaccgtacgttaacgnggtaaccgcgtaccggtctacgggtacttacgtcttaacgtaacgtcggtagaagtaccggtagtccgacgggtttggaaccgttagtaccccgggttgtaaccccgggttacgggtacccgggtaccccggtacccgggtacccggg

SEQ ID NO: 232473 - DNA, 703 bp, Homo sapiens
  misc_feature: GYAE6OF02GLG01.5.27.C05.1.454.CMB.1.raw
  modified_base (206)..(206): a, c, t, g, unknown or other
  misc_feature (206)..(206): n is a, c, g, or t
  modified_base (249)..(249): a, c, t, g, unknown or other
  misc_feature (249)..(249): n is a, c, g, or t
  modified_base (328)..(328): a, c, t, g, unknown or other
  misc_feature (328)..(328): n is a, c, g, or t
  modified_base (553)..(553): a, c, t, g, unknown or other
  misc_feature (553)..(553): n is a, c, g, or t
tcagatcagacacgcacgaccggtgctcgatttagacgcgatcgaagggtttgggggctgggagaggagcccagcactgggattccgaggtgtttccattcagtgatctgcactgaacacagaggactcgccatggagtttgggctgagcttgggttttcctgttgctaattttaaaggtgtccagtgtgaggtgcagttggtggngtcgtgggggaaccttggtccaggccgttggggggttccctgnggtacctcgttccgtgtcgtagcctcgtcgtacgttccaccgtcagtacgactaactactagtgagtccgtgggtcccncgtacggtcgtaccgaaggggtaacgggtcgtagggtagttcggggtacctcgtaagttttattacgtagtcgaagtacgggtaacccgctaacctacgttcgacgtacgaccgtccggacgggacgggcacgtacgtcaaccgtctccgacgtaagacgaactaaacgttaccaaacggtaaccttaacccgtttattaccgttacgaacttagtaaccgaacnctcgaggttaagaccggccggtaagtcccgtcgtacgtcttacttaagttccgtgttcggacgttacggcgttaccgtacggtccgggttacgtaccggtctaacgggtcgtacggggttcccggttaacccggccccggttaccggggg

SEQ ID NO: 232474 - DNA, 939 bp, Homo sapiens
  misc_feature: GYAE6OF02I12TN.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagttgggctgagcttgggtttcctgttgcttattttaaaggtcgtccagtgtgaggtgctagttggtggacgtcgtgggggtaaccttggtcctaggtccgtcggggggtccctggacgtaccgtcctcgtgtcgtacgtccttcgtgaccgtttcacccgttacgacgtacgtcctaaagttaccgtagttacgtacgtaccggtttccggggttaccccggacccctaaagggtccccgttacccgggtaaaaccggggggtttaaacgggggtccgttaaccggggggtaacgggttccggggtttcctttaaccggttaacggtttttaacggttttaacggtaacggtaccgggttaacgtaccgggtaacccgggtacctaaaccggttaccgtttacggaccgttaaacgggtaacccgttccccgggaacggggtaaccggggtacgtaacggttacgtttacccgaaccttaaggttacccacggttaaacgcggttaaaccctaacgtttaaccaaacgggttaacccttaacccgtttttaaccgtaactttccgtaaagaacttaccgggaaccttaacccgtacgacggtaaccggacggtaccgtacgggttacctacccgggttacttaaccggtacgtttaaaccgttaacgttcggtttacccggaaggtaacccgtttagggtaccgttaaccggtccggttacggtttaccgggaccgtaacccgggtttaccggtacgggtttcccgggttaacccccgggttaccccggttaaccccgggggg

SEQ ID NO: 232475 - DNA, 654 bp, Homo sapiens
  misc_feature: GYAE6OF02IGXWH.5.27.C05.1.454.CMB.1.raw
  modified_base (301)..(301): a, c, t, g, unknown or other
  misc_feature (301)..(301): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttccttgttgctattttaaaaggtgtccagtgtgaggtgcagttggtggagtctgggggaaccttggtccagcctggggggtccctgagactctcctgtgtagcctctgcgttcaccgtcagtagcaattacatgagctgggtccnccaggctccgagggtaaggggctggagtgggtctcgagtttatttagtagtcgtagtcggaaccgcaaccgacttcgacagacctccgcgacggggcaggtacttccaacctagtcctaccgagaacgaacctaaattacccaaagaacctaccctttaatccttacgaagtattacgaaccacgcccgtagaacggaacggacccggaacggtaccgtccgggtccttacggttacttaacgtttacgtacggtacgacggtaagtacggtaccgacgttacgggtacctcgggttacccagggttccgtaacggggtttccggttaccccggacccccggttaccgggggg

SEQ ID NO: 232476 - DNA, 717 bp, Homo sapiens
  misc_feature: GYAE6OF02JMYI0.5.27.C05.1.454.CMB.1.raw
  modified_base (292)..(292): a, c, t, g, unknown or other
  misc_feature (292)..(292): n is a, c, g, or t
  modified_base (440)..(440): a, c, t, g, unknown or other
  misc_feature (440)..(440): n is a, c, g, or t
  modified_base (624)..(624): a, c, t, g, unknown or other
  misc_feature (624)..(624): n is a, c, g, or t
tcagatcagacacgcacgaccggtgctcgatttagacgcgatcgagggtttggggctgggagaggagcccagcactgggattccgaggtgtttccattcagtgatctgcactgaacacagaggactcgccatggtagttgggctgagcgtgggttttcctgtgtacttagttttaaaggtgttccagtgtggtaggtgcgtagttggtgagtcgtgggggtaaccttggtccagccgtgggggtccctgagacgtctccgtgtgtacgtcctcgtcgtccgttacgaccgtntaagtacgtactaacgttactagtgacggccgttgggtacccgtccggacggccttaccggtacggtacgggtgaccggttgggacgttcggttaacgtacgttgttacgttatagggtacgactacggacctaccacgtacgtaccncgacgtacgtcggagacggtacactacgttccgactacgtctaccgaagaccgttaacaactacccttaacgtaacttccctttagtaccgtactaaacgactaaggtaccacggtacggtacggaaccgtcggaaccgtaccgggtaacttccccggttaaagtttaccgttcgtttaccggngttacggaccgtagtacccggttctaacgggaacgtttcgggcttacggcccgtaaaggttccgaccgggtttcccgggtccggaaacccggg

SEQ ID NO: 232477 - DNA, 699 bp, Homo sapiens
  misc_feature: GYAE6OF02HGY9G.5.27.C05.1.454.CMB.1.raw
  modified_base (355)..(355): a, c, t, g, unknown or other
  misc_feature (355)..(355): n is a, c, g, or t
  modified_base (378)..(378): a, c, t, g, unknown or other
  misc_feature (378)..(378): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccagtggtagtttgggctgagtcttgggtttttccttgttgcttaaagttttaaaaggttgtcctagtgtggaggtgcgtagttggtggtagtcggtacgggggtaaccttgggtccagtccggtcggggggtccctggacgactcctccgttgtacgtacgcctcgtcgtcgttacctaccgtccgtagtacgactaattacgatagacgcgtcggtccgaccgngccgtacgagggtagggcgtggnggtcggtcgtatagtttaattataggtacgtagtacggacctacgaacctaccgttacgcaacgaccgtaccggacggaggtacgagtactacgaccctacgtcctaaccgaagtaacgaactaaacgttaaccgaaaactaaccttaacccgttttactaccgttactaacgtaactaacggaacacggtccgtaagacggaacgccggaagtcccgtcggcttcgtacgtttactacgttagcggttagacggtaacttcgcgtaggtccgtacggtcaacgtcggttacggttcccggttaccggacccggtaccggg

SEQ ID NO: 232478 - DNA, 844 bp, Homo sapiens
  misc_feature: GYAE6OF02GGFEB.5.27.C05.1.454.CMB.1.raw
tcagatcagacacgcacgaccggtgctcgatttagacgcgatcgaagggtttgggctgggagaggagcccagcactggattccgaggtgtttccattcagtgatctgcactgaacacagaggactcgccatggagtttgggctagacgtcggtttcggttttccttgttcgtactttaaagtttaaaggtcgtccgtagtgtaggaggtcgacgtaggttggtacggtaggtcgggtacggggtaacctttcggccgacggtccgggttccgggggtccctaggacgtccttccgtccgttggtacgtaccgtcctcgttcgtacccggttccgaccccggttagtaacggtacgtaaccgttaaacttacgtaggtaggacggtccggtcccggtcccgaccggaacggtcccgtaaccgggaaggggtacgggtcggtaaggggtcgttcgggtcttacgtaagtttttacgtagccggagtacgtacggaaccgtcacttaccgtcgaacgtacgtaccgtaccggcggggacggactaacgttaccttaaccgaaccctacgtccccgtaacgaacgtaacgtaaacgttaacccctaaacgaaacccgtaaaccctttaccccgttttaacgttccgtaacgagtaaccgtaacgtaaccgtactacggttaacgacggaaccggtcggaaccgtacccggtcgtacgttacgttacgttaaccgttgtacggtacggacgttaacggtcgtaccgtacggttaccgtccggttaacccgtcgggacgttaccgggtacgggttacccggttacccccgggttccggtaaacccggggg

SEQ ID NO: 232479 - DNA, 810 bp, Homo sapiens
  misc_feature: GYAE6OF02IYOM5.5.27.C05.1.454.CMB.1.raw
  modified_base (329)..(329): a, c, t, g, unknown or other
  misc_feature (329)..(329): n is a, c, g, or t
  modified_base (361)..(361): a, c, t, g, unknown or other
  misc_feature (361)..(361): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcgttgggtttttccttgttgcttaagttttaaaaggtcgtccagtgtgaggtgcagttggtggagtcgtgggggtaaccttcgggtccaggtccgtgggggtccctggacgactctcctgtgtacgcctcgtcgtcgttccaccgtcgtagtacgacaattacagtgagtcgtcgggtccnccgaggccgtccgaaggggtacgggcgtgggnggtcgggttctcgtagtttacgtttaatggacgtaagtacggaacccacgaaccctaccgtttccgacgtaacgtaccgtacccggacggggtaccggggacgtaagttacgtttacccgacccgtaacttaccgtacccgaaggaaaccctaaaccgttaaacgttttaaaccccgaaaacgttaaaccccctttaaacccccgttttaactttaccttaaccgtaaagttaacgttaaccgaaaacccggtcgtacccgtaaggtaacggtaaccgggacccgtaaacggtaacccggttcggtacccgttaacgtttacccgttaacgtttacgttagtacccggaggttaccggtaacggtttaccgtacgggtccgtacggttaggtaccccggagtacccgggttagggttccccggttacccggccccgggttaaccggggg

SEQ ID NO: 232480 - DNA, 808 bp, Homo sapiens
  misc_feature: GYAE6OF02FIJJL.5.27.C05.1.454.CMB.1.raw
tcagatcagacacgcacgaccggtgctcgatttagacgcgatcgaagggtttgggctgggagaggagcccagcactggattccgaggtgtttccattcagtgatcctgacacgtagaacacgaggaggtacctccgaccagtggtaggttgggcgtgtagtcgtttcgggttttccgttgtgtactttaagttttaaaggtcgttaccgtagttgtggtaggtgacgttaggttgggtaggtacggttacggtacggggtaaccgttccggtcgaccggtccgggtccgggggtcccgtaggacgtaccttccgtccgttggttacgtccgtccttccgttcggtccgttaccgacccgtactacggtagaaccttaagttaaccagtagacgttcggtcggtacccccgacgacggtccctaccgggtaaggggtaacggtccggtagggtacggttcggttccgtaagttaacgttttaatttaacggacggcgtaagggtaccgaaccgtactaccgtaccgttacgccgtaacgtcccgcggaacggcggtacgaacgtacgtacccaacctacgtaccaccgtagaaacgtaaccttaacgtaaacccgtaacggtaaccctttaccgttacgttaccttagtaaacgtacaacgtaactacgacgttcggaaccgtacgggaccgtacggtaccgtgttccgtagtacttaacgtgtacgtacggacgttaggcctaacgtctacggtccgtagtaccggacggttcggtacggttaccggttacccgtcccggggtaccgg

SEQ ID NO: 232481 - DNA, 939 bp, Homo sapiens
  misc_feature: GYAE6OF02GXPJG.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcttgggttttccttgttgcttaagttttaaaaggtgtccagtgtgaggtgcagttggtggagtcgtggggaaccttggtccagccggtcgggggtccctggagacctcgtcctggtagtacgtcctctgtccgttccaccgtacgagtagactaattacatcggaagtcgtcgggtaccgccgacggtcctccgaagggtaacgggcgtgggagtacgggtcgtaacgttagtttaacttttacgtacgacgtagttacggaaacccgtcctaacgtacccgttaccggacgaaccggtaaccgtacccgggaaccggggaacggggggtaaccctaaacggttaaccgtttacccgtaaacccgttaacgtttacccgttaaacccgaaacgggttaaacccgtaaaacccgtttaaaccgttttaaccccgaaaaaaccggttaaaacccccgttttaaacccccctttttttaaaggtaaccccttttaaccgaaacggttaaaaccggttaaaacttaaacccggtaaaccggttacccgggttaaccgggaaaccgggaaccccgggttaaccccgggaaccggggttaaccccttcccgggtttaaccgtttaccgtttaaaccctttaacggttttaaaccgtttccgggtaacgggaccggtttaaccgggtaaacgtttccccgtaagggttacccggtcccggtttaacgggttcccaacgggggttcccgtaacgggggtttacccttacccccggggtaacccgggttcccccgggggg

SEQ ID NO: 232482 - DNA, 880 bp, Homo sapiens
  misc_feature: GYAE6OF02IL3XU.5.27.C05.1.454.CMB.1.raw
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagcttgggttttccttgtgctatttaaaaggtgtccagtgtgaggtgctagttggtggtagtcgtgggggtaaccttggtccaggtccgtcggggggtccctggacgtacttcctccgtggtgtacgtccttcgtcgtaccgttccgaaccgttcgtaacggtacgtaccgtaaacgttaacctagttacggaacgtccggttccggggttcccggcccgtaacggtcccgttaacccgggtaacgggggttaaaaccgggggtccgttacggggtcgggtttaccggggtttaccgttaccggttaaaggtttttaagttttaaacgtacgggtaaccggtaaggttaccgggtaaacccgtaacccgtaaccgttaaccggttccggtaccgtaaacggtaacccggttcccgggacgggtaaccggggtacgtaaccgttagtacccgtaacctacgttccgtacccgaaaggaaccgaaaccgttaattaacccgaaaagtaacccgttaacccttttagtaccgttacgtaacgttaacgtaacctaacgaccgtaccggtaagaccggtacggacccggtaacgtaccgtccgggtacttaccggttacttaaccggtttacgtacggtacggaccggttaagggtaacctccgtacggtcggttacggtaccgtacggtacggtaccgttaacggggttcggtcccccggttaaaccggggtccggg

SEQ ID NO: 232483 - DNA, 919 bp, Homo sapiens
  misc_feature: GYAE6OF02JJB14.5.27.C05.1.454.CMB.1.raw
tcagatcagacacgcacgaccggtgctcgatttagacgcgatcgaagggtttggggctgggagaggagcccagcactggattccgaggtgtttccattcacgtgatctgcactgaacacagaggactcgccatggagtttggctgagcgtgggtttcctgtgacttagttttaaaggtgtccgagtgtgaggttgcgtaggttcggtgggagtcgttagggggaacccttgggtcccaagggcccgtggggggttcccctggtacggacctcgttcccgtagtcggtagcccttctcggtcgttcgacccggtcaagtacgtaccgaattacgagttcgagtccgtacgggtcccgccgtacggtccgttccgagggtaaccgggcgttacgggtaaggtttcgggtaccgtaccgtacggttttaagtttaagtacggcggttacgtacggtaacccgttaccctaaccggttaaccgtttaccggaccgtaaggtacccgtacccgggtacggaaccgggggtacctaaggtacgtcccgtacccaacgttcccgtaccgaaacggtacggtaacccgttaaaccgttacccgaaacggtaaaccccgtttaacccgtttaaccggttacctttaccgaaacgtaaccggttaacgggtaaaaccaacccggttaccgttaaccggggtaaaccggtaccgttaccccgggtaacgtaacccggggtttccccggtacgttttaaccgggttacccgttaaacgttttcccggtacgggtttaccggtaaccggtaacggtttaaccggtacccggttaaaccgttccgggtaacccgttttacccccggtaccgttaacgggtcccggtttaaccggggtttaccggtttcccccggaacccgggttacccggggg

SEQ ID NO: 232484 - DNA, 779 bp, Homo sapiens
  misc_feature: GYAE6OF02H328A.5.27.C05.1.454.CMB.1.raw
  modified_base (175)..(175): a, c, t, g, unknown or other
  misc_feature (175)..(175): n is a, c, g, or t
tcagatcagacacgcacgaccggtgctcgatttagacgcgatcgaagggtttgggctgggagaggagcccagcactgggattccgagtgttccattcagtgatctgcactgaacacagaggactcgccatggagtttggctgacgctggtttccttgttgctaattttaaaaggngtacctagtgtggaggtggcgaggttcggtaggagtcgtaggggtaaccgttggtccacggtccgtcgggggttaccctggaacgacgttccgtaccgtggtacgtacgtcctacgtcgtacgttcaccggtctaaggtacgtactaaactacgtaagtagtacgtacgtcggttaccgccgtacgccgtaccgaagggttacgggacgttagggtaccggttacggggtacctacgtaagttttaactttaacgacggttaccgaagttcggaacccgtcgtaaccttacgtaccgacgtaacggacccttacggacggaaggggtaccaacgtacgttaccgaaccgtatcccgtaccgaaggtaacgtaactaacttaaaccgaaacgtaaaccctacccgtttaattaccgttcgaacgtataaccgaaaccgtacgtaccggtaacgaagtacccgacgggtaacctccgttaccgactttacggtaccttaagtaccgttaggtacggtaccgaaggtaaccttcgaaccggttgtacccgtcgttaccggagttccgggtaccggttacggttaccccggtccccgggttaacgggg

SEQ ID NO: 232485 - DNA, 829 bp, Homo sapiens
  misc_feature: GYAE6OF02FHJ2K.5.27.C05.1.454.CMB.1.raw
tcagatcagacacgcacgaccggtgctcgatttagacgcgatcgaagggtttggggctgggagaggagcccagcacgtgggattccgaggtgtttccattcagtgatctgcactgaacacagagactcgccagtggtagtttggctgagtcgttggttttccttgttgtacttaagttttaaaggtgtccagttgtgaggtgtcgtagttggtggtggtcggtacgggggtaaccttcgggtaccgacggtccgggtcgggggtcccgtaggacgtacctccgttcgtcggtgtacgtcccgtcgtcgttccgtacgtaccgtagtacgtagaccttaatactagttaggacgtccggtcggtcccggcgtaccgtccgtaccggtaagggtacgggtcggtagggtggtcggttcgttacgttagtttaagttaagtacggtaacgtacggtaccggtaacccgaccgtaccgttacgttaccgtaccgaaccgtacccggccgggacggggtaacgggacgtaaccgttactaacccgaccgtaacttccccgaacggtaagtaccgtaaactaaccgtaaccgaaaaccttaacccttaaccctttgttacctacacggtaaacttacgaccgtacgtccgtaaacgggacgtacgggtaaccgaggttaccgtccgtatttaccgtacgtttccgttaaccttgggtacgtagggtaacctttacggtaccggtacggttccccggttaattaaccgggtcccgtcggtaaacccggggttcgggtttaacccccgggttccggacccccggggtttacccgggg

SEQ ID NO: 232486 - DNA, 897 bp, Homo sapiens
  misc_feature: GYAE6OF02HX9FM.5.27.C05.1.454.CMB.1.raw
tcagatcagacacgcacgaccggtgctcgatttagacgcgatcgaagggtttggggctgggagaggagcccagcactggattccgaggttgtttccattcagtgatctgcactagaacacgaggaggacctcgccagtggtaggtttggcgtgagtcgtttggttttcgtttgttgtacgttaagttttaaaggtagtccgtagttggtggtaggtgtcgtaggttggtaggtaggttcggtacggggtaaccggttcggtccgacggtccggttcggggtcccgtcggtacgtaccttccgtgtccccccccccccccccccccccccgttgtacgtccgtcgttcgtccgttaccgtaccgtacgtaagtacgtactaacttaactagtagtagtcggttacgggtcccggaccgtacggaccgtaccggtaacgggtaacggggtcggttagggtacgggttcggttccgttacggttagttttaagttttaagttaacggtacggtaacggtaacggtacccgtacctaccgtaccgttaccgtaccgtaacgtacccgtacccggacgggaccgggaacgtacgtacttacccgtaacctagttacccgaccgtaagtaacgttaaacccgtaaccttaaaccaaaccggttaaaccccttaacccgttttacttacccgtttaaacaacgtaagtaccgaaaaccgtccgtaaccggtaggaaccggtaaccggaccggggtaacgtaccggtaccgtttcgttaacgttaccgttaacgttaccttagggaccgtcggaacgtacgttaccgtacggttcggttacccgtacggttccggtacggtaccgggtaccgggtttcccgtacccggtacccgggtacccgggg

SEQ ID NO: 232487 - DNA, 708 bp, Homo sapiens
  misc_feature: GYAE6OF02G23QJ.5.27.C05.1.454.CMB.1.raw
  modified_base (424)..(424): a, c, t, g, unknown or other
  misc_feature (424)..(424): n is a, c, g, or t
tcagatcagacacgcacgaccggtgctcgatttagacgcgatcgaagggtttggggctgggagaggagcccagcactgggattccgaggtgtttccattcagtgatcctgcactgaacacagacggactcgccatggagtttgggctgagtcgttgggttttcctttgttgtcttaattttaaaaggtgtccagtgtgaggtgcgtagttggtggagtcgtgggggtaaccttcggtccgacgccggtgggggtccctgacgactcctctgtgtacgtcctcgtgtcgttcaccgttcgagtacgtactaattactagagtagtcgtcgggtcccgccgacggtccgtaccggtaggggtacggggcgtaggggtaggtcgggtcttacgttagttttacgttatacggtacgagtacggaacnccgtactaccgttacgaccgtaacgtaccgtacccgggacgggacggggctaacgtacgtttacccgaccctaactccgtaacccgaaggttaaccgaactaaccgttaaccaaaacgtaccctttaaccctttacttacgttaccgaagtacctaacgacctacgcctaggacgacggtccggaacgtcggcctagttccgttactagttcgtgtacgcggactcgtagccgttcgcgtcggtctaggccggttagggtaccggtacccgtcccgggtacggg

SEQ ID NO: 232488 - DNA, 683 bp, Homo sapiens
  misc_feature: GYAE6OF02INVBA.5.27.C05.1.454.CMB.1.raw
  modified_base (335)..(335): a, c, t, g, unknown or other
  misc_feature (335)..(335): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttgggctgagctgggttttcctgttgctatttaaaggtgtccagtgtgaggtgcagttggtggagtcgtgggggaaccttggtccagccgtgggggtccctgagactctcctgtcgtagcctctgtcgttcaccgtcagtagactaattacatgagtcgtgggtcccgcaggtcctacgagggtaaggggtctgggnggtcgggtctcgtagttaactttaaacgcgtagtcggaaccgcacgtacttcgactacgacgtccgcggaggggcaggtacttaccaccgtatccgtaccgaagtacgaactaacgttaccaaaacgtaaccctacccttttaactaccgttacgaagtacttacgaaaccgacgtacctacggtaacggaccgtacccggaacgggtaccgtccgggtcttacgggttccttaagttaccggtgtacggtaccggaaggttacggtactacggttcgggccgttcgggtacccaggtacggtcgggtttaccggtacccggtaccccggggtcgggtaaccccgggg

SEQ ID NO: 232489 - DNA, 682 bp, Homo sapiens
  misc_feature: GYAE6OF02F7YC6.5.27.C05.1.454.CMB.1.raw
  modified_base (180)..(180): a, c, t, g, unknown or other
  misc_feature (180)..(180): n is a, c, g, or t
  modified_base (261)..(261): a, c, t, g, unknown or other
  misc_feature (261)..(261): n is a, c, g, or t
  modified_base (369)..(369): a, c, t, g, unknown or other
  misc_feature (369)..(369): n is a, c, g, or t
  modified_base (384)..(384): a, c, t, g, unknown or other
  misc_feature (384)..(384): n is a, c, g, or t
  modified_base (645)..(645): a, c, t, g, unknown or other
  misc_feature (645)..(645): n is a, c, g, or t
tcagatcagacacgcacgaccggtgctcgatttagacgcgatcgaagggtttggggctgggagaggagcccagcactgggattccgaggtgtctccattcagtgatctgcactgaacacagaggactcgccatggagtttggctgagctgggttttccttgttgcttattttaaaaggtntccagtgtgaggtgcagttggtggagtctgggggaaccttggtccagccgtgggggtcctgagactctcctgtgtagcctntgtcgttccaacgtcagtacgctaattacattgacgcgtcggtaccgctagggcttaccgaaggttaacggggctgggtagtaggggtcctagtagttaatttagtancgtaatcgggaaccncacgtacgttcgacaacgtaactccggacgagggggactacggacttacactactcgtaccagtaagtactaaacttaccgaaacaacccgtaacccttttataccttaaccgtaagtacttaacggaaacacggacccgttaacgacgggaacgtaccgggaacggtaacccgtaaccgggtcgtacggttaccctaagtttaccgtggttacggacggtaaacggtagtccgtaacgttacggtcgtacggttaaccgnggttccggtaggttccggttacccggtaaccccgggg

SEQ ID NO: 232490 - DNA, 707 bp, Homo sapiens
  misc_feature: GYAE6OF02GB7GC.5.27.C05.1.454.CMB.1.raw
  modified_base (163)..(163): a, c, t, g, unknown or other
  misc_feature (163)..(163): n is a, c, g, or t
  modified_base (178)..(178): a, c, t, g, unknown or other
  misc_feature (178)..(178): n is a, c, g, or t
  modified_base (314)..(314): a, c, t, g, unknown or other
  misc_feature (314)..(314): n is a, c, g, or t
  modified_base (322)..(322): a, c, t, g, unknown or other
  misc_feature (322)..(322): n is a, c, g, or t
  modified_base (621)..(621): a, c, t, g, unknown or other
  misc_feature (621)..(621): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttggctgagctgggttttcctgttncttatttaaaaggtntccagtgtgaggtgctagttggtggagtcgtcgggggaaccttggtccaggccgtgggggtccctgacgactctccgtgtgtacgtcctctgcgttcaccgtgagtagactaattacatgagtcgtcgggtacccncgaggtcnccggtaggggtaacgggtcgtagggacggtttcggggtctacgtagttttacttagtacggtcgagttacggaaacctcgaacaccgtttcgaactacggtaccgtccgtacgggaacggggtccaaacggtacgtttaccgaaccttacgtacccgttacccgaagtacggtaacctaaacgttacccgaaagtaaccccttaccgtttacttgttacgaacttaactacggaactaccggtctaggaacgtacggccgtaaggtaccgtacggtcttacggtcttaaggtttaccgnggtacgtagtacggtacgtgtaccggtgtaccggtggtcccgtaggttccgtaaggggttccggttcccggacccggttaacgggg

SEQ ID NO: 232491 - DNA, 727 bp, Homo sapiens
  misc_feature: GYAE6OF02FJUOK.5.27.C05.1.454.CMB.1.raw
  modified_base (283)..(283): a, c, t, g, unknown or other
  misc_feature (283)..(283): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttggctgagctgggttttccttgttgctatttaaaaggtgtccagtgtgaggtgcgagttggtggagtcgtgggggaaccttggtccaggtccgtcggggggtccctggacgactccgtcctgtcgtacgccgtctcgcgttccnccgtcagtacgctaattacagtcgagcctgggcccgaccaggcctacggaagggtaacggggcgtggaacggttgggctacgtagtttaattttagtacggacgtatacggaaccgtccacgtaccgttcgactacgaccgtccggacggtaacgggggctagtacttaccgaacctaatcccgtaaccgagaaacgaacttaaacttaacccgaaaggtaaccctaaccctttagttacccttacaacggttacacgtaaacacgtcctagaacggaccgtacggacggttaccgtccggtaccgtacgttaccgttaacgttttacgcggttacggtacgtaacgggttaacgaccgttaacggtcggttacccgtcggtacccgttcggtaaccggttaggggttaccccggttaccccggacccgggtttaaccccgggg

SEQ ID NO: 232492 - DNA, 705 bp, Homo sapiens
  misc_feature: GYAE6OF02GNG47.5.27.C05.1.454.CMB.1.raw
  modified_base (320)..(320): a, c, t, g, unknown or other
  misc_feature (320)..(320): n is a, c, g, or t
  modified_base (340)..(340): a, c, t, g, unknown or other
  misc_feature (340)..(340): n is a, c, g, or t
  modified_base (365)..(365): a, c, t, g, unknown or other
  misc_feature (365)..(365): n is a, c, g, or t
  modified_base (381)..(381): a, c, t, g, unknown or other
  misc_feature (381)..(381): n is a, c, g, or t
tcagatcagacacgcacgaccggtgctcgatttagacgcgatcgaagggtttgggctgggagaggagcccagcactgggattccgagtgtttccattcagtgatctgcactgaacacagaggactcgccatggagtttgggctgacgcgttgggttttccttgttgccttaattttaaaaggtgtccagtgtgaggtgctagttggtggagtcgtagggggaaccttggtccagtccgtcggggtccctgagactctccgtagtgtacgtcctctgtccgttcaccgtcagtacgctaattacgatgacgcgtggtcccncgacgctaccgaggtacggntggagtcggtctcgtagtttattanagcgtagtcggaaccnctactacgtcgcgacgacgtcggacgagggacagtacttaccaccgtatcccgtacgaacgtacgaactaaccgttaccgaaacgtaaacccgttacccctttacgtacctttaaccgacgttaacgtaccgaaaccgtaccgaccgttaggaaccgggcggtaacccggtacggaccgttaccgggtccttacggttaccttaacgttacgtcggtacgtccggtaaacggtacggtaccctacgggttaccgttaccgtaccggtaccgacggtaccggttaacggggttcccggttaccccggccccgggttaccccgggg

SEQ ID NO: 232493 - DNA, 705 bp, Homo sapiens
  misc_feature: GYAE6OF02JBI0C.5.27.C05.1.454.CMB.1.raw
  modified_base (538)..(538): a, c, t, g, unknown or other
  misc_feature (538)..(538): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccaatggagtttggctgagtcgttgggttttccttgtgcttaagttttaaaaggtgtccagtgtgaggtgcgtagttggtggagtcgtagggggaaccttcggtccagtcccggtgggggttccctggacgtacctctcctggtgtacgcctctgtccgttccaccgtacagtacgtctaaatttacgatggaacgtacggttcgggtccgaccgtagggtccctaccggtaaggggtaacggggtccgtagggtacggtccgggttctacgtaggtttatttacgagcgtagtaccggaaccgtcacttacgttcgactaacggacgtaccggcggacggggcagtactacgactactccacgagaactaacgaacttaccgaaataccttaccctttgtacccttanacgtaacgcgtaaacacggctaggtaaccggcgaacgacgtacgtacggtccttacgttaaccgttactttacgtggtacgtccgtaaggtccgtaccttacggtcggacccgttaggtaccacggtaggttaccggttcccggtaccccggtaccggtacccgggg

SEQ ID NO: 232494 - DNA, 759 bp, Homo sapiens
  misc_feature: GYAE6OF02GT646.5.27.C05.1.454.CMB.1.raw
  modified_base (212)..(212): a, c, t, g, unknown or other
  misc_feature (212)..(212): n is a, c, g, or t
  modified_base (349)..(349): a, c, t, g, unknown or other
  misc_feature (349)..(349): n is a, c, g, or t
  modified_base (353)..(353): a, c, t, g, unknown or other
  misc_feature (353)..(353): n is a, c, g, or t
  modified_base (366)..(366): a, c, t, g, unknown or other
  misc_feature (366)..(366): n is a, c, g, or t
tcagatcagacacgcacgaccggtgctcgatttagacgcgatcgaagggtttggggctgggagaggagcccagcacgtgggacttccgaggtcgtttccattcagtgatctgcactgaacacagacggactcgaccagtggtagtttcgggctgagtcgttgggttttccttgttgtcttaagttttaaaggtcgtcgagtgtgtaggtcgngtagttggtcggtacgtcggtacgggggtaccttcgggtaccgacgggtcccggtcggggggttccctcggaacgtccttcgtccgtcgtagtacgtcctcgtcggtccgttcccacgtacagtcgaataacgttanatgngtccgtggacccncggacgtcgcggtaggtacgggccggtaggtcggtaggtctacgttagtttagttagtcgtacgtacgtcggaaccctccgtactcgtaccgacgacggttaccgcggtacggaggtaccgacgtccgtaacggtaccttacccggtaccgtacgtaaccgaaacgttaacccgtaaaccttaacccgtaaaacgttaccccttttaaccttaccgttactaccgtaataagggtaaccacccgtaggtaccgaggtaacgtacccggacggtaacgtccgggttacgttacctacgttcgttaaccgttggtacgcgtaacggcgttgaccgttcgggtcgtaaccgtcggaagccggttaggtccggtaacccgcggttaccggacccggg

SEQ ID NO: 232495 - DNA, 818 bp, Homo sapiens
  misc_feature: GYAE6OF02HVIR6.5.27.C05.1.454.CMB.1.raw
  modified_base (164)..(164): a, c, t, g, unknown or other
  misc_feature (164)..(164): n is a, c, g, or t
  modified_base (259)..(259): a, c, t, g, unknown or other
  misc_feature (259)..(259): n is a, c, g, or t
  modified_base (268)..(268): a, c, t, g, unknown or other
  misc_feature (268)..(268): n is a, c, g, or t
  modified_base (277)..(277): a, c, t, g, unknown or other
  misc_feature (277)..(277): n is a, c, g, or t
  modified_base (785)..(785): a, c, t, g, unknown or other
  misc_feature (785)..(785): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttggctgagctgggttttccttgttncttattttaaaaggtgtaccagttgtgaggtgcagttggtggtagtcgtggggaaccttggtccaggccgtgggggtccctgagactctcctagngtacgcctntgcgttccnccgtcagtacgcaattacatgagtcgtacgggtccgaccgacggcctccgtaagggtaacgggctcgggtagtcgggttcctacgtaagttttacgtttaacgtacggtacccgtaagttaccgggtaacccctaccgaacccgttaacgtttaccccggcgtaaacggtaacccggttaccccgggacggggtaaccgggggaccgtaacggtaaccgtttacccgaaccccggtaacgtttaccccgttacccgaaaagggttacggaaacccttaaaccttaaccccgaaaaccgtaaacccctttaaacccgtttttaacttaccgttaccgtaaagtaacggttaccgtaaaccgacgtcccgtaagggtaaaccggaacggttacccggaaggtacccgtacccgggtctttaaccgtacgtttaacgttaccgttcggacgttaacggtacggtaacgttcccgtacggttcgggtacccgtaggtcccgagtaacccggngggtttacccggtcccggtaccccggtccgggg

SEQ ID NO: 232496 - DNA, 715 bp, Homo sapiens
  misc_feature: GYAE6OF02GNORX.5.27.C05.1.454.CMB.1.raw
  modified_base (290)..(290): a, c, t, g, unknown or other
  misc_feature (290)..(290): n is a, c, g, or t
  modified_base (314)..(314): a, c, t, g, unknown or other
  misc_feature (314)..(314): n is a, c, g, or t
  modified_base (547)..(547): a, c, t, g, unknown or other
  misc_feature (547)..(547): n is a, c, g, or t
  modified_base (551)..(551): a, c, t, g, unknown or other
  misc_feature (551)..(551): n is a, c, g, or t
  modified_base (556)..(556): a, c, t, g, unknown or other
  misc_feature (556)..(556): n is a, c, g, or t
  modified_base (561)..(561): a, c, t, g, unknown or other
  misc_feature (561)..(561): n is a, c, g, or t
tcagatcagacacgcacgaccggtgctcgatttagacgcgatcgaagggttggggctgggagaggagcccagcactgggattccgaggtgtttccattcagtgatctgcactgacacagagactcgccagtcggtagttggtctggtagtcgttcggtttcttgtgtcttaagttttaaaggtgtccgagtggtgacggtgacgtggtggtggagtcggtaggggtaccttggccacgcgtcggggtcctagacgtcgtctccgtgtcgtacgccttcgaggtcctaccncgtcgtagtactacgtactacgtntacggacgtcgtcgggccctacgaggccctggtaacggggaacggttcggtaggttaggtacgggttcctacggttaagtttagtttacggacggtaccggttaaacgtacgggaaccccgtagtaacctccgttccggaactccggaaccccgttccggaaacgggtcgggaacgtacgtaactcaacgtctcgtaacagtacgactactacacgtaacctcttacacttanatanaacgntaacnggttagaccacggcgtacgacgtacgtaacttcggaactttacgtacgcggttaccaagggtcctaaccggtttcaccggtttcgggaacgttaccgaccggttaagggtccccgtaggggttaccccgttccggtaccccgggtaaaccgggg

SEQ ID NO: 232497 - DNA, 724 bp, Homo sapiens
  misc_feature: GYAE6OF02JF5DL.5.27.C05.1.454.CMB.1.raw
  modified_base (269)..(269): a, c, t, g, unknown or other
  misc_feature (269)..(269): n is a, c, g, or t
  modified_base (358)..(358): a, c, t, g, unknown or other
  misc_feature (358)..(358): n is a, c, g, or t
tcagatcagacacgcacgaccggtgctcgatttagacgcgatcgaagggtttggggctgggagaggagcccagcactgggattccgaggtgtttccattcagtgatctgcactgaacacagaggactcgccatggagtttggctgagctgggtttcctgtgctatttaaaggtgtccagtgtgagtgcagttggtgagtcgtggggacttggtcagcgtcggggtcctgacgactctccgtgtcgtagcctcgtgtcggttccaccgtnacggtacgactaagttaccagtgtagcgtcgggtccgccgaggtcctccggagggtacggcgtagggaggtggtctcgtagttattagngtagagtacggaccgactcgtaacttccgactacggtaacctcccgggacggtacggggtcctaaacggtacgttaaccgacccgtacttaccgttacccgaaggttaaccgtaaacccggtaaacgttacccgaaaacgttaaacccgttaccccgttttaacttacccgttaaacgtaacgtacgttaaccgtaaacgtaccgtaacgttccggaaacgtacccggtaccgggtaaccggtaaccgtccggtacttaccggttacttaaccgtcgttcgtaggtcgacggtaccgtgtaaccgtcggtaccgtacggtaccgacggttacggtaggttaccgggtcccgtacccgggtaccggg

SEQ ID NO: 232498 - DNA, 487 bp, Homo sapiens
  misc_feature: GYAE6OF01CY5C9.45.45.E01.1.454.CMB.1.raw
  modified_base (404)..(404): a, c, t, g, unknown or other
  misc_feature (404)..(404): n is a, c, g, or t
  modified_base (444)..(444): a, c, t, g, unknown or other
  misc_feature (444)..(444): n is a, c, g, or t
  modified_base (474)..(474): a, c, t, g, unknown or other
  misc_feature (474)..(474): n is a, c, g, or t
  modified_base (476)..(487): a, c, t, g, unknown or other
  misc_feature (476)..(487): n is a, c, g, or t
tcagacgcgatcgacacgaccggtgctcgatttagtgagtcagtaagggaaagggagagtggagactcagtctccattctccctgcccgtcacccttggacagccggcctccatctcctgcaggtctagtcaaagcctcctatacagggatggaaacactcacttgaattggtttcaacagaggccaggccaatctccaaggcgcctaatttataaggtttctaaccgggactctggggtcccagacagattcagcggcagtgggtcaggcactgatttcacactgaaaattagtaggtggaggctgaggatgttggagtttattctgcatgcaaaggtacacactggccgtacacttttggccgaaggggaccaaggctaggaaatcaaaacgaactgtggcngacaccatctgtctcattcttccgccatctgatcgatcgntcgtgagcgggctgggcaaggcgacatagntnnnnnnnnnnnn

SEQ ID NO: 232499 - DNA, 591 bp, Homo sapiens
  misc_feature: GYAE6OF01DB7FY.45.45.E01.1.454.CMB.1.raw
tcagacgcgatcgacacgaccggtgctcgatttagtgagtcagtaagggaaagggggatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctacctatacagggataggaaacactcacttgaattggttacaacagaggccaggccaatctaccaaggcgaccttaaatttataaggtttctaaccgggtactcgtggggtcccagacagattcagcggcaggtgggtcaggcactgtatttcacactagaaaagttaggtagggtaggaggcgtaggaagggtagttaggtttagggtagttttagtttctgtactagtgtacgtaaggttacaacgtacgtggaccgtacgtacgttttcggaccgtaggggtaccaagacgtaggaaatacgaaaacgtaacgtggtaggactgaccacatctacgttacttcactccgttaccccg

SEQ ID NO: 232500 - DNA, 630 bp, Homo sapiens
  misc_feature: GYAE6OF01D7VCB.45.45.E01.1.454.CMB.1.raw
  modified_base (613)..(615): a, c, t, g, unknown or other
  misc_feature (613)..(615): n is a, c, g, or t
  modified_base (617)..(630): a, c, t, g, unknown or other
  misc_feature (617)..(630): n is a, c, g, or t
tcagacgcgatcgacacgaccggtgctcgatttagtgagtcagtaagggaaagggagagtggagactcagtctccactctccctgcccgtcacccttggacagccggcctccatctcctgcaggtctagtcaaagcctcctatacagggatggaaacactcacttgaattggtttcaacagaggccaggccaatctccaaggcgcctaatttataaggtttctaaccgggactctggggtcccagacagattcagcggactaggtggtcgaggcacgtgtactttcaactacgtaagtaaaagtttaggtaggggtaggaggtctagggaaggtattgggttagggttagtttttatttcgtgtactagtcgacgtaaaggtacaactacgtcggtaccgtacttacgttttcggaccggaacggggaaccaaggtcgtaaggaaactacgaaaacgtaacgtggtacggacgtcgaccaacctattcgtcgtttccttactacttccccgttccccgaccttacttcgtagtacgtaccgtacgttccggtccgttcgtgggacgggtcccgggtcgttcgggacggtaacgggccgacgtagtacggatgnnngnnnnnnnnnnnnnn

SEQ ID NO: 232501 - DNA, 547 bp, Homo sapiens
  misc_feature: GYAE6OF01D04JR.45.45.E01.1.454.CMB.1.raw
  modified_base (540)..(540): a, c, t, g, unknown or other
  misc_feature (540)..(540): n is a, c, g, or t
tcagacgcgatcgacacgaccggtgctcgatttagtgagtcagtaagggaaaggggtgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcctatacagggatggaaacactcacttgaattggtttcaacagaggccaggccaatctccaaggcgcctaatttataaggtttcaaccgggactcgtgggtcccagacagattcagcgcagtggtcaggcactgatttcatactagtaaaattagtagggtggaggctagaggtatggttggtagttttatttctgcagttgacaaggtacacaacgtggaccgtactacgttttcggaccaagggggaccaagctaggaaattacaaacggtaactggtaggctgacaaccattctagttccttcncgttccc

SEQ ID NO: 232502 - DNA, 642 bp, Homo sapiens
  misc_feature: GYAE6OF01EKR7K.45.45.E01.1.454.CMB.1.raw
tcagacgcgatcgacacgaccggtgctcgatttagtgagtcagtaagggaaagggggatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcctatacagggataggaaacactcacttgaattggtttcaaacagaggccaggaccaactctaccaacgggcgtaccttaatttaataacggtttacctaaccgggactcgtgggtacccagacagattcagcgcagtggtcaggcacgtgtacttacgactactagtaaaagttaggtagggtaggagtcgtaggaggtattggttaggtagtttatttcgtgtactagtgtacgtaaaggttaccaacgtacgtacgggaccgttacgtacgttttacgggaccggttaacggggaaccaaggtccgtaaggtaaacgtaccgaaaaccggtaccgttaggtagggaccttaggaccctaccttaagtcccgttacgttaccgtttcctaacgttcccgttacccccg

SEQ ID NO: 232503 - DNA, 692 bp, Homo sapiens
  misc_feature: GYAE6OF01C5JOO.45.45.E01.1.454.CMB.1.raw
  modified_base (260)..(260): a, c, t, g, unknown or other
  misc_feature (260)..(260): n is a, c, g, or t
tcagacgcgatcgacacgaccggtgctcgatttagtgagtcagtaagggaaaggggtgatcaggactccccagttcaccttctcacaatgagcctccctgctcagctccgtggggctgctaatgctcgtgggtcccaggatccaggtggggatgttgtagatgactcatcctccactccgtccctcgcccctctacccgtggaccacggcccgacctccatcctcctggactaggtactaacgacaaacgtcctactaanacgagggaatacggaaacactctaattgtaagttcggttaacaagagacgcacgacaactcaccaaggactacttaaagttataacggtttcgaaccggctcggtaccggaccagaacagtatcgaaggcgacgaaggtcggacaggtacagttgtacttacaacgtaagtaaagtaaagttggagggtaggtaggagtggtaaggtagttggttaggttacgtttattacgtagtactaagtacggaacgttaacgtacgaaccgtacgtacgggtaccgttaacgttacggtttcgggaacgttaacggggaacccgaaggtaccgtaaaggaaaacgtacgtaaaaccggtaggttaccggtaggtaccgtacggaccctaacgaacgttccgttaaacgttcttaccttacccgttccgttaaccccg

SEQ ID NO: 232504 - DNA, 807 bp, Homo sapiens
  misc_feature: GYAE6OF01CNPJV.45.45.E01.1.454.CMB.1.raw
tcagacgcgatcgacacgaccggtgctcgatttagtgagtcagtaagggaaagggggatcaggactcctcagttcaccttctcacaatgaggctccctgctcagctcctggggctgctaatgctctgggtcccaggatccaggtggggatgttgtgatgactcagtctccactctccctgcccgtcacccttggacacgccggcctcatctcctgcaggtctagtcaaagcctcctatacgagggataggaaacactcattgatttggttacaacagacggcaggaccaatcctaccgaaggcgtaccttaaagtttaacgtaacggttttaccgtaaaccgggacttaccggtacggggtaccccaaggtaccaggtaactttcgaacggcggacgtaggggtacgggtacgacgggtacctacgttacggtacttttaccgaaacgttaacgttaaaggtaaaaagttttaagggtaacggggggttagggaagggtaccggttaagggtaaggggttaagttacggggtttttaaggggttaaagttttttaacgtttccgtttaggtaccgttaaggttacggtaacccgtaaaggggtttaacccaaccggttaaccggttacgggttacccgttaaccggtttaaccggttttacgggtaacccgggtaacgggggaacccgaaggtaccgttaaagggtaaaactaaaccggaaaacggtaacgtacgggttaggacgttacggaccctaaccgtacgtttccgttcgttacctttacctccgtttacccgttacccccg

SEQ ID NO: 232505 - DNA, 481 bp, Homo sapiens
  misc_feature: GYAE6OF01DJV06.45.45.E01.1.454.CMB.1.raw
  modified_base (454)..(454): a, c, t, g, unknown or other
  misc_feature (454)..(454): n is a, c, g, or t
  modified_base (472)..(481): a, c, t, g, unknown or other
  misc_feature (472)..(481): n is a, c, g, or t
tcagacgcgatcgacacgaccggtgctcgatttagtgagtcagtaagggaaagggagagtggagactcagtctccactctccctgcccgtcacccttggacagccggcctccatctcctgcaggtctagtcaaagcctcctatacagggatggaaacactcacttgaattggtttcaacagaggccaggccaatctccaaggcgcctaatttataaggtttctaaccgggactctggggtcccagacagattcagcggcagtgggtcaggcactgatttcacactgaaaattagtaggtggaggctgaggatgttggagtttattctgcatgcaaggtacacactggccgtacacttttggccaggggaccaagctaggaaatcaaacgactagtggctgcacatctgtcttctatccttcccgcatctgatcgatcgcgtctgacgcggtcgnggtcaaggcgacgatagnnnnnnnnnn

SEQ ID NO: 232506 - DNA, 645 bp, Homo sapiens
  misc_feature: GYAE6OF01D8BGD.45.45.E01.1.454.CMB.1.raw
  modified_base (363)..(363): a, c, t, g, unknown or other
  misc_feature (363)..(363): n is a, c, g, or t
tcagacgcgatcgacacgaccggtgctcgatttagtgagtcagtaagggaaaggggtgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcctatacgaggggataggaaacactcacttgaatttggtttacaacagagccaggccaatctccaaggcgtacttaatttataaggtttctaaccgggactcgtcggggtcccagacagattcgagcggnaggtggtcaggcatgatttcactactaagtaaagttaggtagggtggaggcgtaggagtagttggttaggtagttttagtttcgtgtactagtaggacgtaaaggtacacgtaccgtggtaccgttacgttaccgttttacgggacccgtaacggggaaccgtaacggtacgttaaacgggtaaaacgtaaccgaaaaccggtaacgttagggttacggtcgttacggaaccgtaacccgtacgttacccttcggtttacctttccgtaccgtttacccccg

SEQ ID NO: 232507 - DNA, 585 bp, Homo sapiens
  misc_feature: GYAE6OF01EP4HI.45.45.E01.1.454.CMB.1.raw
tcagacgcgatcgacacgaccggtgctcgatttagtgagtcagtaagggaaaggggtgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcctatacaggggatggaaacactcacttgaattggtttacaacagaggccaggccaatctaccgaaggcgtacctaatttataaggtttctaaccgggtactcgtgggtcccagacagattcagcggcaggtgggtcaggcacgtgactttcacactagtaaattaggtagggtggaggctaggagtagtggttggtagttttattcgtgctagtagacgtaaggtacacgacgtggtacccgtataacgtttcggaccgtaggggaccaaggcgtaggaaactacgaaacgtacgttggtacggcttacggaccctaccgtattaccgttagttccttcgtccgttacccg

SEQ ID NO: 232508 - DNA, 832 bp, Homo sapiens
  misc_feature: GYAE6OF01A9EEU.45.45.E01.1.454.CMB.1.raw
tcagacgcgatcgacacgaccggtgctcgatttagtgagtcagtaagggaaagggggagtcaggactcctcagttcaccttctcacaatgaggctccctgctcagctcctggggctgctaatgctctggtcccaggatccagtgggatgttgtgatgactcagtctccactctccctgcccgtcacccttggacacgccggcctccatctcctgcaggtctagtcaaagcctcctatacagggatggaaacactcacttagaattggttacaacgagacggccaggccaatcctaccgaaggtccgtaccttaaattttagtaacgggttttaccgtaaaccggggtacctcgtacgggggttaccccaaggtacctaaggtaacttcgaaggccggtacgtagggttcggggtaccgaagggtcctaacgttagaacttttacgaaccgtacgttaacggtaaaaagtttagggtaacggggttagggtaacgggtacgttacgggtaaaggggtaacggtttagggtttaggggtaaggtttttaacgttttacggttacggttaccgtaacgttacggtaccggtaaacgggttaaccgtaaccgtaaccggttacgggtaacccggttaaccgtttaacccgggtttttacggggaaccccggttaaacgggggtaacccgtaaacgggtaccggttaaacgggaaaaccgttaaaccgaaaaccggtaaaccggttcgggtacgggtaccggttcggtaacccgtaacccgaacgtttaccgttaccggttaccgtttaccgttaaccgttccccgtttacccccgg

SEQ ID NO: 232509 - DNA, 712 bp, Homo sapiens
  misc_feature: GYAE6OF01EV99O.45.45.E01.1.454.CMB.1.raw
  modified_base (278)..(278): a, c, t, g, unknown or other
  misc_feature (278)..(278): n is a, c, g, or t
  modified_base (334)..(334): a, c, t, g, unknown or other
  misc_feature (334)..(334): n is a, c, g, or t
tcagacgcgatcgacacgaccggtgctcgattttagtgagtcagtaagggaaagggagagtggagacctcagtctccactctccctgcccgtcacccttggacagccggcctccatctcctgcaggtctagtcaaagcctcctatacagggatggaaacactcacttgaattggtttacaacagaggccaggccaatctccaaggcgcctaatttataagttctaacgggactcgtgggtcccagacagattcgagcggcagtggcaggcatgtattnacactagaaattagtaggttggaggtcgtagagagtgtttggagtttatttctgtntactgtcgtaaggtacaacacgtggaccgtaactaccgtttttaggacccgtaacggggacccaaaggccgtaaggaaacttaaacgaaaaccgtaaacgtcggtacggtacgttacgaccgtaacccgtaacttcgtacgggttaccttcgaacgtttcccgttcccgaaccctaacttcgtaccggttaacgtttaccggtaactttccgggtttaccgtacgggtacgggtaaccggggtccgtacgggtaccgtaaacggggtccgtaaccggttaacggttaccgggttaaagtacggtactacggtacgtacggtcggtactacggtacgtacgtacggtacgttacggtacgtacgtacgtacgtacgtcg

SEQ ID NO: 232510 - DNA, 847 bp, Homo sapiens
  misc_feature: GYAE6OF01DWDVO.45.45.E01.1.454.CMB.1.raw
tcagacgcgatcgacacgaccggtgctcgatttagtgagtcagtaagggaaagggtgatcaggactcctcagttcaccttctcacaatgaggcctccctgctcagctccgtgggctgctaatgctcgtcgggtcccaggatccgaggtggggatgttgtgatgactcgagtcctacctacttcctcccgtcgtcccgtacctaccccgttggaccgacggccccggtaccctacctacttccctccgtacggaccgtaggtaccttaacgtaaccgaaaccgtcccttaaccgttaacgtaaccggaaggggtaactaacggtaaaaccctactacctaaccgtttagtaagtttcggttaaccaaacgtacggacggccgaacggaccctaactaccgtaacccgaagggtaccgtaacttttaaaacgtttaacggttaaaccgggtttacccgtaaccgggtaccgttcgggtacggggtaccccaaggtacgtacggtaacttcggacggacggtacgtcggtcgggtacacgggtcctagtagtacttacgaactaacttaagtaaagttacgggtagggtaggaagtacgtaggtaggtaacgttgggttaagtttacgtttacgtttcgacggtatacgtagaacgttaaccggactaacgtacgggtacgtaacccggttacgttaccgggtttaccggaccgggtaacggggtaacctaacggtaacggttaaacggtaaaacctaaccggtaaaacgtacggttagggtaccgtaacggtaccgtaaccctaacgttacgttaccttacgttacccgttacctcccgttaaccccgg

SEQ ID NO: 232511 - DNA, 779 bp, Homo sapiens
  misc_feature: GYAE6OF01EH0JM.45.45.E01.1.454.CMB.1.raw
tcagacgcgatcgacacgaccggtgctcgatttagtgagtcagtaagggaaaggggtgatcaggactcctcagttcaccttctcacaatgaggctccctgctcagctcctggggctgctaatgctctgggtcccaggatccagtggggatgttgtgatgactcagtctccactcctccctgcccgtcacccgttggacacgccggcctccatctcctgctaggtctagtacaaacgcctactatacgagggataggaaacactactacgttagaagtttcggtttacaactaggacggtccgaaggaccaaattccgtaccgtaacgggaccgtaaccctttaaagttttaacgtaaacgggttttccgtaaaaccgggtaccttacggttaccggggtaccccaaggtaacctaagtaacttacgaacggccgggtaccgtaagggttccggggtacgacggggtacctaacgttagtaacgttttccaaacgttaacttaaggtaaaacgttaagggtaagggtacgggtaaggtcgtagggtaaggtagttaggttaggttacgttttagtttacgtcgtacgtagtacgtacgtaacggttaactaacgtacgtacggtacccgtacgttaccgttttacgggaccggtaacgggaaccgtaacggtacgtaacgggtaaaccgtaaacgtaaaaccggtaacgttacggtacggtacgtacgtaccgtaacccgttagttaccgttacgttacccttacgtacgtttacccccg

SEQ ID NO: 232512 - DNA, 704 bp, Homo sapiens
  misc_feature: GYAE6OF01D5KPV.45.45.E01.1.454.CMB.1.raw
  modified_base (412)..(412): a, c, t, g, unknown or other
  misc_feature (412)..(412): n is a, c, g, or t
tcagacgcgatcgacacgaccggtgctcgatttagtgagtcagtaagggaaaggggtgatcaggactcctcagttcaccttctcacaatgaggctccctgctcagctccgtggggctgctaatgctctgggtcccaggatccgagtggggattgttgtgatgactcagtctccactcctccctgcccgtcacccttggacacgccgcctccatcctctgcagtctagtacaaacgcctacctagtacgagggatacgaaaccactctacttagtaagtttcggttacaaacgaggaacggccacggacctaactccgtaccgaagggtccgtacttaaattttaacgttaaacggtttaccgtaaaccgggtcttaccggtcggggtacccaggaacagtacttcgagcggngacggtgggtcaggtcacgtagtatttacaactagtaagtaaagttggtagggtaggaggtcgtaggtaaggtagttagggttaggtttacgttttagtttcgtagtacgtagtacggtaacgtaacggtaactacgtaacgttacgggtacccttaacgtttacgtttacgggaccgtaacggggacctaaacggacgtaaggtaaaacgtaaccggtaaaacgtacgttagggtacgtacgtaccgtacaaccgttattacgttacgtttaccgttacctacgttccccg

SEQ ID NO: 232513 - DNA, 699 bp, Homo sapiens
  misc_feature: GYAE6OF01CDIAZ.45.45.E01.1.454.CMB.1.raw
  modified_base (163)..(163): a, c, t, g, unknown or other
  misc_feature (163)..(163): n is a, c, g, or t
  modified_base (249)..(249): a, c, t, g, unknown or other
  misc_feature (249)..(249): n is a, c, g, or t
  modified_base (264)..(264): a, c, t, g, unknown or other
  misc_feature (264)..(264): n is a, c, g, or t
tcagacgcgatcgacacgaccggtgctcgatttagtgagtcagtaagggaaaggggtgatcaggactcctcagttcaccttctcacaatgaggctccctgctcagctccgtgggctgctaatgctctgggtcccaggatccaggtgggatgttgtgatgactnagtctccactctccctcgcccgtcacccgtggacacggccgcctccatcctccgtgcgagtcctagcaaacgcctactagtaacgngggactaggtaaacnctcgtacttagtaacgttggttacaacgtaggacggacctaggacctaactctaccgaacggccgtaccttaaaagtttacgttaaacggtttaccgtaaaccgggtcgttacggtacggggtacccaaggtacaaggtacttacgacgcggactagggttcgggtacgaacggactacgttagtacgtttccaactacggttaagtaaaggttaagggtaggggtacggtagggtacgtaggtaaggttagttgggtttaaggttagttttaacgtctaggcttaaggtactacgaacggtacacgtacgtcggtaccgttacgttaccgtttacgggaccgaacgggtacaaggtacgaggtaaaactaccgtaaaacgtcgtggacggtcacgaactaactcttacgttcgttacttacccgtatttccccg

SEQ ID NO: 232514 - DNA, 732 bp, Homo sapiens
  misc_feature: GYAE6OF01EAQHL.45.45.E01.1.454.CMB.1.raw
  modified_base (462)..(462): a, c, t, g, unknown or other
  misc_feature (462)..(462): n is a, c, g, or t
tcagacgcgatcgacacgaccggtgctcgatttagtgagtcagtaaggggaaagggggatcaggactcctcagttcaccttctcacaatgaggcctccctgctcagcctccgtggggctgactaatgctcgtcgggtcccaggactccgaggtggggattgttgtagatcggactcacgtcctccacctccgttcccgtcgccccgttactacccgtggacacggcccgtcctaccgacttccgtaccgtcgacgttaaccggtacttaacggtaccaaacgtccccttaacgtaagaccggaagggtacttaacgaacctactacgtacgttagtagttacggtaacacgagtacgacacgtacacgtcgacggagcgtacttaagtacgttaacggtactaccggtcgttacggtccgtacagtactagtacgtacgtacggacgtacgtaggccggtancggtacctagtcgaacttcaacgtacgttaaagtaaaggttcgggtagggtagaacggtcgtaaggtaacggtagtttcggttaaggttacgttaacgtcgtaagtacgtaacgtacggtaacgtaacgtacgtaccgtacgtacggtaccttacgttggttaaccgacggtacgggactaccggaagtaacgtaagtaaaccggaagtacgttcggtagaccgtagttaccacgttacgtcgttactacttaccgtctacccgttaccg

SEQ ID NO: 232515 - DNA, 823 bp, Homo sapiens
  misc_feature: GYAE6OF01A8DU3.45.45.E01.1.454.CMB.1.raw
  modified_base (161)..(161): a, c, t, g, unknown or other
  misc_feature (161)..(161): n is a, c, g, or t
  modified_base (744)..(744): a, c, t, g, unknown or other
  misc_feature (744)..(744): n is a, c, g, or t
  modified_base (794)..(794): a, c, t, g, unknown or other
  misc_feature (794)..(794): n is a, c, g, or t
  modified_base (811)..(811): a, c, t, g, unknown or other
  misc_feature (811)..(811): n is a, c, g, or t
tcagacgcgatcgacacgaccggtgctcgatttagtgagtcagtaagggaaagggggatcaggactcctcagttcaccttctcacaatgaggcctccctgctcagcctccgtggggctgactatgctcgtcgggtccaggactcgaggtgggattggttgngtatgtactcgtacgtcctcctaccttcctcccgtcgtaccccgttctaccgttggaaccgtcggtcccgcccttacctacttccgtccgtcgacgtacgttcgttaacgaacctaaccgtcccttaacgttaacggaacgtaaggggtaacgtaaacgaaacctacggttaaccgtaacgttttaaggttaacggttttaaccggttaacaaaaccggtacggtaaccggaccgtaaaccgtaccctaaacgttcccggtaaccgaaccggtaccgttaaaccttttaaaaggtttttaaaccggttaacccggtttaacccggtaacccggggtcgtttacccgggtaccgggtaacccaagaacgtaacgtaccgtacgacggcggtacgtaggtcgacgcgtaccgtatacgtataaccgaagtaagttaaggtaagttaacggggtggtaaggtcgtacgtaagtaagggttcttagggtttaaggtttactttagggttaactgaacttggaacttaggaaacttcggaacttacggcgttaaccttacgttacgtcgggaacgtaacgggacgtanaaaccggtaaggaaaccctaggaaaccgtgcggtgacgtctaacgacgtntttaacgctaacctccncgttccgtaccg

SEQ ID NO: 232516 - DNA, 548 bp, Homo sapiens
  misc_feature: GYAE6OF02GVFXL.45.45.E01.1.454.CMB.1.raw
tcagacgcgatcgacacgaccggtgctcgatttagtgagtcagtaagggaaagggggatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcctatacagggatggaaacactcacttgaattggtttcaacagaggccaggccaatctccaaggcgcctaatttataaggtttctaaccgggactctggggtcccagacagattcagcgcagtggtcaggcactgatttcacactagaaaattaggtagggtaggaggctgagggatggttaggtagtttattcgtgtctagttgacaagggtacacacgtggaccgtactacgtttggccgaggggtaccaagtcgtagaatacgaaacgtactggtaggctagacaccgatcgtgtcttcgtatccttaccccg

SEQ ID NO: 232517 - DNA, 471 bp, Homo sapiens
  misc_feature: GYAE6OF02GU5R8.45.45.E01.1.454.CMB.1.raw
  modified_base (412)..(412): a, c, t, g, unknown or other
  misc_feature (412)..(412): n is a, c, g, or t
  modified_base (458)..(458): a, c, t, g, unknown or other
  misc_feature (458)..(458): n is a, c, g, or t
  modified_base (464)..(471): a, c, t, g, unknown or other
  misc_feature (464)..(471): n is a, c, g, or t
tcagacgcgatcgacacgaccggtgctcgatttagtgagtcagtaagggaaagggagagtggagactcagtctccactctccctgcccgtcacccttggacagccggcctccatctcctgcaggtctagtcaaagcctcctatacagggatggaaacactcacttgaattggtttcaacagaggccagaccaatctccaaggcgcctaatttataaggtttctaaccgggactctggggtcccagacagattcagcggcagtgggtcaggcactgatttcacactgaaaattagtagggtggaggctgaggatgttggagtttatttctgcatgcaaggtacacactggccgtacacttttggccaggggaccaagctggaaatcaaacgaactgtgctgcacatctgtctnatcttcccgcatctgatcatcgcgtctgagcgggctggcaaggcgngatagnnnnnnnn

SEQ ID NO: 232518 - DNA, 652 bp, Homo sapiens
  misc_feature: GYAE6OF02FF6AV.45.45.E01.1.454.CMB.1.raw
  modified_base (253)..(253): a, c, t, g, unknown or other
  misc_feature (253)..(253): n is a, c, g, or t
tcagacgcgatcgacacgaccggtgctcgatttagtgagtcagtaagggaaaggggtgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcctatacagggatggaaacnctcacttgaattggtttacaacagaggccaggccaatctccaaggcgtaccttaatttagtaacggtttctaaccgggactcgtcggggtcccagacagattcagcggcaggtgggtcaggcacgtgtactttcactactagaaagtttaggtagggtaggaggcgtagggtaggtagttggtttagggtaagttttacgtttacgtgtaccgtaagttcggacgtaaagggtaccaacgtacgtacgggtacccgttaacgttaccggtttttacggacccggtaacggggtaaaccctaagggccgtaacgggtaataaccgaaacggtaacgtacggtacggtaccgtacggacctaacccgtagttaccgttacgtcccttacgtacttaccccg

SEQ ID NO: 232519 - DNA, 628 bp, Homo sapiens
  misc_feature: GYAE6OF02ILAHA.45.45.E01.1.454.CMB.1.raw
tcagacgcgatcgacacgaccggtgctcgatttagtgagtcagtaagggaaagggggatcaggactcctcagttcaccttctcacaatgaggctccctgctcagctcctggggctgctaatgctctgggtcccaggatccagtggggatgttgtgatgactcagtctccactctccctgcccgtcacccttggacagcccggcctccatctcctgcaggtctagtcaaagcctcctatacagggatggaaacactcacttgaattggtttcaacagaggccaggccaatctaccaaggcgcctaatttataaggtttctaaccgggacttcgtcggggtcccagacagtattcagcgcagtgggtcaggcacgtgtatttcactacgtagaaaatttaggtagggtggaggtctaggaaggtagttggttggtagtttatttcgtagctagtgactaagggtaccacgtacgtcggtacccgttactaccgttttcgggacccgtaacgggggtaaccctaaaggtccgttagggaaaacttaccgaaaacggtaacgttggtacggtaccgtggacctaacccgattccgttacggttccctttacgtaccgttcccttacccccgg

SEQ ID NO: 232520 - DNA, 541 bp, Homo sapiens
  misc_feature: GYAE6OF02GY25F.45.45.E01.1.454.CMB.1.raw
tcagacgcgatcgacacgaccggtgctcgatttagtgagtcagtaagggaaaggggtgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcctatacagggatggaaacactcacttgaattggtttcaacagaggccaggccaatctccaaggcgcctaattataaggtttctaaccgggactcgtgggtcccagacagattcagcggcagtgggtcaggcacgtgatttcacactagaaattagtagggtggaggctggaggagtgttggtagtttatttctgtcagtgataacggtacacacgtacggaccgtactacgttttcggaccgtacggggaccaacgcgtaggaacgtcaaacgtacgtagtggctcgcaccatctgtcttcattccc

SEQ ID NO: 232521 - DNA, 732 bp, Homo sapiens
  misc_feature: GYAE6OF02JJFQB.45.45.E01.1.454.CMB.1.raw
tcagacgcgatcgacacgaccggtgctcgatttagtgagtcagtaagggaaagggggagtcaggactcctcagttcaccttctcacaatgaggctccctgctcagctcctggggctgctaatgctctgggtcccaggatccagtgggatgttgtgatgactcagtctccactctccctgcccgtcacccttggacagccggcctccatctcctgcaggtctagtcaaagcctcctatacagggatggaaacactcacttgaattggttcaacagacggccaggccaatcctccaaggccacctaatttagtaagtttctaaccgggactcgtggggtcccagacagtacttcgagcggcaggtcggtcaggcacgtgatttacgactacgtagaaacgtttaggtagggtaggtacggagttacggaaggtaacgttggtttacgggttaaggtttttaacgttttaccgttaggtaccgtagttggtacggtaaacggttacgtaaccggtaaccgttcgggtaacccggttacgtttaaccgtttttacggggacccggttaaccgggggtaacccgtaaacggttaacccggttaggggtaaaaccttaccggtaaaacccggtaaacttacggggttaccggtacggtaccgaacccggttaacccgtaacgtttcccggttagttttaacccgttcccgttaaccgtttaccccgtttaccccccgg

SEQ ID NO: 232522 - DNA, 565 bp, Homo sapiens
  misc_feature: GYAE6OF02ICBL9.45.45.E01.1.454.CMB.1.raw
  modified_base (337)..(337): a, c, t, g, unknown or other
  misc_feature (337)..(337): n is a, c, g, or t
  modified_base (543)..(543): a, c, t, g, unknown or other
  misc_feature (543)..(543): n is a, c, g, or t
  modified_base (546)..(546): a, c, t, g, unknown or other
  misc_feature (546)..(546): n is a, c, g, or t
  modified_base (548)..(548): a, c, t, g, unknown or other
  misc_feature (548)..(548): n is a, c, g, or t
  modified_base (551)..(553): a, c, t, g, unknown or other
  misc_feature (551)..(553): n is a, c, g, or t
  modified_base (555)..(565): a, c, t, g, unknown or other
  misc_feature (555)..(565): n is a, c, g, or t
tcagacgcgatcgacacgaccggtgctcgatttagtgagtcagtaagggaaagggagagtggagactcagtctccactctccctgcccgtcacccttggacagccggcctccatctcctgcaggtctagtcaaagcctcctatacagggatggaaacactcacttgaattggtttcaacagaggccaggccaatctccaaggcgcctaatttataagggggggtttctaaccgggactcgtggggtcccagacagattcagcggcagtgggtcaggcactgatttcacactgaaaattagtagggtggaggctgaggatggttggtagtttagtttntgctagtgacaagggttacactaccgtggccgttaacgtacgttttgggaccgacgggggaacccaaggcgtagggaaactacaaaacgaaactgtgggctggccacctattcgtgtcctttcattccttcccgctacgtctgactcgactcgtacgtctggacggtccggggcttaggggacctaagggccgacgtagtaacggncgngncgnnngnnnnnnnnnnn

SEQ ID NO: 232523 - DNA, 907 bp, Homo sapiens
  misc_feature: GYAE6OF02HMFK2.45.45.E01.1.454.CMB.1.raw
tcagacgcgatcgacacgaccggtgctcgatttagtgagtcagtaagggaaagggggatcaggactcctcagttcaccttctcacaatgaggctccctgctcagctcctggggctgctaatgctctgggtcccaggatccagtggggatgttgtgatgactcagtctccactctccctgcccgtcacccttggacacgccggcctccatcctcctgcaggtctagtcaaagccctcctatacagggataggaaacactcacttgaattggtttacaacagacggccaggccaactctaccgaaggcgtaccttaaatttacgttaacggttttccgtaaaccggggtacttaccgtacgggggtaccccaaggtaaccgtaacggtaacttttaccgacggaccggggtacctaacgggttcggggttaccgaacgggccgtaaaccgttacgggtaactttttacccgaaaccttaaccgttaaagggtttaaaaaaccgttttagggggttaaaggggggtttacggggtaaacggggtaccgttaagggggtaaacggggttacgtttaggggttttaagggggtttaaaggtttttttaacgttttaccgttacggttaccgttaaggtttacgggaaccggttaaaagggttaaccctaaccggttaaccggttaccgggtaacccgggtttaacccttttacgggtttttacggggaaccccggtaaaccgggggggtaaccccgtaaacgggtacccggtaaggggtaaaaccttaacccgggtaaaaacgggttaacccgttgggttaccgggtaccgtaccggtaaccctaacccgtaacggtttccggttaaccggtttacccttacccgttaaccgtttcccgtttaaccccccgg

SEQ ID NO: 232524 - DNA, 516 bp, Homo sapiens
  misc_feature: GYAE6OF02I9AKA.45.45.E01.1.454.CMB.1.raw
  modified_base (449)..(449): a, c, t, g, unknown or other
  misc_feature (449)..(449): n is a, c, g, or t
  modified_base (501)..(501): a, c, t, g, unknown or other
  misc_feature (501)..(501): n is a, c, g, or t
  modified_base (503)..(516): a, c, t, g, unknown or other
  misc_feature (503)..(516): n is a, c, g, or t
tcagacgcgatcgacacgaccggtgctcgatttagtgagtcagtaagggaaagggagagtggagactcagtctccactctccctgcccgtcacccttggatagccggcctccatctcctgcaggtctagtcaaagcctcctatacagggatggaaacactcacttgaattggtttcaacagaggccaggccaatctccaaggcgcctaatttataaggtttctaaccgggactctggggtcccagacagattcagcggcaggtgggtcaggcactgatttcacactgaaaattagtagggtggaggctgaggatggttggtagttttatttctgctatgctaaggtacacgactggccgtactacttttgggcccaggggaccaaggctagggaaatcgaaaacgaactggtcggatcgacaaccgatctgttcttcacttccttcccncctactctagatcgatcgcgtctgagcggctggcaggcgcagtagcagctangnnnnnnnnnnnnnn

SEQ ID NO: 232525 - DNA, 631 bp, Homo sapiens
  misc_feature: GYAE6OF02FWVLY.45.45.E01.1.454.CMB.1.raw
  modified_base (298)..(298): a, c, t, g, unknown or other
  misc_feature (298)..(298): n is a, c, g, or t
tcagacgcgatcgacacgaccggtgctcgatttagtgagtcagtaagggaaagggggatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcctatacagggatggaaacactcacttgaattggtttcaacagaggccaggcccaatctcaaggcncctaattataagtttctaaccgggctcgtcgggtcccagacagattcgagcggcagtggtcaggcactgtatttcactactagaaaattaggtagggtaggaggcgtaggaggtagttggttaggtagtttagttcgttgtacgtattcggacgtaaagtacctaacgtacgttacgggtaccgttaacgtacgttttcgggacccgtaacggggtaaccgaaaggtccgtaaggtaaacgtaccgtaaaacgtaacgttagggtacggtacctacggtaccctaaccgtacgttccgttacgttccgtttaccgtacgttcccttaccccgg

SEQ ID NO: 232526 - DNA, 970 bp, Homo sapiens
  misc_feature: GYAE6OF02IS4RI.45.45.E01.1.454.CMB.1.raw
  modified_base (264)..(264): a, c, t, g, unknown or other
  misc_feature (264)..(264): n is a, c, g, or t
tcagacgcgatcgacacgaccggtgctcgatttagtgagtcagtaagggaaagggggatcaggactcctcagttcaccttctcacaatgaggctccctgctcagctcctggggctgctaatgctctgggtcccaggatccgaggtggggattggttgtgatgactcagttcctccactcctccctcgccccgtcacccgttggacacggcccggcctaccattcctccgtgcgtacggttcttacttaccaacgtccctactanacgagggtactaacggaaactactctaacttagtaagtttcggttacaacgtacggacggtaccaacggtacctaaacgttcccgtaaccggaaacggtcccgttaacctttaaaagttttaacgtttaaaaccgggtttttaacccggtaaaacccggggttacctttaccgggttaccgggggttaacccctaaacggtaaccgttaacggttaaacctttacggaaccgggtaccggggtaccgtaacggggtttacggggtaccgtaaacgggtccttaaccgtttacggttaacttttaacccggaaccgttaacgtaaaaagggtttaaaacggtttaggggttaaacggggggtacgggtaacgggttacgtaagggggtaacgggttaacggtttaggggttttaagggttttaaacggtttttaactttttaccgggagttaaccggttaaggttccggtaaacggttaacgggttaacccaaccggttacgggttaccgggtaacccgtttaacgtttaccggttttaccggggaacccggggtaagggtaaacccgtacgtaacgggttaacggttaaaaccgtaccggtaaaaccggtacggttcgggtccgggttaacgtaaccgaacccgtaaccgttaacgtttccgttacccggtttaaccgttaccttacccggtttacccgtaccccg

SEQ ID NO: 232527 - DNA, 877 bp, Homo sapiens
  misc_feature: GYAE6OF02H1LEY.45.45.E01.1.454.CMB.1.raw
tcagacgcgatcgacacgaccggtgctcgatttagtgagtcagtaagggaaaggggtgatcaggactcctcagttcaccttctcacaatgaggctccctgctcagctcctggggctgctaatgctctgggtccaggatccagtggggatgttgtgatgactcagtctccactctccctgcccgtcaccttggacacgccggcctccattcctcctgcaggtctagtacaaacgcctactatacgagggataggaaacactctacttagtaatttggtttacaacgtaggacggacctagggacctaaactcccgtaccgaaacgggtccgtaccgtttaaaattttaacgtttaaacgggtttaccgttaaaacccggggtacttaccggtacgggggttaccccaaggtaaccgtaacgtactttaccggacggccggtacgtaagggttcgggtaccgagggcctaacgttaggtactttaccgaactacgttaaagttaaaacggtttaagggtaaggggtaggacgggtacgttagggtaaagggttagtttaggggtttacgggttaaggtttttacttttacggttacggtaccgttaaggttacggtaaacggtaaacgggtaaccctaacggttaccggttacgggtaccccggtttaacgtttaaccgggttttaccgggaacccggggtaacggggggtaaaccctaaacggggtaccggttaaacggggtaaaaccttaaccggtaaaaacccgggttaacggtttaacggggtaccgggttaaccgtaaccggaacccgttaacccggttaacgtttacccggtttacggtttacccgttttacccggacccttttaacccccgg

SEQ ID NO: 232528 - DNA, 921 bp, Homo sapiens
  misc_feature: GYAE6OF02G8LWU.45.45.E01.1.454.CMB.1.raw
  modified_base (904)..(906): a, c, t, g, unknown or other
  misc_feature (904)..(906): n is a, c, g, or t
  modified_base (908)..(908): a, c, t, g, unknown or other
  misc_feature (908)..(908): n is a, c, g, or t
  modified_base (912)..(912): a, c, t, g, unknown or other
  misc_feature (912)..(912): n is a, c, g, or t
  modified_base (914)..(917): a, c, t, g, unknown or other
  misc_feature (914)..(917): n is a, c, g, or t
  modified_base (919)..(920): a, c, t, g, unknown or other
  misc_feature (919)..(920): n is a, c, g, or t
tcagacgcgatcgacacgaccggtgctcgatttagtgagtcagtaagggaaagggagagtggagactcagtctccactctccctgcccgtcacccttggacagccggcctccatcctcctcgcgacgtctagtacaaacgcctactatacgagggtagtacggaaacactactacgttagtaagttttggtttacaacgaaggacggaccgacggtacctaactcctaaccgaacggaccgtaacctttaaattttaacggtttaacggtttaccggtaaacccgggttacttaccgggttaccggggtacccaagaccgtaagttacgttacgacgggccggacgtagggttcgggtaccggacggaccgttacggtagtttactttaccgaacccgttaagttaaaacggtaaaagttttaaggggttaagggggtaggggtacgggttaccggttaggggaaagggttacggtttacggggttttaaggggttttaagtttttttaacgttttccggttacgtaacgtaggtttacgtaaccggttaaacggttaacccaacgtaccggggttccgtaaacccggttaacccttttacgggtttaccgggaaccgggtaaccgggtaaccgttaacgggtacgttaaaagggtaaaaccttaaccgaaaaacccgtagggtttacgggtccgtaaccggttacggaacccgtaaccgtaccgtttccgttttaccgttaccttaaccgttacctttccccggttaacccctacccgttacgtttaccgttaacgttaccgttaccgttaacggtcccgttcgttcgggccggttaacgggcccggtcggttacggaaccgggcgtaacgggttaccgtaagttcggatggactgagtcgcnnngngacngnnnngnng

SEQ ID NO: 232529 - DNA, 666 bp, Homo sapiens
  misc_feature: GYAE6OF02H5WOX.45.45.E01.1.454.CMB.1.raw
tcagacgcgatcgacacgaccggtgctcgatttagtgagtcagtaagggaaagggggatcaggactcctcagttcaccttctcacaatgaggctccctgctcagctcctggggctgctaatgctctgggtcccaggatccagtggggatgttgtgatgactcagtctccactctccctcgcccgtcacccttggacagcccggcctccatctcctgcaggtctagtacaaacgcctacctatacgagggataggaaacactcacgttagtaattggtttacaacagacggccaggaccaatcctaccgaacggccgtaccttaaatttaacgttaacgggttttaccgtaaccgggtacttccgttacggggtcccaggaccagtacttacgaggccggcgtaggtcgggtcaggcacgtgtactttcactaacgtagtaaaacgtttaggtagggtaggaggacgtaggaggtagttggtttaggttagttttatttcgtgtctagtacgtacgtaagtacacgtacgtcggtaccgtacgttacgttttcggaccggtaacgggaaccgaaggtaccgtaaggtaaactacgtaaaccgtacgtcgtacggtcgtacgtaccactacgttcgttacgttaccttactaccttaccgttaccccg

SEQ ID NO: 232530 - DNA, 734 bp, Homo sapiens
  misc_feature: GYAE6OF02IV95B.45.45.E01.1.454.CMB.1.raw
  modified_base (206)..(206): a, c, t, g, unknown or other
  misc_feature (206)..(206): n is a, c, g, or t
  modified_base (569)..(569): a, c, t, g, unknown or other
  misc_feature (569)..(569): n is a, c, g, or t
tcagacgcgatcgacacgaccggtgctcgatttagtgagtcagtaagggaaaggggtgatcaggactcctcagttcaccttctcacaatgaggcctccctgctcagctccgtgggctgctaatgctcgtgggtcccaggatccgaggtggggatgttgtgatcgactcagtcctccactccgtccctcgccctctaccgttggacncggccgtcctccactctcctgcgtacgtctagacaacgtcctaccgtatacgagggatacggaaactctacgtacgttagtaacgtttcggttaacaaacgtggacggaccgaaggtacccgtaaactcccgtaccggaacggtacccgttaaccctttaaagtttaaacgtttaaaccgggttttacccaaaccgggggttaaccttccgggttaccggggtacccctaaggaaccgtagttaaccttcgacggcggtactaggtacggtcaacggtctacgtgtactcgactactaagttaagtaggtacggagtacggacgtaggtacggtagttacggtttagtacggtttattcggtntacgtagtcgtaacgtaaacgtacccgtacgacgtcgtaacccgtttacgacggtttcggaaaccgacgggtacctaaggtaccttaaggtaaccgtacgtaacgtcgtacggtcgtacgtacgaaccgtacttacgcgtttcggtacttaccggtacttcccgg

SEQ ID NO: 232531 - DNA, 718 bp, Homo sapiens
  misc_feature: GYAE6OF02H3SN6.45.45.E01.1.454.CMB.1.raw
  modified_base (419)..(419): a, c, t, g, unknown or other
  misc_feature (419)..(419): n is a, c, g, or t
  modified_base (539)..(539): a, c, t, g, unknown or other
  misc_feature (539)..(539): n is a, c, g, or t
tcagacgcgatcgacacgaccggtgctcgatttagtgagtcagtaagggaaaggggtgatcaggactcctcagttcaccttctcacaatgaggctccctgctcagctcctggggctgctaatgctctgggtcccaggatccaggtggggatgttgtgatgactcagtctccactctccctcgcccgtcaccgttggacacgccgtcctaccatcctccgtagctaggtctagtaccaaacgtcctacctatacgagggtactacggaaactacctcgtactttagtaagtttcggttacaaacgtaggaacggaccagggtaacctaactcctaccgaacggccgtaaccttaagttttacgtaacgttaccgtaaccgggcttacggtcgggtaccagacagtacttcgacgcggtanaggtcggacgacggctactagttacttacgaactacgttaaggtaaacgtttagggtacggggtaggtacggtacgtagggtaaggttcgttaagggtttcggttagtttttactttcgngtacgagttacgaacgtaaacggtacacggttacctacgggtacctacgttacggttcggaacccggtacgggaaacttaccggagttaaacgtaacggtacgaaaccggtgttacggtcgggtacctaacgccttaaacgtacgttaccgttacgtttaccgtcttaccgttaccccg

SEQ ID NO: 232532 - DNA, 741 bp, Homo sapiens
  misc_feature: GYAE6OF02FHE5T.45.45.E01.1.454.CMB.1.raw
  modified_base (197)..(197): a, c, t, g, unknown or other
  misc_feature (197)..(197): n is a, c, g, or t
tcagacgcgatcgacacgaccggtgctcgatttagtgagtcagtaagggaaaggggtgatcaggactcctcagttcaccttctcacaatgaggctccctgctcagctcctggggctgctaatgctctgggtcccaggatccagtggggatgttgtgatgactcagtctccactctccctgcccgtcacccttggacncgccggcctccatcctcctgcaggttcctagtacaacgcctactatacgagggatacggaaaccactactacttgtaatttcggtttacaacgtaggacggacccacggtaccaacttccgttacccgaaggtccgtaaccttaaacttttaagtaacggttttaccgtaaacccgggtacgttccggtaccggggtaccccacggtaacacggtaacttccgacggaccgggcgtaacgggttggggtaccgaggtcccagtcgttatttaccgactaaccgtaagtaaaacgtttagggttagggtacgggtacggtaccgtagggtaaggtacgttagggtttaggttaaccccgttttagtttcgtacgtcttagccggtaacgtaacggtacaaccgtacgtacgggtaccgttaacgttacgtttacggacccggtacgggaaccgtacgtacgtaacggtaactaaccgaaccggtaacgtaggtccgtacgttacggacaccgtcttaccgtcgttaccttacctaccgttccccg

SEQ ID NO: 232533 - DNA, 817 bp, Homo sapiens
  misc_feature: GYAE6OF02JMP6N.45.45.E01.1.454.CMB.1.raw
  modified_base (266)..(266): a, c, t, g, unknown or other
  misc_feature (266)..(266): n is a, c, g, or t
tcagacgcgatcgacacgaccggtgctcgatttagtgagtcagtaagggaaagggggatcaggactcctcagttcaccttctcacaatgaggctccctgctcagctcctggggctgctaatgctctgggtcccaggatccaggtggggatgttgtgatgactcagtctccactcctccctcgcccgtcacccgttggacacggcccgtcctcactcctcctgctaggtctagacaaacgtcctctatacgagggatacggaaaccnctctacttagtaatttcggtttacaacgaggtacggccgtaacggaccctaaacgttccgtaacccggaaacgggtcccgttaaaccgtttaaacgtttttaaacggttaaaccgggttttacccgtaaaaccccgggggtcctttaccgggttacccgggggttaaccccaaagtaaccgtaacgttacttaccggaacggtaccgggtaccggtaagggttacggggttaccaacgggtcccgaaacgttacggttaactttacccgaacgttaaccgttaaaggtaaaaggttttaccggggaaggggttacgggtacggtacgttaggtaagggttacgtttagggttagggttacgttttactttcggagtaccgtagtaccgtaaggtacgtaacgccgttaagtcggtaccgttacgttcggttacggaaccggaacgtaaccgtaagtccgtaagaaccttacgaaacggtacgtggaccgtactaccggaccttaacgttcgttaaccggtctttaacgtaccgttacgttacccctaccgg

SEQ ID NO: 232534 - DNA, 728 bp, Homo sapiens
  misc_feature: GYAE6OF02HP6B1.45.45.E01.1.454.CMB.1.raw
  modified_base (284)..(284): a, c, t, g, unknown or other
  misc_feature (284)..(284): n is a, c, g, or t
  modified_base (439)..(439): a, c, t, g, unknown or other
  misc_feature (439)..(439): n is a, c, g, or t
  modified_base (551)..(551): a, c, t, g, unknown or other
  misc_feature (551)..(551): n is a, c, g, or t
tcagacgcgatcgacacgaccggtgctcgatttagtgagtcagtaagggaaaggggtgatcaggactcctcagttcaccttctcacaatgagctccctgctcagctccgtgggctgctaatgctcgtgggtcccaggactccgaggttgggatggttgtgatgactcgagtcctccactcctccctcgccctacacccgttggactacgcccggccctccactcctaccgtgaccgtaggttctaagacctaaacgccctactacgtagacggtatacgaaacnctactacttagtaagtttgttaccaacgacgacggccgaacggaccctaatcccgtaaccggaacggtaccgttaaccttaagttttaacgttaacggtttaccgtaaacccgggtcttccggtacggggtaccccagtaacgtagtacgtacgnggccggcgtaagggtggtacgacggtctactagtcttacactacgtaagtaagttggacggtaggagtagtaggtagtagttggttagttagtttagttgtacgtagcgttnaacgtagtacgaccgttacgtcgttaccttacgttaccggtttacgaccgggtaaaccgggtacctaacgggttaccgtaacggtaaccgttaacgtaaaccgggtacgttcggtagttaaccgccgtaacctaccgttcgttaccgtttcgtacctttacgttccctttacccggg

SEQ ID NO: 232535 - DNA, 825 bp, Homo sapiens
  misc_feature: GYAE6OF02FZRQK.45.45.E01.1.454.CMB.1.raw
  modified_base (274)..(274): a, c, t, g, unknown or other
  misc_feature (274)..(274): n is a, c, g, or t
tcagacgcgatcgacacgaccggtgctcgatttagtgagtcagtaagggaaagggtgatcaggactcctcagttcaccttctcacaatgaggctccctgctcagctcctggggctgctaatgctctgggtcccaggactccaggtggggtatggttgtgatgactcacgtctccactcctccctcggccccgtcctacccttggaccacgcccggtcctccatcctcctgcgtacggtcctagtacgaaacgtccttacctagtaccgaggtanacggaactactactagttagtaagtttcggtttacaacgaggtacggaccgacggacctaattacccgtaccgaacgggtcccgtaacctttaaacgttttaaggttaaccggttttaaccggtaacccggggtaacttccggttacggggtacccaacggtaacctaggttaacctttacgaccggtccggtacgtaaggttcggggtaccgaacggtcctaacgttcgttaaactttccgaactacggttaaagtaaacgttagggttaaggggtcgggtaggtacgtaggtaggtattgggtttacggttagttttacgttacgtttcgtacgtaacggttacgtaacgttaacggtaaccgtaacgtaccgttaccgggtacccggtttaacgtttaccggtttaccgggtaaccgggtaaccgggtaaaccggttaacggtaacgttaggtaaaccgtacgtaacggtaagggttcggtacggtaccggttacgaccggttacctacggtttactacgggttaccctttacgtacccgtttacccg

SEQ ID NO: 232536 - DNA, 798 bp, Homo sapiens
  misc_feature: GYAE6OF02GO22K.45.45.E01.1.454.CMB.1.raw
  modified_base (170)..(170): a, c, t, g, unknown or other
  misc_feature (170)..(170): n is a, c, g, or t
tcagacgcgatcgacacgaccggtgctcgatttagtgagtcagtaagggaaaggggtgatcaggactcctcagttcaccttctcacaatgaggctccctgctcagctccgtggggctgctaatgctctgggtcccaggatccaggtgggatgttgtgatgactcagttcnccactctccctgccccgtctacccgttggacacggcccggtcctccatcctcctagccgtaggtcctaagtaccaaacgtcccttacctaatacgagggtatacggaaactactcacgttagtaatttggttacaacgtagacggaccgtacggacacttacaccgaaggtacctacttaaatttacgttaaacggtttaccgtaaacccgggtctcggtaccgggtacccaaggaacgtaagtaacttcgacgtaccgggtagtcgggtacgggtacgaacgggccttaacgtcgttaacgtttaccgaaacgtaacgtttaaacggtaaaagttttacggggtaaggggttacgggaacgggtacgttagggtaagggttaaggtttggggtttaacggtttacggttttaacgtttcgtaggtactagttacgaacgtacgtaacgtacgtacggttacgggtaccgttaaccgtttacgggtttaccggaaccgggttaacgggaaccgtaaaggttacgtaaaggtaacctaaacggtaaaccggtaaccggtaggtcggaacccgttcaacccgttaacgtactttaccggttacctttccgttaccgtccgtttaaccccg

SEQ ID NO: 232537 - DNA, 601 bp, Homo sapiens
  misc_feature: GYAE6OF01CVY6I.40.56.F01.1.454.CMB.1.raw
tcagtctagcgactcacgaccggtgctcgatttagcagacgtctgaacacacaaaggggggagtcagacccagtcaggacacagcatggacatgagggtcccccgctcagctcctggggctcctgctgctctggctcccaggtgccaattgtgacatccagatgacccagtctccctccaccctgtctgcctctattggagacagggtcaacatcacttgccgggccagtcggaggatttatacctgattggcctggtatcagcaagaaaccgagggaaacgcccctgaccctcctgattcgttaaggcgtactacgtttggagacagtgggtcccatcgaaggttcaggcggcaggtggataccgagacagattcactctcacatcagcacgcctgacagccggtattgtattttgactaacgttacttacgtcgacctaaactaattaactttaacgtaacgtttacgtacccgttacgggtaccggtttaccggacccgaaacgggtacccgtaagggtaccggtaaaagtcgaacggtaaccgaacgttcgggttcggacgtacgtacctaaccctagttcgtcgttccgttacccg

SEQ ID NO: 232538 - DNA, 506 bp, Homo sapiens
  misc_feature: GYAE6OF01E112R.40.56.F01.1.454.CMB.1.raw
tcagtctagcgactcacgaccggtgctcgatttagcagacgtctgaacacacaaaggggggagtcagacccagtcaggacacagcatggacatgagggtccccgctcagctcctggggctcctgctgctctggctcccaggtgccaattgtgacatccagatgacccagtctccctccaccctgtctgcctctattggagacagggtcaacatcacttgccgggccagtcggaggatttatacctgattggcctggtatcagcagaaaccagggaaagcccctgacctcctgatctttaaggcgtctactttggagacatgggtcccatcaaggttcagcggcagtgatccgagacagaattcactctcacatcagcagcctgcagccgatgtattttgctaactttattactgacctaacaatattaacagtttactccgttacggacgttcggaccaagggacccaggtaggaaatcgagaagactgagctgcacatctgtctc

SEQ ID NO: 232539 - DNA, 516 bp, Homo sapiens
  misc_feature: GYAE6OF01A8CV9.40.56.F01.1.454.CMB.1.raw
  modified_base (240)..(240): a, c, t, g, unknown or other
  misc_feature (240)..(240): n is a, c, g, or t
  modified_base (276)..(276): a, c, t, g, unknown or other
  misc_feature (276)..(276): n is a, c, g, or t
  modified_base (311)..(311): a, c, t, g, unknown or other
  misc_feature (311)..(311): n is a, c, g, or t
  modified_base (347)..(347): a, c, t, g, unknown or other
  misc_feature (347)..(347): n is a, c, g, or t
  modified_base (411)..(411): a, c, t, g, unknown or other
  misc_feature (411)..(411): n is a, c, g, or t
tcagtctagcgactcacgaccggtgctcgatttagcagacgtctgaacacacaaaggggggagtcagacccagtcaggacacagcatggacatgagggtccccgctcagctcctggggctcctgctgctctggctcccaggtgccaattgtgacatccagatgacccagtctccctccaccctgtctgcctctattggagacagggtcaacatcacttgccgggccagtcggagatttanacctggttgcctggtatcagcagaaaccagggaaancccctgacctctgatcttaaggctctactttgganacatgggtccatcaaggttcagcggcagtgatcganacagattcactctcacatcagcagcctgacagccgatgatttgactaacttatactgacctaanaattatactagttactcgtacggacgttcggaccgaaggacccgaggtacgaaagtacgaacgacgtaacgtggtcggacgtacgactaccatctgtcctcgtac

SEQ ID NO: 232540 - DNA, 577 bp, Homo sapiens
  misc_feature: GYAE6OF01DVHHN.40.56.F01.1.454.CMB.1.raw
tcagtctagcgactcacgaccggtgctcgatttagcagacgtctgaacacacaaaggggggagtcagacccagtcaggacacagcatggacatgagggtccccgctcagctcctgggggctcctgctgctctggctcccaggtgccaattgtgacatccagatgacccagtctccctccaccctgtctgcctctattggagacagggtcaacatcacttgccgggccagtcggaggatttatacctgattggcctggtatcagcagaaaccagggaaagcccctgacctcctgatctttaaggcgtctactttggagacatgggtcccatcaaggttcagcggcagtggatccgagacagattcactctcaccatcagcagcctgcagccggatgtattttgactaacttattacctgaccctaaacaataactttaactaagtttacttcccgttaccgggtaccgtttaccgggacccgtaacgggtaccccgaagggtacggtaaagtaccgaacggaaccggtaacgttcggtcgggtcgtacgacccaaccacttccgtcgttctttacccg

SEQ ID NO: 232541 - DNA, 515 bp, Homo sapiens
  misc_feature: GYAE6OF01EYJMS.40.56.F01.1.454.CMB.1.raw
  modified_base (240)..(240): a, c, t, g, unknown or other
  misc_feature (240)..(240): n is a, c, g, or t
  modified_base (342)..(342): a, c, t, g, unknown or other
  misc_feature (342)..(342): n is a, c, g, or t
tcagtctagcgactcacgaccggtgctcgatttagcagacgtctgaacacacaaaggggggagtcagacccagtcaggacacagcatggacatgagggtccccgctcagctcctggggctcctgctgctctggctcccaggtgccaattgtgacatccagatgacccagtctccctcaccctgtctgcctctattggagacagggtcaacatcacttgccgggccagtcggaggatttanacctgattggcctggtatcagcagaaaccagggaaagcccctgacctcctgatctttaaggcgtctactttggagacatgggtcccatcaaggttcagcggnagtgatccgagacagaatcactctcaccatcagcagcctgcagccggatgatttgctaacttattactgaccaactaatacttaacagtttactccgtacggtacgttcggacccaagggacccgaggtacggaaatcgagtacgaactgtaggctgaccacatctgtcttac

SEQ ID NO: 232542 - DNA, 540 bp, Homo sapiens
  misc_feature: GYAE6OF01CNMLM.40.56.F01.1.454.CMB.1.raw
  modified_base (282)..(282): a, c, t, g, unknown or other
  misc_feature (282)..(282): n is a, c, g, or t
  modified_base (417)..(417): a, c, t, g, unknown or other
  misc_feature (417)..(417): n is a, c, g, or t
tcagtctagcgactcacgaccggtgctcgatttagcagacgtctgaacacacaaaggggggagtcagacccagtcaggacacagcatggacatgagggtccccgctcagctcctggggctcctgctgctctggctcccaggtgccaattgtgacatccagatgacccagtcctccctccaccctgtctgcctctattggagacagggtcaacatcacttgccgggccagtcggaggatttatacctggttggcctggtatcagcaagaaaccgagggaaacncccctgacctctgactcttaaggcttctactttggatacagtcgggtcccagtacgaaggtcaggcggcaggtgatcgagacagaacttcactctcacatcagcagcctgcagccgatgtatttcgactaacttntactgaacctaataattacttacaagttctaccgtacggtacgttcggaccgaacgggacccaggtacgaaactcgaagacgtaagtggtcgcgtagaccgtacctattcctgtccttctacc

SEQ ID NO: 232543 - DNA, 555 bp, Homo sapiens
  misc_feature: GYAE6OF01BDJID.40.56.F01.1.454.CMB.1.raw
  modified_base (285)..(285): a, c, t, g, unknown or other
  misc_feature (285)..(285): n is a, c, g, or t
  modified_base (322)..(322): a, c, t, g, unknown or other
  misc_feature (322)..(322): n is a, c, g, or t
  modified_base (325)..(325): a, c, t, g, unknown or other
  misc_feature (325)..(325): n is a, c, g, or t
  modified_base (420)..(420): a, c, t, g, unknown or other
  misc_feature (420)..(420): n is a, c, g, or t
  modified_base (434)..(434): a, c, t, g, unknown or other
  misc_feature (434)..(434): n is a, c, g, or t
tcagtctagcgactcacgaccggtgctcgatttagcagacgtctgaacacacaaaggggggagtcagacccagtcaggacacagcatggacatgagggtccccgctcagctcctggggctcctgctgctctggctcccaggtgccaattgtgacatccagatgacccagtcctccctccaccctgtctgcctctattggagacagggtcaacatcacttggccgggccaggtcggaggtatttataccgtggttggcctggtatcagcaagaaaccagggaaacnccctgacctcctgatcttaaggcttctacgtttgganacntgggtcccatcgaaggttcaggcggcaggtgatccgagacagaattcactctcacatcatcagcctgcaggccgtatgtactttgactaactttntactcgacctaaanaattacttaactagttactccgtacggtacttcggaccaagggtacccagggttacgaaatcgaacggaccgtaagtcggtaggcctacgaccgaacctagttacttcgtcttcctaaccg

SEQ ID NO: 232544 - DNA, 533 bp, Homo sapiens
  misc_feature: GYAE6OF01ATOL8.40.56.F01.1.454.CMB.1.raw
tcagtctagcgactcacgaccggtgctcgatttagcagacgtctgaacacacaaaggggggagtcagacccagtcaggacacagcatggacatgagggtccccgctcagctcctggggctcctgctgctctggctcccaggtgccaattgtgacatccagatgacccagtctccctccaccctgtctgcctctattggagacagggtcaacatcacttgccgggccagtcggaggatttatacctgattggcctggtatcagcagaaaccagggaaacgcccctgacctcctgatctttaaggcgtctactttggagacatgggtcccatcaaggttcagcggcagtggatccgagacagattcactctcaccatcagcacgctgcagccggatgtatttgactaacttattactgacctaactaatattactagttactcctcggtacgttaccggaccgaacgggacccgaggtagggaactacgagtaaccggaactggtacggctcgaccaccagttctgttcttaccg

SEQ ID NO: 232545 - DNA, 534 bp, Homo sapiens
  misc_feature: GYAE6OF01B30DC.40.56.F01.1.454.CMB.1.raw
  modified_base (241)..(241): a, c, t, g, unknown or other
  misc_feature (241)..(241): n is a, c, g, or t
  modified_base (279)..(279): a, c, t, g, unknown or other
  misc_feature (279)..(279): n is a, c, g, or t
  modified_base (347)..(347): a, c, t, g, unknown or other
  misc_feature (347)..(347): n is a, c, g, or t
  modified_base (381)..(381): a, c, t, g, unknown or other
  misc_feature (381)..(381): n is a, c, g, or t
tcagtctagcgactcacgaccggtgctcgatttagcagacgtctgaacacacaaaggggggagtcagacccagtcaggacacagcatggacatgagggtccccgctcagctcctggggctcctgctgctctggctcccaggtgccaattgtgacatccagatgacccagtctccctccaccctgtctgcctctattggagacagggtcaacatcacttgccgggccagtcggaggatttanacctgattggcctggtatcagcagaaaccagggaaacncccctgacctcctgattctttaaggcgttctacgtttggagacagtgggtcccatcaaggttcagcgnagtgatccgagacagattcactctcacctatcancagcctgcagccggatgtatttgactaactttatactgacctaaactaatattaacagtttactccgtcggtacgttcggaccaacgggaccctaagggtacgaaatcgaacgtacgaacgtggtacggctcgtaccactatcttgtcttacg

SEQ ID NO: 232546 - DNA, 561 bp, Homo sapiens
  misc_feature: GYAE6OF01EDG4G.40.56.F01.1.454.CMB.1.raw
  modified_base (283)..(283): a, c, t, g, unknown or other
  misc_feature (283)..(283): n is a, c, g, or t
  modified_base (372)..(372): a, c, t, g, unknown or other
  misc_feature (372)..(372): n is a, c, g, or t
  modified_base (429)..(429): a, c, t, g, unknown or other
  misc_feature (429)..(429): n is a, c, g, or t
tcagtctagcgactcacgaccggtgctcgatttagcagacgtctgaacacacaaaggggggagtcagacccagtcaggacacagcatggacatgagggtccccgctcagctcctgggggctcctgctgctctggctcccaggtgccaattgtgacatccagatgacccagtctccctccaccctgtctgcctctattggagacagggtcaacatcacttgccgggccagtcggaggtatttataccgtggttggcctggtatcagcaagaaaccagggaaacncccctgacctcctgatctttaaggcgtctactttggagacagtggtcccatcgaaggttcagcgcagtggatcgagacagattcactcncaccatcagcacgcctgcagccgatgtatttgactaatttactacgtgaccctaaanaattaacttactaagttactcccgttacgggtaccgttcggaccgaacggggtacccagggtaacggaaataccgaacggtaacgtaacggtggtggccgtacgacctacgtactccttgttccttctaccg

SEQ ID NO: 232547 - DNA, 640 bp, Homo sapiens
  misc_feature: GYAE6OF01DAYTK.40.56.F01.1.454.CMB.1.raw
  modified_base (286)..(286): a, c, t, g, unknown or other
  misc_feature (286)..(286): n is a, c, g, or t
  modified_base (605)..(605): a, c, t, g, unknown or other
  misc_feature (605)..(605): n is a, c, g, or t
  modified_base (624)..(624): a, c, t, g, unknown or other
  misc_feature (624)..(624): n is a, c, g, or t
tcagtctagcgactcacgaccggtgctcgatttagcagacgtctgaacacacaaaggggggagtcagacccagtcaggacacagcatggacatgagggtccccgctcagctcctggggctcctgctgctctggctcccaggtgccaattgtgacatccagatgacccagtctccctccaccctgtctgcctctattggagacgagggtcaacatcacttcgccgggccaggtcggagtatttactaccgtggttggcctggtatcagcaagaaaccgagggaaacncccctagacccttcctgtactcgtttaaggccgttcgttactttggagactagtcgggtacccctagtaccgaaggttccgaaggccggtacgtaagggtacggtaacgttaccggaagtaaaccgtagtaaactttccaccttcctaccaccctatccgaagccacgtcctggaccaggtccggattagttacttttacgacttaacgtttacttacgtacgacctaaacttatacttaactagttactccggtacggtacgtcggaccgaacggtccgaaggtagaaacgtcgaaggaccgtaatgggtcgaccgtnaaccgtactactccgtttnttaccttcgtaacccg

SEQ ID NO: 232548 - DNA, 617 bp, Homo sapiens
  misc_feature: GYAE6OF01DRRBX.40.56.F01.1.454.CMB.1.raw
  modified_base (211)..(211): a, c, t, g, unknown or other
  misc_feature (211)..(211): n is a, c, g, or t
tcagtctagcgactcacgaccggtgctcgatttagcagacgtctgaacacacaaaggggggagtcagacccagtcaggacacagcatggacatgagggtccccgctcagctcctggggctcctgctgctctggctcccaggtgccaattgtgacatccagatgacccagtcctccctccacctgtctgcctctatggagacagggtcaacntcacttggccgggcaggtcggaggtatttagtaccgtggttggcctggtactcagacaagaaaccgagggaaacgcccctgacctcctgtacttcgtttaaggctacgttacgtttaggagactagtcgggtaccctatacgtaaggttcaaggcggacaggtaggacgtaccggagacgaagtaacttccactcacaaccactacgacgcacgtccctagccgaggaccggtattcggtacttttcgaaccttaactttactactacgaccaaataactacttaactagttactaccgtacggtaccgttaccggaccggtaacgggacccgtaggtacggaaactcgaacggtacgtaacgttggcggtcgtacgacctacctattcgtcgttcgttctacccg

SEQ ID NO: 232549 - DNA, 589 bp, Homo sapiens
  misc_feature: GYAE6OF01CM9WG.40.56.F01.1.454.CMB.1.raw
  modified_base (240)..(240): a, c, t, g, unknown or other
  misc_feature (240)..(240): n is a, c, g, or t
  modified_base (355)..(355): a, c, t, g, unknown or other
  misc_feature (355)..(355): n is a, c, g, or t
tcagtctagcgactcacgaccggtgctcgatttagcagacgtctgaacacacaaaggggggagtcagacccagtcaggacacagcatggacatgagggtccccgctcagctcctggggctcctgctgctctggctcccaggtgccaattgtgacatccagatgacccagtctccctccaccctgtctgcctctattggagacagggtcaacatcacttgccgggcagtcggaggatttanaccgtggttcgcctggtatcagcagaaaccgagggaaacgcccctagacctcctagtatacgtttaaggctctacgtttaggagtacagtcggtcccagtcgaagttcgagcggnaggtggactccgagacagtaacttcactctcacatcagcagcctgcagccggatgtatttcgactaactttactactcgaaccctaaataacttaacttacgtaagtttaccgtccgtacggtacggttccgaacccgtaacgggaccctagggtacgaaacgtaccgaaggtaccgtaacgttggtcggtaccgtagacccttaccgatttccgtcgtccctttacgtacccg

SEQ ID NO: 232550 - DNA, 544 bp, Homo sapiens
  misc_feature: GYAE6OF01BJ5WX.40.56.F01.1.454.CMB.1.raw
  modified_base (240)..(240): a, c, t, g, unknown or other
  misc_feature (240)..(240): n is a, c, g, or t
  modified_base (319)..(319): a, c, t, g, unknown or other
  misc_feature (319)..(319): n is a, c, g, or t
tcagtctagcgactcacgaccggtgctcgatttagcagacgtctgaacacacaaaggggggagtcagacccagtcaggacacagcatggacatgagggtccccgctcagctcctggggctcctgctgctctggctcccaggtgccaattgtgacatccagatgacccagtctccctccaccctgtctgcctctattggagacagggtcaacatcacttgccgggcagtcggaggatttanacctgattggcctggtatcagcagaaaccagggaaacgcccctgacctcctgattcgtttaaggcgttctactttgganacagtgggtcccatcaaggttcagcggcagtggatccgagacagaattcactctcacatcagcagcctgcagccgatgatttgactacttattacctgaccaactaatacttaactagttactaccgtcggtacgttcgggaccaacgggtaccaggtacggaaatccgaaggtaccgaacgttcggacggtctacggactacccgtattccgtgttccttaccg

SEQ ID NO: 232551 - DNA, 608 bp, Homo sapiens
  misc_feature: GYAE6OF01EXQTQ.40.56.F01.1.454.CMB.1.raw
  modified_base (213)..(213): a, c, t, g, unknown or other
  misc_feature (213)..(213): n is a, c, g, or t
  modified_base (413)..(413): a, c, t, g, unknown or other
  misc_feature (413)..(413): n is a, c, g, or t
tcagtctagcgactcacgaccggtgctcgatttagcagacgtctgaacacacaaaggggggagtcagacccagtcaggacacagcatggacatgagggtccccgctcagctcctggggctcctgctgctctggctcccaggtgccaattgtgacatccagatgacccagtcctccctccacctgtctgcctctagttggagacagggtcaacntcacttggccgggcctaggtcggaggtatttactaccgttggttggcctggtactcgagcaaggaaaaccgagggaaacgccccgtagacctccgtgtacgttccgtttaacgggccgttacgttacgtttggacacgtagtcgggtcccagtacgaaggttcaggtcgcgagtcgacgtacgagacagtaattcactcnccacagtcacgcacgcctagacgaggccggtatcgtatttcgacttaacttatactactaccaatacttatacgtagttacgtaccgtacggtaccgttacggaccggtaacgggtacccgaagggtacgtaaactacgaggtaaccgaaggtcggtcggacgtcgaccgtaccacgttacttcgtcttcgtacc

SEQ ID NO: 232552 - DNA, 637 bp, Homo sapiens
  misc_feature: GYAE6OF01B1E7D.40.56.F01.1.454.CMB.1.raw
tcagtctagcgactcacgaccggtgctcgatttagcagacgtctgaacacacaaaggggggagtcagacccagtcaggacacagcatggacatgagggtccccgctcagctcctggggctcctgctgctctggctcccaggtgccaattgtgacatccagatcgacccagtcctcccctccaccctgtcctcgcctctattggagacgagggtacaactatccacgttcggccgggccaggtcggaggtactttataccgtgtagttcggccttaggtatcagacaagaaaccgacgggaacgcccctgaccctctgtacttcgttaaggcttcttacgtttaggacgactagtcgggtaccctatacgtaaggttcaggtcgctaggtgactccggagaacacgtaactcgacttcaccacagtacacgtacacgtcctgacgacgacggtacttggttatttcgtaaccttaacctttacgtaaccttacgtaacctaaattaactttcttaactagtttacccttaccgtacggtaccgttacggacccgtaaacgggacccgtaaggtacggaattaccgaacggtaacgacgttacggcgtacgtcgtacctactattccgttgttctaccg

SEQ ID NO: 232553 - DNA, 543 bp, Homo sapiens
  misc_feature: GYAE6OF01EL276.40.56.F01.1.454.CMB.1.raw
  modified_base (242)..(242): a, c, t, g, unknown or other
  misc_feature (242)..(242): n is a, c, g, or t
tcagtctagcgactcacgaccggtgctcgatttagcagacgtctgaacacacaaaggggggagtcagacccagtcaggacacagcatggacatgagggtccccgctcagctcctggggctcctgctgctctggctcccaggtgccaattgtgacatccagatgacccagtctccctccaccctgtctgcctctattggagacagggtcaacatcacttgccgggccagtcggaggtatttanacctgattggcctggtatcagcaagaaaccagggaaacgcccctgacctcctgatcgtttaaggcgttctacgtttggagtacatcgggtcccatacaaggttcaggcggcagtggatcgagacagaatcactctcacatcagcacgcctgcacgccggtatggtatttcgactaactttatactcgacctaataatattaactagttactaccgttacggtaccgttacggaccgtaacgggacccgtaggtacggaaatcgagacgtaacgtggtcggctgaccactatcttgtcttcc

SEQ ID NO: 232554 - DNA, 836 bp, Homo sapiens
  misc_feature: GYAE6OF01CQR7A.40.56.F01.1.454.CMB.1.raw
  modified_base (153)..(153): a, c, t, g, unknown or other
  misc_feature (153)..(153): n is a, c, g, or t
tcagtctagcgactcacgaccggtgctcgatttagcagacgtctgaacacacgaaaggggggagtcagacccagtcaggacacagcatggacatgagggtccccgctcagctcctggggctcctgctgctctggctcccgaggtgccaattgngacatccagatgacccagtcctccctccaccctgtctcgtcctctagtggacgacagggtacaactatcctacgttcggccgggacctaggtacgggaaggtatttaagtacctggtacgttgggccttaggtactacgagaccgaacggaaaaccggaggaaaccgccccgtacgaccctccgtagtactttacgttaacggcgttaccttaggtttacgggaactaacgtacggtacggggttaccccaagttaaccgtaaagggttaccacgggaccgggtacgtaggggtacggtaaccggtaccggaacggaacgtaacgttaaacttccctacgtacccttaccaacctaactaccggaagtacctaaccgttcccgtacggacccggaaacgggttcccgggtaaatttaggggtttaacttttaccggtaacctttaaaaccgtttttaacctttaaccgtaccggtaaaaccctaaacgttaaaacttaaacggtttaaccgttaaccggttaccggtttaaccccggttacgggttaacccggtttaccgggaccgggttaaaccgggaaccccgggtaagggtaaaccggtaaacgtaaccgtaacgggtaaccggtaacgtcgggacggttcgtaccgacctacccgtagttccttccggttcttaacccg

SEQ ID NO: 232555 - DNA, 835 bp, Homo sapiens
  misc_feature: GYAE6OF01AV1OX.40.56.F01.1.454.CMB.1.raw
tcagtctagcgactcacgaccggtgctcgatttagcagacgtctgaacacacaaaggggggagtcagacccagtcaggacacagcatggacatgagggtccccgctcagctcctggggctcctgctgctctggctcccaggtgccaattgtgacatccagatgacccagtcctccctccaccctgtctcgcctctattggagacgagggtacaacatcacgttcggcccgggccaggtcggaggtacttttactaccgttgggttcggtccgttaggttactaccgagtaccgaaacggaaaacccggaacggggaaaccgcccccgtacgtacccttaccgtacggtacgttaccgttttaaacgggtccgttaccgtttaccgttttagggaacgtaccgtacggttaccgggttcccctaacgttacggtaaacgggttccgaacggggtcccgggtacgtaaacgggttcgggaaccgttacccggaacggtaaaccgtaacggttaaacctttacctaacccgttaccccgtaacctaacccctacgttaccgaacggtccctaacggtccccgtacggacccgaacgggtaccggtaattacgggttacttttacggaacctttaacgtttaacttaccgttacgaaccctaaacgttaacttaactttaacctacggtttaacctacccgggtaccggttaccggttacccggaaccggtaaccgggaaccgtaaggggtaactaaacgcgtaaacggtaccgtacggttggccgggtaccctacgggacccctacgttacttccgtttacgttcccttcgttacccg

SEQ ID NO: 232556 - DNA, 606 bp, Homo sapiens
  misc_feature: GYAE6OF01CBUOG.40.56.F01.1.454.CMB.1.raw
  modified_base (243)..(243): a, c, t, g, unknown or other
  misc_feature (243)..(243): n is a, c, g, or t
tcagtctagcgactcacgaccggtgctcgatttagcagacgtctgaacacacaaaggggggagtcagacccagtcaggacacagcatggacatgagggtccccgctcagctcctggggctcctgctgctctggctcccaggtgccaattgtgacatccagatgacccagtctccctccaccctgtctgcctctattggagacagggtcaacatcacttgccgggccaggtcggaggtatttanacctggttggcctggtatcagcagaaaccagggaaacgcccctgaccctctgatcgtttaaggcgttctacgtttggagactagtcgggtcccatcgaaggttcacggtcggacgaggtcggatccgagacagtaacttcactctacaccatcagcacgcctgcgagccggatgtacttttagacttaacttactactacgacctaactaacttaattaacgtagttactacccgtacggtacgttaccgggaccgtaacgggacccgtagggtacggaaacgtaccgaaggtaaccggtaagttacgggtcgggcgtacggaccgtaaccctacttccgtttgttacccgttcttaaccccg

SEQ ID NO: 232557 - DNA, 803 bp, Homo sapiens
  misc_feature: GYAE6OF01C5WBZ.40.56.F01.1.454.CMB.1.raw
  modified_base (215)..(215): a, c, t, g, unknown or other
  misc_feature (215)..(215): n is a, c, g, or t
tcagtctagcgactcacgaccggtgctcgatttagcagacgtctgaacacacaaagggggggagtcagacccagtcaggacacagcatggacatgagggtccccgctcagctcctggggctcctgctgctctggctcccaggtgccaattgtgacatccagatgacccagtcctccctccaccctgtctcgcctctatggagacagggtacaacntcacttcggccgggccaggtcggaggtattttagtaccgttgggttcggccgtggtactcaaggacaacggaaaaccgacggggaaaaccgtcccccgtaggaaccccttacccgtagtaacgtttaccgttttaaacgggccgtttacttaacgttttgggaactaacgtacgttcggggtacccctaagttacccgtaaagggtttccgagggtacccgggtaccgtaaggggttacgggaacgttacccggaaggtaacccgaaggtaactttccgaaccttcctacccaaacctataccgaacgccaacggtccccgtggacccgaacgggtacccgggaatttacgggttaacttttacggaacctttaaactttaactttacccgtacgtaaaccctaaattaaactttaacgtttaaaccgtacgtttaaccttacccgggtaacgggttacccgggtttacccgggaacccggtaacggggtaaccccgttaaggggtaacgtaaaccggtacgtaaccggaaacggtaccgttaggtcggtacctaggaccctactacttccttgtacccttctaaccg

SEQ ID NO: 232558 - DNA, 560 bp, Homo sapiens
  misc_feature: GYAE6OF01CZ8WZ.40.56.F01.1.454.CMB.1.raw
tcagtctagcgactcacgaccggtgctcgatttagcagacgtctgaacacacaaaggggggagtcagacccagtcaggacacagcatggacatgagggtccccgctcagctcctggggctcctgctgctctggctcccaggtgccaattgtgacatccagatgacccagtctcccctccaccctgtctgcctctattggagacagggtcaacatcacttgccgggcaggtcggaggatttataccgtggttggcctggtatcagcaagaaaccgaggaaacgcccctgaccctctagattcgtttaacggcgttctacgtttggagacagtcgggtccatcgaaggttcagcgcaggtggactccgagacagtactctactctcaccatcacgtcagcctgcgagccgtatgtacttttgactaacttatactacgtacaactaattactaactagtttactccgtacggtaccgttacggaccgtacgggacctagggtacgaacgtacgacgtaacgtagtggtcggactggacctactattccgtcgtcgttctacc

SEQ ID NO: 232559 - DNA, 692 bp, Homo sapiens
  misc_feature: GYAE6OF01DB4QB.40.56.F01.1.454.CMB.1.raw
  modified_base (302)..(302): a, c, t, g, unknown or other
  misc_feature (302)..(302): n is a, c, g, or t
  modified_base (651)..(651): a, c, t, g, unknown or other
  misc_feature (651)..(651): n is a, c, g, or t
tcagtctagcgactcacgaccggtgctcgatttagcagacgtctgaacacacgaaaggggggagtcagacccagtcaggacacagcatggacatggagggtcccccgctcagctcctggggctcctgctgctctggctcccaggtgccaattgtgacatccagatgacccagtcctccctccaccctgtctcgcctctagttggagacgagggtcaacatcacgttcggccgggcaggtacggaggtatttataccgtgtattcggccttggtactcgaagacaagaaaccgagggaaaccnccccgtagtaccctccgtagtacttacgttaacggcgttactacgtttgaactacgtagtccggtaccctagtacgtaacggttcgaaggtccggagtaggtacggtacgtaccggagtacgtaagtaacttccaacttcgaaccacctatccgagaccgacgtcctagacggacggtacggtattaggttacttttgaaccttaactttaactaccggactaaccctaaatactttaactaacgttcgttaccgtaccggtacgggttaaccgtaccgaacccgggtaacggtaaccgtagggttaaccgtaaacgtacccgggtaacgtaacggttcgtcgggtacncgtaacccgaccttacttaccggtcttcccgtaactcccgg

SEQ ID NO: 232560 - DNA, 573 bp, Homo sapiens
  misc_feature: GYAE6OF01EZ23E.40.56.F01.1.454.CMB.1.raw
  modified_base (216)..(216): a, c, t, g, unknown or other
  misc_feature (216)..(216): n is a, c, g, or t
  modified_base (248)..(248): a, c, t, g, unknown or other
  misc_feature (248)..(248): n is a, c, g, or t
  modified_base (411)..(411): a, c, t, g, unknown or other
  misc_feature (411)..(411): n is a, c, g, or t
  modified_base (420)..(420): a, c, t, g, unknown or other
  misc_feature (420)..(420): n is a, c, g, or t
  modified_base (560)..(560): a, c, t, g, unknown or other
  misc_feature (560)..(560): n is a, c, g, or t
tcagtctagcgactcacgaccggtgctcgatttagcagacgtctgaacacacaaaggggggagtcagacccagtcaggacacagcatggacatgagggtcccccgctcagctcctggggctcctgctgctctggctcccaggtgccaattgtgacatccagatgacccagtcctccctccaccctgtctcgcctctagttggacgacaggtcaacntcacttgccgggccaggtcggaggtattttanaccgttggttcggccgttggtatcagcaacgaaaccgagggaaacgcccctgaccctcctgacgttacgtttaaggccgttacgttacgtttggagtactagtcgggtacccatacgtaaggttccagcggcagtaggagtcgagacagattcactctcacancagcacgcngacacgcgattgtatttgacttacttcttactcgaacctaataatattactacttctccgtacggtcgtacgaccgacggaccgagggtacgaagtcgacgacgtaacgtggtacgcgtacgaccgtacctataccgttnttccgtcttaccg

SEQ ID NO: 232561 - DNA, 753 bp, Homo sapiens
  misc_feature: GYAE6OF01CHIIW.40.56.F01.1.454.CMB.1.raw
  modified_base (215)..(215): a, c, t, g, unknown or other
  misc_feature (215)..(215): n is a, c, g, or t
tcagtctagcgactcacgaccggtgctcgatttagcagacgtctgaacacacaaagggggggagtcagacccagtcaggacacagcatggacatgagggtccccgctcagctcctggggctcctgctgctctggctcccaggtgccaattgtgacatccagatgacccagtcctccctccaccctgtctgcctctagttggagacagggtcaacntcacgttcggccgggccaggtcggaggtactttataccgtggttcggccttggtactcagtaccaacggaaaccgagggaaaccgcccgtacgaccctccgtagtaacttccgtttaacggccgttacttaacgtttcgggaacgactaacggttcgggtaccctaagttacgaaacggtttcgaacggtcggacctagggttacgggacttaccggaggaactaaggtaaactttccacctacgttacgaacctataccacgaccgacgtccgtagaccgacgtccggtaatacggttagttttacgacctttaaacgttactttaacctacgtaacccgtaaactaaacgttaacgtttaacctaacggtttaccttacccggttacggggtacccgtttaaccgggaacccggtaacgggaaccccgttaaggggtaacgtaaaccggtaagtaaccgggtaaccgaacggttaggcgggtacccgttacgtacccgtaacgttaacttcgttacggttacccttcttaaccccg

SEQ ID NO: 232562 - DNA, 733 bp, Homo sapiens
  misc_feature: GYAE6OF01CPX39.40.56.F01.1.454.CMB.1.raw
  modified_base (119)..(119): a, c, t, g, unknown or other
  misc_feature (119)..(119): n is a, c, g, or t
  modified_base (358)..(358): a, c, t, g, unknown or other
  misc_feature (358)..(358): n is a, c, g, or t
  modified_base (380)..(380): a, c, t, g, unknown or other
  misc_feature (380)..(380): n is a, c, g, or t
  modified_base (521)..(521): a, c, t, g, unknown or other
  misc_feature (521)..(521): n is a, c, g, or t
  modified_base (579)..(579): a, c, t, g, unknown or other
  misc_feature (579)..(579): n is a, c, g, or t
tcagtctagcgactcacgaccggtgctcgatttagcagacgtctgtcggcggggggaactgctcagttaggacccagacggaaccatggaagccccagcgcagcttctcttccctcgtncttactcgtcggcctcccagactaccagtaggaataaatgtgctagaccgtcagttcctaccgacgcccctacccgttggttcctggttcgtaccgtaccgggaaagggggaaaacgcggaccctacccccttcgtccgtggaccggtagggacctaggtacgaggttacgttcgtaccgacccctaaacgttaaccgttacgccgtacggtaaccagaccgaaacgtaaccgcgaccncgtcccctaccgagtccctctnacttctagcctcaccactccgacgcggactacgtacggtacccaccgagtaccgtggtaccagggtcgtacggtacgggtttcggggacgtaagggtacctaacggttcccttacgaccctttaccgacgaacctgtacgngtacccgctcggactacgtacgtagttaggtaactttcttcgttatttattttccgtntgtactaggtacttaagttaacttacgttacgggtgtaccgttcttccggttacgggttcggggacggtaaaccgggtggtaagggttacgataccgtacggaaagtcggtagtacggtcgacctacgacttattacgttccgtaatttccccg

SEQ ID NO: 232563 - DNA, 844 bp, Homo sapiens
  misc_feature: GYAE6OF01ANGGA.40.56.F01.1.454.CMB.1.raw
  modified_base (202)..(202): a, c, t, g, unknown or other
  misc_feature (202)..(202): n is a, c, g, or t
tcagtctagcgactcacgaccggtgctcgatttagcagacgtctgtcggcgggggaactgctcagttaggacccagacggaaccatggaagcccccagcgcagcttctcttcctcctgctactctggctcccagatccactggagaatgtgctgacgcagtctccagcctacctgtcctgtcgtcctaccgaaggggaaacncggcctaccccttgtcccgtggaccgtacggggcctaaggtcgaggttaacggttcggttaccgcccctaaacgtaacgttttacggcccgtttaagggaacccaaggtaccgaaaccggtaaaacccggttccgggtaccccgtaaccggtccccgtacccgtaaccgggtcccttaccccgttacgtaactttacccgtttaaacgttccggttaccaccgttaaccgttacccgaacccggtaacggggtaccctaaccggtttaccgtaaccgtacccccgtaaaggtcccgttacgggttacccgagggtttacggaccgttaacggggttcggggttaccgtacggggtaaccgtaaccggttaccgttaccgtaccgttaccggttaaccaaccgtactaccgggtacgtacgtaccgtcgtacgtcgttaacgtcgtagtaacgtttcgtttacgtactttacggttttacttccgtacgtacgtacgtcgttaaacgttacgttaacgtaggttcggacgttaccgttacggttaccggttcgggaccggttagggtaccgtagggttcgagtagtaccgtaaggttggtaaacgttgtacggccttaccgccgtaatcgttcgtcgttaccg

SEQ ID NO: 232564 - DNA, 737 bp, Homo sapiens
  misc_feature: GYAE6OF01DHB9G.40.56.F01.1.454.CMB.1.raw
  modified_base (200)..(200): a, c, t, g, unknown or other
  misc_feature (200)..(200): n is a, c, g, or t
  modified_base (675)..(675): a, c, t, g, unknown or other
  misc_feature (675)..(675): n is a, c, g, or t
tcagtctagcgactcacgaccggtgctcgatttagcagacgtctgtcggcggggggaactgctcagttaggacccagacggaaccatggaagccccagcgcagcttctcttcctcctgcttactctggctccagataccactggagaaatagtgctgacgcacgtctccagccacctgtctgtgtctaccgagggaacgngccaccgtctcctgcgagggcagtcagtagttgttcaccgtaacctaacgttacgccgtacggtaacccaaggtaccaaaacggtaaaccgtcggacccctaacggacccttacccgaaggccccttacctacctattccgttaacgttaccggtacacctacctacccggaaccggtacgggtaccctaacggttacggttaaccctcccgaacgtaccgttacggttcgtaggtcggcgttacggggttcgggtacggtcgggaaacttacggacccttttacgacccgtttaccacgttaaaaccctgtaacccgaacgtaccgaaccgtccgagtaccgtaacgtagttaacggtaaagtttgtttaccgaatttttacgttttacgttcgtagttaccgaagttacgttaagttaattacgttacggtggtactcgttacgtacgttcgggacggtacggtaacgtaggnggtagaccgttacgaaggtaccgtagtggtactacgtcgaactaccgtacttcgtacgttcc

SEQ ID NO: 232565 - DNA, 1198 bp, Homo sapiens
  misc_feature: GYAE6OF01AFB8N.40.56.F01.1.454.CMB.1.raw
tcagtctagcgactcacgaccggtgctcgatttagcagacgtctgaacacacgaaaggggggagtcagacccagtcaggacacagcatggacatgagggtcccccgctcagcctcctggggcctcctgctgctcgtcggcctcccgaggtcgacctaatttggtgaacactcccaaggtattccgaacccctacgttcccctccccctaccccaccccgttgtcctccgtcccttacgttagttcgggaacggtaaccggtaacgggtaccaaaacctacgttacccgttaacccggtttccggggacccccggggggtacccgtaacgggggtttacccgggggtaaagggttttaaaccgtttttttaaccggtttaaccccggggtttttggggggttttacccggggttacccccggtttagggggtttaaccttacccggaacgggtaaaacccccgaaaaaccggggaaaaaccccggggtaaaacggggggtaaaaccccccgtccccccccggtttaacggtaacccccctttaccccggtttaggtttaaacccggtttttaacccggtttttaaaaccgggggtccccttttttaaacccgggttttaccgggtttttaaacggggggaaacccgtttaaacccgggttaaccgggttttcccccgggggttaaccccttaacggtttaaacccgggttaacgggtttacccggaacgggggtacccggtaccgggtaaaggggttacccgggtaaccggttaaccccgggaaacgtaaaccggtaaacggtttaaccctttaccccgtaacctttacccccgtaaaccctaacccgtacgttaccgaaccggtaccgttacccggaccgtacggaccccgggtacgggttaccgggtttatttaccggtttttaaacgttacccgttaaccgttttaaccgtttaacgttaccgaaccccgtttaaaaccgtaactttaaaccgttttaacgttaacccgttaacggttttaccccggttacccgggttaacccgggtaccgggtttacccgggaaccccgggttaacgggtacccgtaagggtaaccgtaacgtacccggaaagggtaccgttaccggttggtaccggcccttaccgaacccgttaccgtttctacggttttcccctacgtttcccggtacccccg

SEQ ID NO: 232566 - DNA, 709 bp, Homo sapiens
  misc_feature: GYAE6OF01BT7OV.40.56.F01.1.454.CMB.1.raw
  modified_base (544)..(544): a, c, t, g, unknown or other
  misc_feature (544)..(544): n is a, c, g, or t
  modified_base (695)..(695): a, c, t, g, unknown or other
  misc_feature (695)..(695): n is a, c, g, or t
  modified_base (701)..(701): a, c, t, g, unknown or other
  misc_feature (701)..(701): n is a, c, g, or t
tcagtctagcgactcacgaccggtgctcgatttagcagacgtctgaacacacaaaggggggagtcagacccagtcaggacacagcatggacatgagggtccccgctcagctccgtggggcctcctgctgctcgtggcctcccgaggtcgcctaattgtgacactccagatcgaccagtcctccctccgaccctgtctcgcctctagtggagacaggcaactatctacgttcggccggcgaggtcggtagtagtttactaccggtgggttcggtcgtaggtagacagaacgaacgaaaaccggaacgggaaaccgtccccgtacgaccgtacctaggtaacttacggtttaaacggtcgttacttacgttacggaagacgtaacgttcgggtaccacgttacgaacggttacgacgggtacggcctaaggtcggaacgtacgagaacgaagtaacttccgaacctctaccgactacgacacgtaccacggtcctaggccgtaacgtacgggtacttagtacgtttaccgacttaaaaccggtttntaccgacgtaaacctaacttaacgttaacttacgtagttaaccctcgggttacccgtaaggtacccggtaacgaccggaacccgtagggtaaagaaccgtttcggaactacggttacgacggttcacgttacgactaccgtatacggtttncccgtntaacccgg

SEQ ID NO: 232567 - DNA, 564 bp, Homo sapiens
  misc_feature: GYAE6OF01B3NYY.40.56.F01.1.454.CMB.1.raw
tcagtctagcgactcacgaccggtgctcgatttagcagacgtctgaacacacaaaggggggagtcagacccagtcaggacacagcatggacatgagggtccccgctcagctcctggggctcctgctgctctggctcccaggtgccaattgtgacatccagatgacccagtcctccctccaccctgtctgcctctattggagacagggtcaacatcacttgccgggccagtcggagtattataccgtggttggcctggtatcagcagaaaccagggaaacgcccctgacctcctgattcgtttaaggccgttcttactttggagacagtcggggtcccagtcgaaggttcaggcggcagtggatccgagacagattcactctcaccatcagcacgctgcagccggatgtatttgactaacttattactgacctaataattattaactagtttactcccgtacggtacgtttccggaccgaacgggacccgtagggtacgaaacgtcgaacggacgaacgttcggtggaccgtagacctacctattcgtcgttccttcgttacccg

SEQ ID NO: 232568 - DNA, 665 bp, Homo sapiens
  misc_feature: GYAE6OF01DTRLA.40.56.F01.1.454.CMB.1.raw
  modified_base (249)..(249): a, c, t, g, unknown or other
  misc_feature (249)..(249): n is a, c, g, or t
  modified_base (273)..(273): a, c, t, g, unknown or other
  misc_feature (273)..(273): n is a, c, g, or t
  modified_base (340)..(340): a, c, t, g, unknown or other
  misc_feature (340)..(340): n is a, c, g, or t
  modified_base (363)..(363): a, c, t, g, unknown or other
  misc_feature (363)..(363): n is a, c, g, or t
  modified_base (366)..(366): a, c, t, g, unknown or other
  misc_feature (366)..(366): n is a, c, g, or t
  modified_base (414)..(414): a, c, t, g, unknown or other
  misc_feature (414)..(414): n is a, c, g, or t
  modified_base (446)..(446): a, c, t, g, unknown or other
  misc_feature (446)..(446): n is a, c, g, or t
  modified_base (455)..(455): a, c, t, g, unknown or other
  misc_feature (455)..(455): n is a, c, g, or t
  modified_base (658)..(658): a, c, t, g, unknown or other
  misc_feature (658)..(658): n is a, c, g, or t
tcagtctagcgactcacgaccggtgctcgatttagcagacgtctgtcggcggggggaactgctcagttacggacccaaggacggaaccagtggaacgcccagcgcatcttctcttcctctgctactctcggctccagactaccagtaggaagaaattgtcgctggaccgcaacgttccaccgaccgaccctacccgtgttcgtgtcggtaccgacgggaaggggaaacaccgccaccccgttcgtccgnggacgaggtactacgacgtaggtntcggtacgaccctactaacgttcgaccgtacggaacacggaacgaacgtaaccgcgaccacgtcccncacggtcctctactatccgttancgngtaccacaccgaccgaggcctacgtacgtcctaccgagtcgtagtcgngacgtgaggggtcgtagaccgatccgtatacntacgaaccncactacgacgtcacgtcgacgtactacgtacgtagtaacttgttacgttacgtttatttacgtacgtagtactaacgtacttaagttaaccggttaggtaggttcgtccgttacgtaacggttcgggtaacccgggaggtaaccggtaggagtaacggctaaggcgtaagcggtagtgggtacccagtaccgctaacgtcgtntcgttac

SEQ ID NO: 232569 - DNA, 770 bp, Homo sapiens
  misc_feature: GYAE6OF01A9Y0Y.40.56.F01.1.454.CMB.1.raw
  modified_base (293)..(293): a, c, t, g, unknown or other
  misc_feature (293)..(293): n is a, c, g, or t
  modified_base (490)..(490): a, c, t, g, unknown or other
  misc_feature (490)..(490): n is a, c, g, or t
tcagtctagcgactcacgaccggtgctcgatttagcagacgtctgaacacacgaaagggggggagtcagacccagtcaggacacagcatggacatgaggggtccccgctcagctccgtggggctcctgctgctcgtggcctcccgaggtgacctaagttgtgacataccagatccgacctacgtccctccctccctaccctcgtctcgtcctctagtggagacggaggacaactatctacggtcggccggccaggtcggagttattacgtacgttgggttcgcgttaggtacncacggacgaaacggaaaccgagggaacctcccgtactacccgtcgtagtacgttacgttaaggtccgttacttacgtgggactacgtacggtccgggtaccctaggttaaccggtaacggtcgacgggtaccggagtaacggtcggacgtaccgaaggaaactaacgtaacttacccacgtcctaacctaaccgtanaccgacgacctaccggtcctagggaccgtacggtacggttacgttagtttaacctttaccgtaaacgttaacctttacgtaacgtacccgaaacttaaaacttacctttaaacgtttacgttaaccggttcccggtaacccgggtacccgggttaacggaccggtaaccgaacggggtaacgttacggtaacgaaccgtaacggacggtaacggttaacgtcgggacgtaccgaccggttacctacggtatttacccggttcgttaccctaccgttcccg

SEQ ID NO: 232570 - DNA, 804 bp, Homo sapiens
  misc_feature: GYAE6OF01AYVFJ.40.56.F01.1.454.CMB.1.raw
  modified_base (206)..(206): a, c, t, g, unknown or other
  misc_feature (206)..(206): n is a, c, g, or t
  modified_base (254)..(254): a, c, t, g, unknown or other
  misc_feature (254)..(254): n is a, c, g, or t
  modified_base (327)..(327): a, c, t, g, unknown or other
  misc_feature (327)..(327): n is a, c, g, or t
tcagtctagcgactcacgaccggtgctcgatttagcagacgtctggtcggcggggggaactgctcagttaggacccagacggaaccagtggaagccccagcgcagcttctcttcctcctgcctactctggcctacccagtacttaccacgtggaacgaaattacggtgctggacgcgacgtctccacgcccacccgtgttctcgtntccgtaccggagggaaacgcggccacccgttccactcgacgacggacnggtacagacggttcttccgaccaaccgtaatttcggcctacggtacgacgtacgaacgtaaccgtccgaaccnccgtacccgccggtaatcccgttccactaacctcttaaccgtcgtccggccctaacgtccgacccgacggtaccgacctttgacccgtaccgagtacccgtaagggtacgacgggtacgtacggtacgggtccgttaagggaaccaccggtttagttaccccacgtacccgttacccttaccggaatacccacggttcccgaccgccgtttccggacctacgttaaccgtaagttagtttccgtttaaacgttcttttaacggttttactttacggtacctcgtaacgttcttaaggttaacttacggttacggtgtaccgtcgtttaccggttacggtacgggttaccgtaaaggggtaccgaacgggttacgtaagggttccctaagggtttaacccgaagggttaacgttcgggttaaccgtacccgtacgtaacccgttaggacccgttttacggttaccttaccggtttccc

SEQ ID NO: 232571 - DNA, 496 bp, Homo sapiens
  misc_feature: GYAE6OF02GHNKA.40.56.F01.1.454.CMB.1.raw
  modified_base (240)..(240): a, c, t, g, unknown or other
  misc_feature (240)..(240): n is a, c, g, or t
tcagtctagcgactcacgaccggtgctcgatttagcagacgtctgaacacacaaagggggagtcagacccagtcaggacacagcatggacatgagggtccccgctcagctcctggggctcctgctgctctggctcccaggtgccaattgtgacatccagatgacccagtctccctccaccctgtctgcctctattggagacagggtcaacatcacttgccgggccagtcggaggatttanacctggttggcctggtatcagcagaaaccagggaaagcccctgacctcctgatctttaaggcgtctactttggagacatgggtcccatcaaggttcagcggcaatggatccgagacagaattcactctcaccatcagcagcctgcagccggatgatttgctaacttattactgccaactaatattacagttatcctcggacgttcggccaagggacccaggtgaatcagacgactgtgctgcacatctgtctctac

SEQ ID NO: 232572 - DNA, 508 bp, Homo sapiens
  misc_feature: GYAE6OF02GXOED.40.56.F01.1.454.CMB.1.raw
tcagtctagcgactcacgaccggtgctcgatttagcagacgtctgaacacacaaaggggggagtcagacccagtcaggacacagcatggacatgagggtccccgctcagctcctggggctcctgctgctctggctcccaggtgccaattgtgacatccagatgacccagtctccctccaccctgtctgcctctattggagacagggtcaacatcacttgccgggccagtcggaggatttatacctgattggcctggtatcagcagaaaccagggaaagcccctgacctcctgatctttaaggcgtctactttggagacatgggtcccatcaaggttcagcggcagtggatccgagacagaattcactctcaccatcagcagcctgcagccggatgattttgctaacttattactgaccaacaatattacagtttactcctacggtacgttcggaccaagggacccaggtggaatcgaagacgaactgtcggctgcaccatctgtcttc

SEQ ID NO: 232573 - DNA, 506 bp, Homo sapiens
  misc_feature: GYAE6OF02GUG24.40.56.F01.1.454.CMB.1.raw
  modified_base (241)..(241): a, c, t, g, unknown or other
  misc_feature (241)..(241): n is a, c, g, or t
tcagtctagcgactcacgaccggtgctcgatttagcagacgtctgaacacacaaaggggggagtcagacccagtcaggacacagcatggacatgagggtccccgctcagctcctggggctcctgctgctctggctcccaggtgccaattgtgacatccagatgacccagtctccctccaccctgtctgcctctattggagacagggtcaacatcacttgccgggccagtcggaggatttanacctgattggcctggtatcagcagaaaccagggaaagcccctgacctcctgatctttaaggcgtctactttggagacatgggtcccatcaaggttcagcggcagtggatccgagacagaattcactctcaccatcagcagcctgcagccgatgatttgctaacttattactgccaacaatattacagttatccgtcggtacgttcggaccaaggacccgaggtacgaatcgaagacgaactgtcgctcgcacctatctgtcttac

SEQ ID NO: 232574 - DNA, 504 bp, Homo sapiens
  misc_feature: GYAE6OF02I0YNS.40.56.F01.1.454.CMB.1.raw
  modified_base (399)..(399): a, c, t, g, unknown or other
  misc_feature (399)..(399): n is a, c, g, or t
  modified_base (501)..(501): a, c, t, g, unknown or other
  misc_feature (501)..(501): n is a, c, g, or t
tcagtctagcgactcacgaccggtgctcgatttagcagacgtctgaacacacaaaggggggagtcagacccagtcaggacacagcatggacatgagggtccccgctcagctcctggggctcctgctgctctggctcccaggtgccaattgtgacatccagatgacccagtctccctccaccctgtctgcctctattggagacagggtcaacatcacttgccgggccagtcggaggatttatacctggttggcctggtatcagcagaaaccagggaaagcccctgacctcctgatcttaaggcgtctactttggagacatgggtcccatcaaggttcagcggcagtggatccgagacagaattcactctcaccatcagcagcctgcagccgatgtatttnctaattattactcgaccaacaattattacagttactcctcggtacgtttcggaccaagggacccaggtagaatcagacgaactgtcgctgcacatctgtctntac

SEQ ID NO: 232575 - DNA, 559 bp, Homo sapiens
  misc_feature: GYAE6OF02IXZMR.40.56.F01.1.454.CMB.1.raw
  modified_base (376)..(376): a, c, t, g, unknown or other
  misc_feature (376)..(376): n is a, c, g, or t
  modified_base (406)..(406): a, c, t, g, unknown or other
  misc_feature (406)..(406): n is a, c, g, or t
tcagtctagcgactcacgaccggtgctcgatttagcagacgtctgtcggcggggggaactgctcagttaggacccagacggaaccatggaagccccagcgcagcttctcttcctcctgctactctggctcccagataccactggagaaatagtgctgacgcagtctccagccaccctgtctgtgtctccaggggaaagaggcaccctctcctgcgagggcagtcagagtgttcgccaccaacttagcctggtaccagcagaaacctggccagcctccaggcctcctcatctatcgtgcactcccaccagggccactggtactcccagccaggttcagtcggcaggtgggtctgggacagtacttcactctacaccntcagcagcctgcagtctagaagtatttcgntagtttattcttgtcagtctagtattagtaacgtgggtctcgttactaccgtttcgggacgggtaacgggaccgtaagggtggtaacggtacgtacgaaacggacgtaacgttcggtggaccttggacccaccgtaacgttccttggttaccc

SEQ ID NO: 232576 - DNA, 740 bp, Homo sapiens
  misc_feature: GYAE6OF02FYMSX.40.56.F01.1.454.CMB.1.raw
tcagtctagcgactcacgaccggtgctcgatttagcagacgtctgtcgggcgggggaactgctcagttaggacccagacggaaccatggaagccccagcgcagcttctcttcctcctgctactctggctcccagataccactggagaaatagttgactgaacgcacgtactccacgcctaccctgtctgtcgtcggtccgagggaagcgtcctacctctccgtgacgacggctacgtcgagtacgtgtcgactacctaacgttacgccgttaggtacccaaggcgaacggaacccgttcggaccaacggtccctacccgacggtcctcctcaattcttagtcgtacgcctactcccgaaccgaccggcctacgtacggtacctaccgacgtccgtacggttcgacggtcggcggtacggttcgggtacgtacgggaactacggtacttcgtaccgtctacctacctactacgagcctaggtcccgtaggtacccgttaaggtaccgtaacgtaacgttacgttttacggacttttacggtttacctttccgtagtacctaacgtacgtttacgttaacgttaacgttaccggttacggttccttaaccgtttccggtaacggtttaccgggaaccgggtaacggtaaccggtagggtacgtaacggaacttaacggaaccgtacggtaacgttcgtacgggtacctacggtacctacccgttgtttaccggtacttcccg

SEQ ID NO: 232577 - DNA, 554 bp, Homo sapiens
  misc_feature: GYAE6OF02JHY8U.40.56.F01.1.454.CMB.1.raw
  modified_base (240)..(240): a, c, t, g, unknown or other
  misc_feature (240)..(240): n is a, c, g, or t
  modified_base (275)..(275): a, c, t, g, unknown or other
  misc_feature (275)..(275): n is a, c, g, or t
  modified_base (304)..(304): a, c, t, g, unknown or other
  misc_feature (304)..(304): n is a, c, g, or t
  modified_base (314)..(314): a, c, t, g, unknown or other
  misc_feature (314)..(314): n is a, c, g, or t
tcagtctagcgactcacgaccggtgctcgatttagcagacgtctgaacacacaaaggggggagtcagacccagtcaggacacagcatggacatgagggtccccgctcagctcctggggctcctgctgctctggctcccaggtgccaattgtgacatccagatgacccagtctccctccaccctgtctgcctctattggagacagggtcaacatcacttgccgggccagtcggagatttanacctggttgcctggtatcagcagaaccagggaacncccctgacctcctgactctttaaggcctntactttgganacagtcgggtcccatcaaggttcagcggcagtggatccgagacagtacttcactctcaccatcacgcagcctgcagccggatagtagttttacgactaactttatactcgacctaaactaattataactagttactaccgtacggtacgttcgaccgtaacggaccgtagtaggactacgacggtaacgtaacgtggtacggtctacgacctaccgtacttcgtacgttacttccgtacc

SEQ ID NO: 232578 - DNA, 517 bp, Homo sapiens
  misc_feature: GYAE6OF02GLZGT.40.56.F01.1.454.CMB.1.raw
  modified_base (437)..(437): a, c, t, g, unknown or other
  misc_feature (437)..(437): n is a, c, g, or t
  modified_base (496)..(496): a, c, t, g, unknown or other
  misc_feature (496)..(496): n is a, c, g, or t
tcagtctagcgactcacgaccggtgctcgatttagcagacgtctgaacacacaaaggggggagtcagacccagtcaggacacagcatggacatgagggtccccgctcagctcctggggctcctgctgctctggctcccaggtgccaattgtgacatccagatgacccagtctccctccaccctgtctgcctctattggagacagggtcaacatcacttgccgggccagtcggaggattatacctgattggcctggtatcagcagaaaccagggaaacgcccctgacctcctgatctttaaggcgttctactttggagacatgggtccatcaaggttcagcggcagtggatcgagacagaatcactctcacatcagcagctgcagcgatgtatttgactaacttattactgaccaaacaattacttaacagtttaacnccgttacgtaccgttcggaccgaagggacccaggtagaatcgaagacgtaactgtacgngtcgacaccatctcgtctacc

SEQ ID NO: 232579 - DNA, 584 bp, Homo sapiens
  misc_feature: GYAE6OF02G38UA.40.56.F01.1.454.CMB.1.raw
tcagtctagcgactcacgaccggtgctcgatttagcagacgtctgaacacacaaaggggggagtcagacccagtcaggacacagcatggacatgagggtccccgctcagctcctggggctcctgctgctctggctcccaggtgccaattgtgacatccagatgacccagtctccctccaccctgtctgcctctattggagacagggtcaacatcacttgccgggcagtcggaggatttatacctggttggcctggtatcagcagaaaccagggaaagcccctgaccctcctgatctttaaggcgtctactttggagacatcgggtcccatcaaggttcagcgcagtgatcgagacagaattcactctacacatcagcagcctgcagccggatgtatttgacttaactttattactacgacctaaacgtaattacttaacctagtttactaccgttacggtaccgtttccggacccgtaaacgggaccccgtagggtacggaaacttcgaacggtaaccgaacgttaggtacggtaccgttacggacctaccggtaacttccgtacggttccttacgttaccccg

SEQ ID NO: 232580 - DNA, 718 bp, Homo sapiens
  misc_feature: GYAE6OF02GPI6R.40.56.F01.1.454.CMB.1.raw
  modified_base (213)..(213): a, c, t, g, unknown or other
  misc_feature (213)..(213): n is a, c, g, or t
  modified_base (244)..(244): a, c, t, g, unknown or other
  misc_feature (244)..(244): n is a, c, g, or t
tcagtctagcgactcacgaccggtgctcgatttagcagacgtctgaacacacaaagggggagtcgagaccagtcaggacacagcatggacatgagggtccccgctcagctcctggggctcctgctgctctggctcccaggtgccaattgtgacatccagatgacccagtctccctccaccctgtctcgcctacttatggatacagggtcaacntcacttgccgggtccagtcggaggactttanacctgtattggcctggtatcagcagaaacgagggtaaacgcccctagacctcgtcgacttcgtttaacggcgttactacttttgggactacgtacgttgggtaccctagtacctaagggtttcacggtcggactggtaggacgttccggaagtacagaaatttacccgacgttcctaccaaccactactaacgcgacgtaccgtcgacgtacgacccggaacgttcgtacgtttttcgaaccgtttaacgtttaacttaaccgttacgtaccctaaaacgtaactttaacttaaccgttaacggttttaccttacccggttaaccggttaccgggtttaccgtacccggtaaaccgggtaacccggtaccgggttaaggtaaccggttaaccggtaaccggtaaaccggtaaccgtaacgggtacggtaccgtacgtcggtaaacccctagttacccttcggtacctttacccg

SEQ ID NO: 232581 - DNA, 727 bp, Homo sapiens
  misc_feature: GYAE6OF02IRI10.40.56.F01.1.454.CMB.1.raw
tcagtctagcgactcacgaccggtgctcgatttagcagacgtctgaacacacaaaggggggagtcagacccagtcaggacacagcatggacatgagggtccccgctcagctcctggggctcctgctgctctggctcccaggtgccaattgtgacatccagatgacccagtctccctccaccctgtctgcctctattggagacgagggtcaacatcacttggcccgggccaggtcggaggtatttatacctgattggcctggtatcagcaagaaaccgagggaaacgcccctagaccctcctgacttacgtttaacggcgttccttacgtttggagactacgtcgggtacccagttaccgtaacggttcgacgtcgggaccgtaggtcggtaacgtaccggacgaacgtaagtaacttaccaccttacctaccaaccacttaccgacgtaccaacggcccgttacggacccaacgggtcccggtaatttacggtacttttacggaaccttaaacgttttaacgttaccgaacgtaaccctaaaacctaattaacgtttaaccgtaacggtttaaccctaccggttaaccgggttacccggttaacccggtaacccggtaaacgggtaccccgtaaggggttacgtaaacgtaccggaaacgtaaaccggtacgttaacggtcggtaccgtaggaccctaccggttatccggttacgttccgttacccg

SEQ ID NO: 232582 - DNA, 514 bp, Homo sapiens
  misc_feature: GYAE6OF02GQZ24.40.56.F01.1.454.CMB.1.raw
  modified_base (336)..(336): a, c, t, g, unknown or other
  misc_feature (336)..(336): n is a, c, g, or t
  modified_base (347)..(347): a, c, t, g, unknown or other
  misc_feature (347)..(347): n is a, c, g, or t
  modified_base (359)..(359): a, c, t, g, unknown or other
  misc_feature (359)..(359): n is a, c, g, or t
  modified_base (375)..(375): a, c, t, g, unknown or other
  misc_feature (375)..(375): n is a, c, g, or t
tcagtctagcgactcacgaccggtgctcgatttagcagacgtctgaacacacaaaggggggagtcagacccagtcaggacacagcatggacatgagggtccccgctcagctcctggggctcctgctgctctggctcccaggtgccaattgtgacatccagatgacccagtctccctccaccctgtctgcctctattggagacagggtcaacatcacttgccgggccagtcggaggattatacctgattggcctggtatcagcagaaaccagggaagcccctgacctctgatcttaaggctctactttggagacatgggtcccatcaaggtcagcgnagtggatcganacagatcactcncacatcagcagctgcngcgatgtatttgctaattatactgaccaaatatattacagttactccgtacggtaccgttacggaccgtaagggacctaggtacggaatacgaacgaacgtaactggtacggccgtcgcaccgtactcttcgtcttacc

SEQ ID NO: 232583 - DNA, 535 bp, Homo sapiens
  misc_feature: GYAE6OF02FF23Z.40.56.F01.1.454.CMB.1.raw
  modified_base (193)..(193): a, c, t, g, unknown or other
  misc_feature (193)..(193): n is a, c, g, or t
  modified_base (213)..(213): a, c, t, g, unknown or other
  misc_feature (213)..(213): n is a, c, g, or t
  modified_base (279)..(279): a, c, t, g, unknown or other
  misc_feature (279)..(279): n is a, c, g, or t
  modified_base (381)..(381): a, c, t, g, unknown or other
  misc_feature (381)..(381): n is a, c, g, or t
  modified_base (480)..(480): a, c, t, g, unknown or other
  misc_feature (480)..(480): n is a, c, g, or t
tcagtctagcgactcacgaccggtgctcgatttagcagacgtctgaacacacaaaggggggagtcagacccagtcaggacacagcatggacatgagggtccccgctcagctcctgggggctcctgctgctctggctcccaggtgccaattgtgacatccagatgacccagtctccctccaccctgtctgcctntattggagacagggtcaacntcacttgccgggcaggtcggaggtattttatacctggttgcctggtatcagcagaaccagggaaancccctgacctctgatcttaaggctctactttggagacatcgggtccatcaaggttcagcggcagtgatcgagacagatcactctcaccatcagcagcctgcngcgatgattttgactaacttattactgaccaactaatatttaccagtttactccgttacggacgtttaccggacctaaagggccctagggtacggaacncgacgtaacggaacttggtacggactcgaccactaagtctacgttccttataccg

SEQ ID NO: 232584 - DNA, 573 bp, Homo sapiens
  misc_feature: GYAE6OF02FY5HY.40.56.F01.1.454.CMB.1.raw
  modified_base (213)..(213): a, c, t, g, unknown or other
  misc_feature (213)..(213): n is a, c, g, or t
  modified_base (241)..(241): a, c, t, g, unknown or other
  misc_feature (241)..(241): n is a, c, g, or t
tcagtctagcgactcacgaccggtgctcgatttagcagacgtctgaacacacaaagggggggagtcagacccagtcaggacacagcatggacatgagggtccccgctcagctcctggggctcctgctgctctggctcccaggtgccaattgtgacatccagatgacccagtctccctccaccctgtctgcctctattggagacagggtcaacntcacttgccgggcagtcggaggatttanaccgtggttggcctggtatcagcaagaaaccagggaaagcccctgacctcctgatctttaaggcgtactactttggaagacagtcggtcccatcaaggttcacgtcggcagtgatcgagacagaattcactctcaccatcagcagcctgcaggccggatggtatttgactaacttattactcaccaaataataacttacaagtttactcccgttagggtaccgtttcggaccgaaacgggacccgtagggtaacggtaagtcgtaaggaaccggtaacgttacggtacggtacgtcgaccgtaaccgtacttacggtcgtactttccgtaac

SEQ ID NO: 232585 - DNA, 726 bp, Homo sapiens
  misc_feature: GYAE6OF02HVWN3.40.56.F01.1.454.CMB.1.raw
  modified_base (517)..(517): a, c, t, g, unknown or other
  misc_feature (517)..(517): n is a, c, g, or t
tcagtctagcgactcacgaccggtgctcgatttagcagacgtctgaacacacaaaggggggagtcagacccagtcaggacacagcatggacatgagggtccccgctcagctcctggggctcctgctgctctggcctcccaggtgccaattgtgacatccagatgacccagtcctccctccaccctgtctcgcctctattggagacgagggtacaacatacacttcggccggccaggtcggaggtatttatacctagtattggcctaggtatcaggacaagaaaccgaaggaacgcccctagaccctcgtgaactttcgttaaggcgttccttaacgtttggaacgacgtaacgtcgggtaccctaagttaccgtaacggttacgaaggccgggtaccgtaaggttcgggaacgttacccggaaagtaaccgaaagttaaccgttacctaaccgttacctaccaaccctacgtaacgacgtcaaaccggtcccgtagaacgacgggtaccgtaagttnttacggttttacaccgtttaactttaacttaacgtacgaaaccctaaacttaattaaccttaacgtacggtttacttacccggtacggttaacggttcccggaaaccggtaaaccgggaccgtaaggggtacggtaaacgtccggaacgtaaaccggttactaggtcgggaccttcgaacccgttactggttaccttacgttccttaac

SEQ ID NO: 232586 - DNA, 801 bp, Homo sapiens
  misc_feature: GYAE6OF02HJH4A.40.56.F01.1.454.CMB.1.raw
  modified_base (285)..(285): a, c, t, g, unknown or other
  misc_feature (285)..(285): n is a, c, g, or t
  modified_base (297)..(297): a, c, t, g, unknown or other
  misc_feature (297)..(297): n is a, c, g, or t
tcagtctagcgactcacgaccggtgctcgatttagcagacgtctgaacacacaaaggggggagtcagacccagtcaggacacagcatggacatgagggtccccgctcagctcctggggctcctgctgctctggctcccaggtgccaattgtgacatccagatgacccagtcctccctccaccctgtctgcctctagttggagacagggtcaacatcacttggccgggccaggtcggaggtatttacacctgagttggctggtatcgagcaagaaccgagggaacnccctgacctccngtacttacgtttaacggccgttacgttacgtttggaacgtacgtaggttaccgggtacccagttacgtaacggttcgaacggccgggtactaggtacggtaacgtacccggaaggtaaccgtaaggttaaacttcctaaaccgttcccgttaaacccacccgtaacttaccggacgtaccgacgggtccctacgggaccaacgggtccgggtaaattcggtttaactttaccggaacctttaaaccgtttacgtttaacccgtacgtaaacccgttaaaaccttaacgtttaaaccgttaaccgtacgttttaaacccgttcccgggttaacccggggttaacccgggtttacccgggaaacccggttaaaccgggggtaaccccgtaggggtaacgtaaaccgttccgggaaaaccggttaaccgtaacgttaccggggtccggtaccttacggtaccccgaaccgtttacggttacccgttacggtttacccgtttacccgg

SEQ ID NO: 232587 - DNA, 712 bp, Homo sapiens
  misc_feature: GYAE6OF02F106J.40.56.F01.1.454.CMB.1.raw
  modified_base (391)..(391): a, c, t, g, unknown or other
  misc_feature (391)..(391): n is a, c, g, or t
tcagtctagcgactcacgaccggtgctcgatttagcagacgtctgaacacacaaaggggggagtcagacccagtcaggacacagcatggacatgagggtccccgctcagctcctggggctcctgctgctctggctcccaggtgccaattgtgacatccagatgacccagtctccctccaccctgtctgcctctattggagacagggtcaacatcacttggccgggccaggtcggaggtatttatacctgtattggcctggtactcgagcaagaaaccgagggaaacgcccctggaccctctgattcgttaaggccgttctacgtttggacgtactagttcgggtccctaagttcctaagggttcaagccgggacaggtgggactccggaanaccgaagtaacttaccgaccttacctaccgaacctaagttccaagggtacccaacggtccccgtagacccgacgggtacccgggtaagtacggttaacgtttttcggaaaccttaaaccgtttttataacccgttaccgtaacccgtaaaacttaacttaacgtttaactacggttttaaccttcccggttaaccgggttacccgggttaccggaacccggtaaacgggaccccgtaaggtacggaaactcggaaacggaaccgttactagggtaccggtacgtacggacctacccgtagtaccgtttagtcccgttaacg

SEQ ID NO: 232588 - DNA, 581 bp, Homo sapiens
  misc_feature: GYAE6OF02G0DY8.40.56.F01.1.454.CMB.1.raw
  modified_base (323)..(323): a, c, t, g, unknown or other
  misc_feature (323)..(323): n is a, c, g, or t
  modified_base (427)..(427): a, c, t, g, unknown or other
  misc_feature (427)..(427): n is a, c, g, or t
tcagtctagcgactcacgaccggtgctcgatttagcagacgtctgaacacacaaaggggggagtcagacccagtcaggacacagcatggacatgagggtccccgctcagctcctggggctcctgctgctctggctcccaggtgccaattgtgacatccagatgacccagtctccctccaccctgtctgcctctattggagacagggtcaacatcacttggcccgggcaggtcggaggtattataccgtggttcggcctggtatcagcagaaaccgagggaacgccctgaccctcctgattcttaaggcttactacgtttgganacagtcgggtcccatcgaaggttcaggcggacaggtggactccgagacagtattcactctacaccatcagcagcctgcagccgatgtagtttcgactaactttntactgacctaaacgtattaacttacgtagtttacctccgtacggttaccgttccggaaccgtaacgggtacccgtaagggtaccgtaagtccgaacggtaccgtaacgtcggtcggctacgaccacctaattccgtacggttccttacgtaccc

SEQ ID NO: 232589 - DNA, 874 bp, Homo sapiens
  misc_feature: GYAE6OF02H4N9T.40.56.F01.1.454.CMB.1.raw
tcagtctagcgactcacgaccggtgctcgatttagcagacgtctgaacacacaaaggggggagtcagacccagtcaggacacagcatggacatgagggtccccgctcagctcctggggctcctgctgctctggcctcccaggtgccaattcgtgacatccagatgacccagtctccctccaccctgtctgcctctacttggagacagggtcaacatccgacgttcgccggggacctaggtcgggtaggtaattttaactacccgttaggtaacgtttcgggcccgttaggggttaactccgtaagacccgtaaaggaaaaacccgtaacgggggaaaaccgtccccccgttaacggtaaccccttacccgtttaggacgtttaaaccggtttttaaacggaccggtttacctttaacgttttacgggtaaacggtaaccgttaacggtttacggggttacccccaacgttaccggttaaaagggtttccgaacggtacccgggaccgtagttacggacgttacccggaagtaacaaggttaaacttacaaccttacgtaccactaacgtcaacggactaaacggtcccgttagaccgaacgggtaccggtaacgttacgttacgtttttacgaaccgtttaaacctttaaattacccttaacgacctaaaacgtaaacgtttaactttaaacctaagttttaacccgttcccgggttaacggttacccgggtttaacggtaaccccgggttaaagggaaccccggttaggttaaaccgggaaacctttacggaaacggtaccggtaacggttaaacggtcgggttaacctacggtacccaaaccggtacctttacgttaccgtttacttacccg

SEQ ID NO: 232590 - DNA, 770 bp, Homo sapiens
  misc_feature: GYAE6OF02GH0OQ.40.56.F01.1.454.CMB.1.raw
  modified_base (130)..(130): a, c, t, g, unknown or other
  misc_feature (130)..(130): n is a, c, g, or t
  modified_base (292)..(292): a, c, t, g, unknown or other
  misc_feature (292)..(292): n is a, c, g, or t
tcagtctagcgactcacgaccggtgctcgatttagcagacgtctgaacacacaaaggggggagtcagacccagtcaggacacagcatggacatgagggtccccgctcagctcctggggctcctgctgctntggctcccaggtgcctaattgtgacatccagatgacccagtcctccctccaccctgtctgcctctattggagacgagggtacaactatcacttggccgggtccaggtcgggaggtatttataccgtggttcgccgtggtatcagcaacgaaccgagggaacnccctagacctctagatactttaggcgttacttagttggacgtcacgtcgggtaccctagtacgtaacggttcacggacggtacgtaggtcggtacgtacccgggtaagaacgtaagtaaacttccgtaaccttcccgtaacctaacccgtaataccgaacgacccgtaacggtccctacggaccgtaaccgggtacccggttaatttaacgggtttacttttaaccgggaacctttaaaaccgtttttaaccgttttaccgaaccggtaaaccctaaaacgttaaaacgttttaaccttaaccggttaacgttttaaccgttcccgggttaaccgggtacccggtttaccgggtaaccggtaaaccggggtaacccgtaagggtaaccggttaagtaccgtaaacggtaaccggttaacgttacggtggttaccgagtacctacctacggttacttcggtttacccttcgttaacccg

SEQ ID NO: 232591 - DNA, 636 bp, Homo sapiens
  misc_feature: GYAE6OF02GB9BP.40.56.F01.1.454.CMB.1.raw
  modified_base (109)..(109): a, c, t, g, unknown or other
  misc_feature (109)..(109): n is a, c, g, or t
tcagtctagcgactcacgaccggtgctcgatttagcagacgtctgaacacaacaaaaggggggagtcacgacccagtcaggaccacagcatggacatgagggtccccgntcagctcctggggcttcctgctgctctggctcccaggtcgccaattgtgactatccagatgacccgagtctccctccaccctgtctcggcctctattggagacagggtcaacatcctacttcggccgggccaggtcgggaggtattttatacctggttggcctggtatcgagcagaaaccgacggggaaagcccgtgacctcctgacttcgtttaaggccgttcttacgtttgggacgctagtcgggtacccatacgtaaggttcagcggacaggtgactccgagactagtaacttcactctacaccatcacgcacgctgcagtccggatacgtgtttgacttaacgttattactcgaacctaaataacttactttacgtagtttacctaccgttcggtaccggtttccggaccggtaaacggtacccgttaagggtacggtaaccgttcgaacggaacggtaacgttcgggtacggtacgttacggaccgtaccggtacttccgttcggttaccttaccgtacccg

SEQ ID NO: 232592 - DNA, 797 bp, Homo sapiens
  misc_feature: GYAE6OF02HF8KE.40.56.F01.1.454.CMB.1.raw
  modified_base (297)..(297): a, c, t, g, unknown or other
  misc_feature (297)..(297): n is a, c, g, or t
tcagtctagcgactcacgaccggtgctcgatttagcagacgtctgaacacacaaaggggggagtcagacccagtcaggacacagcatggacatgagggtccccgctcagctcctggggctcctgctgctctggctcccaggtgccaattgtgacatccagatcgacccagtcctccctccaccctgtctcgcctctattgggagacgagggtacaactatcacttcggccgggccaggtcggaggtatttataccgtggttcggccttggtatcagacaaggaaaccgagggaaacnccgtaccgacctcctcgtactaccgtttaacggtacgtcttacgtttagtagacgtagtcggtaccgctacgacggtacgtagcggtcgagtggtactacgacgtacgtaagtaatactactacctacctaccgaaccttacgacgacgtaccgtaccgtccgtacgaaccgtccgggtacgttacgtttacgttttaccggttacgttaaacccttttaaatttaccgttaccgtaaacccaaacgttaacttaaacgtttaaccgttaacgtttaaccgtttacccgtacccggggtttaacccgggttacccgggttaaccccgggggaaaccggttaacccggggtaaccgggttaacggggtaaacgtttaaaccgggaacggttaaacccggtaaacccgggtttcgggttaaccgggtacccggttaacggtaaccccgtaacccgttaacccgttttacgacccggtttttacccttaacccggttaccccg

SEQ ID NO: 232593 - DNA, 623 bp, Homo sapiens
  misc_feature: GYAE6OF02FIA70.40.56.F01.1.454.CMB.1.raw
  modified_base (305)..(305): a, c, t, g, unknown or other
  misc_feature (305)..(305): n is a, c, g, or t
tcagtctagcgactcacgaccggtgctcgatttagcagacgtctgaacacacaaaggggggagtcagacccagtcaggacacagcatggacatgagggtccccgctcagctcctggggctcctgctgctctggctcccaggtgccaattgtgacatccagatgacccagtcctccctccaccctgtctgccctctattgggaagacagggtccaacactcacttgcccggggccaggtccgggaggtactttacacctgacttggccctggtatcagcagaaacctacggggaaacgccccctanacctcctgtatctttaaggcgttctactttggacgacatcgggtccagtacaaggtttacagcggcgagtcggatccgaagacagaacttcactactcaccatccacgcacgcctgccagccggtatcgtatttcgctaactttactaactcgacctaaactaaattataacttagtttactaccgttacgggtaccgtttccgaacccggtaaacgggacccctaggggttacggaacgtaccgtaacggaaccgtaaccgttcggtacgggacctcggaaccgtaccctacttaccgttcgttaccggtttaaccc

SEQ ID NO: 232594 - DNA, 708 bp, Homo sapiens
  misc_feature: GYAE6OF02JHASQ.40.56.F01.1.454.CMB.1.raw
tcagtctagcgactcacgaccggtgctcgatttagcagacgtctgaacacacaaaggggggagtcagacccagtcaggacacagcatggacatgagggtccccgctcagctcctggggctcctgctgctctggctcccaggtgccaattgtgacatccagatgacccagtcctccctccaccctgtctgcctctacttggagacgagggtcaacatcacttcgccgggccagtcggaggtatttacgtacctgtattggcctggtacttccagaccaacgaaaccgacgggaaacgccccctagaccctccgtagtacttacgtttaaggccgttacttacgtttaggaacgtacgtagtcgggtaccctagttacgtaacggttcgacggcggacgtaggtcggacgtaccggaacgtacgaagtaacgttacaaccgttcctacaaccgtatacccgagtaccacgtaccctggacctagggaccgtattacggtattttcggaaccttaactttaacgttactacgtacccctaaagttaatttacctttaaacgtacgttttaacccgtacccggttaccgggttaccgttacgggaacccggtaaacgggtaccccggtaagggttaccggaaactacggaaacggtaaccgtaggttacggtacgacgttacgcctaaccctgtacttcgttaccttaaccg

SEQ ID NO: 232595 - DNA, 788 bp, Homo sapiens
  misc_feature: GYAE6OF02HHMNH.40.56.F01.1.454.CMB.1.raw
  modified_base (503)..(503): a, c, t, g, unknown or other
  misc_feature (503)..(503): n is a, c, g, or t
  modified_base (510)..(510): a, c, t, g, unknown or other
  misc_feature (510)..(510): n is a, c, g, or t
  modified_base (523)..(523): a, c, t, g, unknown or other
  misc_feature (523)..(523): n is a, c, g, or t
  modified_base (537)..(537): a, c, t, g, unknown or other
  misc_feature (537)..(537): n is a, c, g, or t
  modified_base (545)..(545): a, c, t, g, unknown or other
  misc_feature (545)..(545): n is a, c, g, or t
  modified_base (569)..(569): a, c, t, g, unknown or other
  misc_feature (569)..(569): n is a, c, g, or t
  modified_base (589)..(589): a, c, t, g, unknown or other
  misc_feature (589)..(589): n is a, c, g, or t
tcagtctagcgactcacgaccggtgctcgatttagcagacgtctgaacacacaaaggggggagtcagacccagtcaggacacagcatggacatgaggtccccgctcagctccgtggggctcctgctgctctggcctcccaggtgcctaagttgtgacatccagatcgaccctagtcctccctccaccctgtctcgtcccttgtacgttggacgacgtacgggtacaactactctacgttcggcccggggtacctagggtcggtaagggttattttaccgaccgttagggttcggtccggttaggtacgtcgacggtacctaacggtaaaacccggaagggtaaacctccccgttaacgtaaccccgttccgtagtaactttaccggtttacggtaccgttacctttaacggtttcggaaccgtacgtaggttaccggttccctaagtaccgtaagggtcaacggtcggtcgtagtcggtactacgacgactagacttactacncgtaccnctaacgcacggtnaacggtcagtaccncggacgtntaacgttgtacgaattaaccgttnttaccgcgtaaaaccctaanaacgtttaccgaagtttaccgttacctccgttaaccggttaccgtaccgggttacccgaaaccgggttacgtaacgggtttaaccgaacggtttaccacggggttaaaacctcggtaacggtaccccgggttacgtaacccgaccggttaaccttacccggttaccggttactttacccgttaaccgtttacccccggg

SEQ ID NO: 232596 - DNA, 878 bp, Homo sapiens
  misc_feature: GYAE6OF02GW0Q8.40.56.F01.1.454.CMB.1.raw
tcagtctagcgactcacgaccggtgctcgatttagcagacgtctgaacacacaaaggggggagtcagacccagtcaggacacagcatggacatgagggtccccgctcagctcctggggctcctgctgctctggctcccaggtcgccaattgtgacatccagatcgacccagtcctccctcccacctgtctcgccttactacgttggacgacgtacggtaccaactattccacgtttcggccggggacctaagggttcggaagggttaacttttacttaccggttgggttacggtaccgttaggttacgtcgaacgacctaacggaaaccgaacggggaaaccgtccccgtacgtaacccgtccgttacgtaacgttaccggtttaacggtaccgttaccgtttaacgtttcggaacgtaacgtacggttacgggtaccctaaggttacggtaaacggtttccggacggtaccggtacgtaaggggtcggtaacggtaccccggaaggtaaccgtaaacggtaacgttaccaaccgttcctacctaacctaacgtaccaggtaccctaacgtccggacgtacgtaccgggtaccggtagttacgttaagttacggttaaccttaacgtttaccgtttaccgtaacctaaaccctaaacgttaaactttacgttaacgtttaaccgttaacgtttacccgggttaacgggttacccggttacccggggtaacccggtaaacccgggtaacccggtaacggtttaacgggaacgttaccggttaaacgggtaacccggttaacggttacgggtacggttaccggtaccgtacccttaaccgtaccgtttcgtttaacccgtttcgtttacccgttaacccg

SEQ ID NO: 232597 - DNA, 545 bp, Homo sapiens
  misc_feature: GYAE6OF02FOISW.40.56.F01.1.454.CMB.1.raw
  modified_base (283)..(283): a, c, t, g, unknown or other
  misc_feature (283)..(283): n is a, c, g, or t
  modified_base (541)..(541): a, c, t, g, unknown or other
  misc_feature (541)..(541): n is a, c, g, or t
tcagtctagcgactcacgaccggtgctcgatttagcagacgtctgaacacacaaaaggggggagtcagacccagtcaggacacagcatggacatgagggtccccgctcagctcctggggctcctgctgctctggctcccaggtgccaattgtgacatccagatgacccagtcctccctccaccctgtctgcctctattggagacagggtcaacatcacttgccgggccagtcggaggtatttatacctgattggcctggtatcagcaagaaaccagggaaacncccctgacctcctgatctttaaggcgttctacgtttggagacagtcgggtcccatcaaggttcaggcggcaggtggactccgagacagaattcactctcacatcagcagcctgcacgccggatggtatttgactaactttatactcgaccaaataacttattacagtttactaccgtcggtacgttccgacgaacgggtaccgagggtacgtaacgtacgaacgtaacgaacgtgtagcgtacgcacctatctacgtnttcg

SEQ ID NO: 232598 - DNA, 648 bp, Homo sapiens
  misc_feature: GYAE6OF02IZG9B.40.56.F01.1.454.CMB.1.raw
  modified_base (297)..(297): a, c, t, g, unknown or other
  misc_feature (297)..(297): n is a, c, g, or t
  modified_base (479)..(479): a, c, t, g, unknown or other
  misc_feature (479)..(479): n is a, c, g, or t
  modified_base (633)..(633): a, c, t, g, unknown or other
  misc_feature (633)..(633): n is a, c, g, or t
tcagtctagcgactcacgaccggtgctcgatttagcagacgtctgaacacacaaaggggggagtcagacccagtcaggacacagcatggacatgagggtcccgctcagctcctggggctcctgctagctcgtggctcccgaggtcgccaattgtcgacatccagtactgacccagttcctccctccaccctgtctcgcctcttacgtcggacgacgacgggtacaacgactcacgtttcggccggggtccacgtcgggagtactttacgtaccgtgtacgttcggtcgtaggttacnccgtagaccaacgtaaaacccggagggaaaccgtcccctaggacccttccaggtacttacgtttaacgggcgttactacggtttcggaacgtaccgtacgtacgggtcctagttacgtaacgttcgacgtcggacgtagttcggactccgagacagtaacttcactctacacgtctacgtanacgtacgctagcgacgtcgtactgttattacggtactaacttctacgacgtacctaagtaacttaactacgtactcttacgtacgtacgttacgaaccgtaaggaccgtagtcgtaactcggtaacgtacgtagtcgtagtcctgccaacgttntcgtccgtacttacg

SEQ ID NO: 232599 - DNA, 770 bp, Homo sapiens
  misc_feature: GYAE6OF02J1XLW.40.56.F01.1.454.CMB.1.raw
  modified_base (135)..(135): a, c, t, g, unknown or other
  misc_feature (135)..(135): n is a, c, g, or t
  modified_base (273)..(273): a, c, t, g, unknown or other
  misc_feature (273)..(273): n is a, c, g, or t
  modified_base (549)..(549): a, c, t, g, unknown or other
  misc_feature (549)..(549): n is a, c, g, or t
tcagtctagcgactcacgaccggtgctcgatttagcagacgtctgaacacacaaaggggggagtcagacccagtcaggacacagcatggacatgaggtcccgctcagctctgggctcctgctgctctgctcccgnggtcgccaattgtgacatacctaggatcgaccctagtcctcccctaccacccttgtctcgtacccttcgttagttcggagacgtacgggtaccaatactcctacgttcggaccggggccaggtcggaaggtactttanaccttagtagttcggtccgttaggtactacgacgccgaaacgtaaacccggtaaggaacccgccccgttacgtacccgtcgtagactttaccgttacggtccctagttacgttaggacgacgttacggtcggttacccgtagttaccgacggttacgacggccgtacgtacggtacggtacggaccgtacgaacgtaacgttaacgttaccctacccgtaccgttaacacccgtaacttacccggaacgtccgtaacccgtcccgtacggaacccnccgggttaaccggtaagttactttaggttaccgtacgttaacgttactaaccgtacgtaacctaaacgtaacttaacttaccgttagttaccttacgttaccggttaccggttaccgaccggaaccgggtacgttaacggtacgtaacgttacggaacgtaacgtacgttcggtacgtccggttacgacgtaccgtacgtttcgtcccgttacttaacccg

SEQ ID NO: 232600 - DNA, 173 bp, Homo sapiens
  misc_feature: GYAE6OF01B8PS1.40.71.G05.1.454.CMB.1.raw
  modified_base (172)..(173): a, c, t, g, unknown or other
  misc_feature (172)..(173): n is a, c, g, or t
tcagtctagcgactcacgaccggtgctcgatttagtgtcgtcgcaagagagagggggaagaggaagactgacggtcccccaggagttcaggtgctgggcacagcggccctgggctgcctggtcaaggactacttccagtcgctagactgagcgggctggcaaggcgcatagnn

SEQ ID NO: 232601 - DNA, 684 bp, Homo sapiens
  misc_feature: GYAE6OF01B3LZE.40.71.G05.1.454.CMB.1.raw
  modified_base (674)..(674): a, c, t, g, unknown or other
  misc_feature (674)..(674): n is a, c, g, or t
tcagtctagcgactcacgaccggtgctcgatttagtgtcgtcgcaagagagaggggacccaaaaccacacccctcctagggagaatcccctagaccacagctcctcaccatggactggacctggagcattccttttcttggtggcagcagcaacaggtcgcccactcccaggttcaaatgctgcagtcgtggaggcgaggtgaagaagccgtgggcctcgagtggagggtctccgtgcgagtacttcgtggttacagtcctttacgactagtggtatgagtcgtgggtgcgacgcggacccccggagaacgggtcttggaggtggagtgggagtggagcgagaccgtaacttaacgagtaggtacgaaccaacgtaaaacgtacgtagaccaacgaaggtaacgttaccgaaggaacgaaggacgttaccaacctaacgtaccgaacccaacgaacgtaaccaccaactaccccaaacgacgaccaaccgtaactaccgtaagtaagtggggaacgtacggaacggacgtaccgtacgaaccttagaccgtaacggaaccggaaccgtaaccggtacccgtttaattacgttaccgtaggtacggaccgaaggtacgacgttaccggaagggttccgggaaggtacggtaagttccgggtacccgttagtacgnggtaacgtcg

SEQ ID NO: 232602 - DNA, 559 bp, Homo sapiens
  misc_feature: GYAE6OF01AQWPD.40.71.G05.1.454.CMB.1.raw
  modified_base (502)..(502): a, c, t, g, unknown or other
  misc_feature (502)..(502): n is a, c, g, or t
tcagtctagcgactcacgaccggtgctcgatttagtgtcgtcgcaagagagagggggacccaaaaaccacacccctcctagggagaatcccctagaccacagctcctcaccatggactggacctggagcatccttttcttggtggcagcagcaacaggtgcccactcccaggttcaaatgctgcagtctggaggcgaggtgaagaagccgtggggcctcagtgagggtctccgtgcgagacttctggttacagtctttaccgactatggtatgagcgtgggtgcgacacggcccccggagagggctggagtggagtgggagtggagcagctacgttacaagtggtagacaacaaactagtacgacacgaagtaacgttccaaggacagacgtcaacatcgaccacagacacactccacagacacacgacctatagtagggagtaggacggacgtccagacagtcgagacgtacgaccggacgttaatacttacgtggtacgngacggtagatcgtaggtcgggaggtaggacgtacggttccggtagtcggtgagtacg

SEQ ID NO: 232603 - DNA, 178 bp, Homo sapiens
  misc_feature: GYAE6OF01BBW7A.40.71.G05.1.454.CMB.1.raw
  modified_base (174)..(178): a, c, t, g, unknown or other
  misc_feature (174)..(178): n is a, c, g, or t
tcagtctagcgactcacgaccggtgctcgatttagtgtcgtcgcaagagagagggggggaagaggaagactgacggtcccccaggagttcaggtcgcctggcacagcggccctggctgcctggtcaaggactacttccagtcgctagactgagcgggctggcaaggcgcatagnnnnn

SEQ ID NO: 232604 - DNA, 623 bp, Homo sapiens
  misc_feature: GYAE6OF01EVP9V.40.71.G05.1.454.CMB.1.raw
tcagtctagcgactcacgaccggtgctcgatttagtgtcgtcgcaagagagagggggacccaaaaaccacacccctcctagggagaatcccctagaccacagctcctcaccatggactggacctggagcatccttttcttggtggcagcagcaacaggtgcccactcccaggttcaaatgctgcagtctggaggcgaggtgaagaagcctggggcctcagtgagggtctcctgcgagacttctggttacagctttaccgactatggtatgagtctgggttgcgacgacggccccccggacgaacggggtccttggaggtgggagtgggatggagcaggcacttacgaagtggtagacaacaaactagtcgcaacagaacgttaccgaggaaccagtacgtccaaccatacgaccacaacgacacgactacccaacccgaagaccaacacgtacctataggtaggtacgggtggacggacgtccgtacgaactacgttacgtacggaccggtaaccgacccggtaccggttaattacgttacgttaggttcggacgaggaacgtagtacgtaaggtccgggaagggtaggaaggttcggtacccggttgttcgtggagtaaccg

SEQ ID NO: 232605 - DNA, 625 bp, Homo sapiens
  misc_feature: GYAE6OF01CCRZC.40.71.G05.1.454.CMB.1.raw
  modified_base (308)..(308): a, c, t, g, unknown or other
  misc_feature (308)..(308): n is a, c, g, or t
  modified_base (556)..(556): a, c, t, g, unknown or other
  misc_feature (556)..(556): n is a, c, g, or t
  modified_base (618)..(618): a, c, t, g, unknown or other
  misc_feature (618)..(618): n is a, c, g, or t
tcagtctagcgactcacgaccggtgctcgatttagtgtcgtcgcaagagagagggggacccaaaaaccacacccctcctagggagaatcccctagaccacagctcctcaccatggactggacctggagcatccttttcttggtggcagcagcaacaggtgcccactcccaggttcaaatgctgcagtctggaggcgaggtgaagaagcgtggggcctcgagtgaggtctcctgcgagacttcgtggttacagtcttacgactatgtatgagtcgtggtgcgacgcggccccgagaggctgagtggagnggagtggagcgagactacgttagaagtcggtagaaccaagaaactagtagacaacgaaggtaacgtaccgaaggtacaaggtactaccacgacgtacgtaaccgacgaacaaccgacttaccacccgaaccgacgtaccaacggacttaccgagttaaccgtgggaggtaggacggtacgacctgaactacgtcgtaacgaaccgtacgtaaccgggtaccttaattaccttacggtaggtaccgganaaaggccgtagttagaacggtcgggaaagggtccgtaacgtcggggtaccgtagtccgtggngttaacg

SEQ ID NO: 232606 - DNA, 649 bp, Homo sapiens
  misc_feature: GYAE6OF01A1J94.40.71.G05.1.454.CMB.1.raw
  modified_base (328)..(328): a, c, t, g, unknown or other
  misc_feature (328)..(328): n is a, c, g, or t
tcagtctagcgactcacgaccggtgctcgatttagtgtcgtcgcaagagagagggggacccaaaaaccacacccctcctagggagaatcccctagaccacagctcctcaccatggactggacctggagcatccttttcttggtggcagcagcaacaggtgcccactcccaggttcaaatgctgcagtctggaggcgaggtgaagaagcctggggcctcagtgagggtctcctgcgagacttctggttacagtctttaccgactatggtatgagcgtgggtgcgacacggcccccggacgaagggcttggaggtggagtgggatgggancgagcaacttacaagtggttagaacaacaaactagtgacaacgaagtaacgttccgaaggtaacagacgtcaaccatacgaccaacacgaaccacactaccccaaccaacgaccaaccgacgaccctaagtacgtagggtaggtaggaacggacgacccgtaggacaagttcctacggtaaccggaaccgtaaccgggtacccgttaattaacgtttaaccgtgggtacgaccggtaggtaacgtactaccggtaaggttacggggaaggggttacggtaaacggttcggtacccggtttagtaccgtttaggacggtacg

SEQ ID NO: 232607 - DNA, 575 bp, Homo sapiens
  misc_feature: GYAE6OF01D057J.40.71.G05.1.454.CMB.1.raw
  modified_base (296)..(296): a, c, t, g, unknown or other
  misc_feature (296)..(296): n is a, c, g, or t
  modified_base (392)..(392): a, c, t, g, unknown or other
  misc_feature (392)..(392): n is a, c, g, or t
  modified_base (436)..(436): a, c, t, g, unknown or other
  misc_feature (436)..(436): n is a, c, g, or t
tcagtctagcgactcacgaccggtgctcgatttagtgtcgtcgcaagagagagggggacccaaaaaccacacccctcctagggagaatcccctagaccacagctcctcaccatggactggacctggagcatccttttcttggtggcagcagcaacaggtgcccactcccaggttcaaatgctgcagtctggaggcgaggtgaagaagcctggggcctcagtgagggtctcctgcgagacttctggttacagctttaccgactatggtatgagctgggtgcgacacggcccccgganaagggcttgagtggagtgggagtgggagcgaggcacttacaagttggtagacaacaaactatgacacgagaatccagacagagtcacatagaccanagacacactccaacagcacacgcctatagtggaggtgacggacncgtacgaacgatcgtacgaccgaaccgaccgggtaccgttaattacgttaccgtggtacggacgaagtacgtaacgtacaacggtccggggaagggttaggaaagttccgggccggttaggttccgtggtacggtaccg

SEQ ID NO: 232608 - DNA, 739 bp, Homo sapiens
  misc_feature: GYAE6OF01AVGUA.40.71.G05.1.454.CMB.1.raw
  modified_base (726)..(726): a, c, t, g, unknown or other
  misc_feature (726)..(726): n is a, c, g, or t
tcagtctagcgactcacgaccggtgctcgatttagtgtcgtcgcaagagagagggggacccaaaaaccacacccctcctagggagaatcccctagaccacagctcctcaccatggactggacctggagcattccttttcttggtggcagcagcaacgaggtcgcccactcccaggttacaaatgctgcagtcgtggaggcgaggtagaacgacgccgtgggcctcgagtggaggtctcgtgcgtagtacttcgtacgttacacgtccttttaccgattagtggtatgagtcgtgggtcgcgaccgaccggccccggagacggtctgacggtggagtgggacgtgggacgacgacgtcgtaacttaagaaggttggaacgaactaaacgtaactacgtacgaactaacgtaacgtaacggtacgaaggacgtaacggacgtacccgaaccgtagtaacccggaaccaacgaaccgtaaccaacccgtaacctaacccccggaacccgaacgtaacccgaacgaaacccggttaaccgttaacgttaacgggtaaccggggtaaggttaacccgggaacgggttaccggtaccggtaacgtaaccgttaggtaaccgtaaccggacgtaaccgacccggtaacgttaacgttacgttacggtaggtacgaggtaaggacgtacggtacggaggtaccgggagggtagtaacgtcggtacggttaccgngtaacggcgtacg

SEQ ID NO: 232609 - DNA, 697 bp, Homo sapiens
  misc_feature: GYAE6OF01ECXR9.40.71.G05.1.454.CMB.1.raw
tcagtctagcgactcacgaccggtgctcgatttagtgtcgtcgcaagagagagggggacccaaaaaaccacacccctcctagggagaatcccctagaccacagctcctcaccatggactggacctggagcatccttttctggtggcagcagcaacaggtcgcccactcccaggttcaaatgctgcagtctggaggcgaggtgaagagccgtggggcctcgagtgacgggtctccgtgcgagtacttcgtggttacagtctttaccgattagtggtatggagtcgtgggtacgacgacgaccggccccggaagacgggtcttaggacgtggaggtgggagtggagtacgagtacctaacttacgtagtacggtacgaacaacgtaaactagtcgaacctaacgaacggttaaccgtcgaacggaacagaaccgtccaacagtaacgaaccaacgtaccgtaacacctaacgtaccccaacgtaagaccctaaacgtacgtaaccgtagttacggtaagggtacggtacgggacgtaccgtacgtaacgtacacggttacgtaacccggtacggacccggtttaacggtactttaaacgttgttaaccggtgtaaccgacggtaagcgttaacgtaggttaacggcggggtaaggttacgacggttcccggtacttcggttacggaacgtcggttaacg

SEQ ID NO: 232610 - DNA, 173 bp, Homo sapiens
  misc_feature: GYAE6OF02H47TY.40.71.G05.1.454.CMB.1.raw
  modified_base (173)..(173): a, c, t, g, unknown or other
  misc_feature (173)..(173): n is a, c, g, or t
tcagtctagcgactcacgaccggtgctcgatttagtgtcgtcgcaagagagaggggggaagaggaagactgacggtcccccaggagttcaggtgctgggcacagcggccctgggctgcctggtcaaggactacttccagtcgctagactgagcgggctggcaaggcgcatagn

SEQ ID NO: 232611 - DNA, 174 bp, Homo sapiens
  misc_feature: GYAE6OF02FYQST.40.71.G05.1.454.CMB.1.raw
  modified_base (173)..(174): a, c, t, g, unknown or other
  misc_feature (173)..(174): n is a, c, g, or t
tcagtctagcgactcacgaccggtgctcgatttagtgtcgtcgcaagagagaggggggaagaggaagactgacggtcccccaggagttcaggtgctgggcacagcggccctgggctgcctggtcaaggactacttccagtcgctagactgagcgggctggcaaggcgcatagnn

SEQ ID NO: 232612 - DNA, 604 bp, Homo sapiens
  misc_feature: GYAE6OF02IZZR2.40.71.G05.1.454.CMB.1.raw
  modified_base (295)..(295): a, c, t, g, unknown or other
  misc_feature (295)..(295): n is a, c, g, or t
tcagtctagcgactcacgaccggtgctcgatttagtgtcgtcgcaagagagagggggacccaaaaaccacacccctcctagggagaatcccctagaccacagctcctcaccatggactggacctggagcatccttttcttggtggcagcagcaacaggtgcccactcccaggttcaaatgctgcagtctggaggcgaggtgaagaagcctggggcctcagtgagggtctcctgcgagacttctggttacagctttaccgactatggtatgagctgggtgcgacaggcccccgganaagggcttgagtggatgggatggagcagcacttacaatggtgacacaaactatgcacagaagttccaggacagagtcaccatcgaccacagacacactacccaccagaccaacacgacctaatagtagggaggtagaagggacgccgtagaactacgttaccgtacggaaccgaaccgacccgggtaccgttaagttaacttaacgttggttacggaccgtaaggacgtaacgttaccgtaagggttaccgggtaagggttaaggtaacgttcgggtacccggttcggttacggtacggtacgtaccgg

SEQ ID NO: 232613 - DNA, 515 bp, Homo sapiens
  misc_feature: GYAE6OF02H334O.40.71.G05.1.454.CMB.1.raw
  modified_base (294)..(294): a, c, t, g, unknown or other
  misc_feature (294)..(294): n is a, c, g, or t
tcagtctagcgactcacgaccggtgctcgatttagtgtcgtcgcaagagagaggggacccaaaaaccacacccctcctagggagaatcccctagaccacagctcctcaccatggactggacctggagcatccttttcttggtggcagcagcaacaggtgcccactcccaggttcaaatgctgcagtctggaggcgaggtgaagaagcctggggcctcagtgagggtctcctgcgagacttctggttacagctttaccgactatggtatgagctgggtgcgacaggcccccgganaagggcttgagtggatgggatggagcaggcacttacaagtggtgacaacaaactatagcacagaagttccaggacagagtcaccatcgaccacagacacactccaccagcacagctatagtggagtgaggagcctagactagtctgaacgacgaccggccgtatattacgtgtcgacgagagatcagtcggtaggtggagtcggccgttgtcgtagagtcg

SEQ ID NO: 232614 - DNA, 551 bp, Homo sapiens
  misc_feature: GYAE6OF02IDE3J.40.71.G05.1.454.CMB.1.raw
  modified_base (294)..(294): a, c, t, g, unknown or other
  misc_feature (294)..(294): n is a, c, g, or t
  modified_base (319)..(319): a, c, t, g, unknown or other
  misc_feature (319)..(319): n is a, c, g, or t
  modified_base (383)..(383): a, c, t, g, unknown or other
  misc_feature (383)..(383): n is a, c, g, or t
tcagtctagcgactcacgaccggtgctcgatttagtgtcgtcgcaagagagaggggacccaaaaaccacacccctcctagggagaatcccctagaccacagctcctcaccatggactggacctggagcatccttttcttggtggcagcagcaacaggtgcccactcccaggttcaaatgctgcagtctggaggcgaggtgaagagcctggggcctcagtgagggtctccgtgcgagacttctggttacagtctttaccgatatggtatgagctgggtgcgacaggcccccgganaagggcttgagtggatgggatggancagcacttacaagtggtagacacaaactatagcacagaagttccagacagagtcacatgaccanagacacatcccaacagccaacacgcctaatacgtagggaggtagaggagccgtagactatctaggaaccgacaccgggtacctaagtacttacgtgtgacgaggacgacttacgagttccgggaaggttaggaacgttcgggaccgttaggttccgtaggagtaaccg

SEQ ID NO: 232615 - DNA, 528 bp, Homo sapiens
  misc_feature: GYAE6OF02GFV0A.40.71.G05.1.454.CMB.1.raw
  modified_base (407)..(407): a, c, t, g, unknown or other
  misc_feature (407)..(407): n is a, c, g, or t
  modified_base (434)..(434): a, c, t, g, unknown or other
  misc_feature (434)..(434): n is a, c, g, or t
tcagtctagcgactcacgaccggtgctcgatttagtgtcgtcgcaagagagagggggacccaaaaaccacacccctcctagggagaatcccctagaccacagctcctcaccatggactggacctggagcatccttttcttggtggcagcagcaacaggtgcccactcccaggttcaaatgctgcagtctggaggcgaggtgaagaagcctggggcctcagtgagggtctcctgcgagacttctggttacagctttacgactatggtatgagctgggtgcgacacggcccccggacaagggcttgaggtggagtgggatggagcgagcacttacaatggtgacacaaactatgacacagaagttccgaaggacaagacgtacaccatcgaccacagacacatccacancacagaccatatggagtagaggacgcngacatactgacgacacggcgtatacgttactgtagcgaagagactacgagtcggtaggtaggtaacgtcggtaccgttgtacgttaggagtacg

SEQ ID NO: 232616 - DNA, 573 bp, Homo sapiens
  misc_feature: GYAE6OF02HURG1.40.71.G05.1.454.CMB.1.raw
  modified_base (247)..(247): a, c, t, g, unknown or other
  misc_feature (247)..(247): n is a, c, g, or t
  modified_base (254)..(254): a, c, t, g, unknown or other
  misc_feature (254)..(254): n is a, c, g, or t
  modified_base (416)..(416): a, c, t, g, unknown or other
  misc_feature (416)..(416): n is a, c, g, or t
tcagtctagcgactcacgaccggtgctcgatttagtgtcgtcgcaagagagagggggacccgaaaaaccacacccctcctagggagaatcccctagaccacagctcctcaccatggactggacctggagcatccttttcttggtggcagcagcaacaggtgtcccactcccaggttcaaatgctgcagtctggaggtcgaggtgaagaagccgtggggcctcagtgagggtctcctgcgagacttcnggttacngctttaccgactagtggtatgagcgtgggtgcgacgacgggccccccggagaaggggccttggacgtggagtggggatgggagcagctacttacgaagtggtagacaacgtaaactatgacacagtaacgttccgaaggacgagacgtacaccatcgaccanagacaacactaccaccagaccacacgtacctatacgtagggtaggtcgaggacgcctagacatacgagacgacgacggtccttaagtattacgtgtcgacgaggacgattcgaggtacgggtagtcggaacgtcggtaccggttgtcgtaggatacg

SEQ ID NO: 232617 - DNA, 532 bp, Homo sapiens
  misc_feature: GYAE6OF02HOSPL.40.71.G05.1.454.CMB.1.raw
  modified_base (295)..(295): a, c, t, g, unknown or other
  misc_feature (295)..(295): n is a, c, g, or t
  modified_base (342)..(342): a, c, t, g, unknown or other
  misc_feature (342)..(342): n is a, c, g, or t
  modified_base (403)..(403): a, c, t, g, unknown or other
  misc_feature (403)..(403): n is a, c, g, or t
  modified_base (415)..(415): a, c, t, g, unknown or other
  misc_feature (415)..(415): n is a, c, g, or t
  modified_base (425)..(425): a, c, t, g, unknown or other
  misc_feature (425)..(425): n is a, c, g, or t
  modified_base (438)..(438): a, c, t, g, unknown or other
  misc_feature (438)..(438): n is a, c, g, or t
tcagtctagcgactcacgaccggtgctcgatttagtgtcgtcgcaagagagagggggacccaaaaaccacacccctcctagggagaatcccctagaccacagctcctcaccatggactggacctggagcatccttttcttggtggcagcagcaacaggtgcccactcccaggttcaaatgctgcagtctggaggcgaggtgaagaagcctggggcctcagtgagggtctcctgcgagacttctggttacagctttaccgactatggtatgagctgggtgcgacaggcccccgganaagggcttgagtggatgggatgggagcgagcactacaatggtgacanaaactatgcacagaagtttccaaggacagagtacaccgatagaccacagacacatccacancacagcctatanggagtggagngcctagacatcgngacgacgacggccgtataactacgtagtcgacgagaacgtatacgacgtacggtagggtggtaacgtggcccggtttggtaccgttggagtacg

SEQ ID NO: 232618 - DNA, 557 bp, Homo sapiens
  misc_feature: GYAE6OF02I0VXU.40.71.G05.1.454.CMB.1.raw
  modified_base (367)..(367): a, c, t, g, unknown or other
  misc_feature (367)..(367): n is a, c, g, or t
  modified_base (451)..(451): a, c, t, g, unknown or other
  misc_feature (451)..(451): n is a, c, g, or t
tcagtctagcgactcacgaccggtgctcgatttagtgtcgtcgcaagagagagggggacccaaaaaccacacccctcctagggagaatcccctagaccacagctcctcaccatggactggacctggagcatccttttcttggtggcagcagcaacaggtgcccactcccaggttcaaatgctgcagtctggaggcgaggtgaagaagcctggggcctcagtgagggtctcctgcgagacttctggttacagctttaccgactatggtatgagctgggtgcgacgacggcccccggacaagggcttggaggtggagtggggatgggagcgagctaacttacaagtgggtgaacaacaaactatgacanagtaacgttcaggacagatcaccatgaccacagacacatccacagacacacgcctatagtggaggtagacggagcctaggaacnctcgtacgacgaacgacggtccgttaatacgtttacgtagtgacgtaagaggtactacgtacggtacgggaagggttgaacgtggtaccggttgtcgtggagtacg

SEQ ID NO: 232619 - DNA, 602 bp, Homo sapiens
  misc_feature: GYAE6OF02HZ4US.40.71.G05.1.454.CMB.1.raw
  modified_base (332)..(332): a, c, t, g, unknown or other
  misc_feature (332)..(332): n is a, c, g, or t
  modified_base (434)..(434): a, c, t, g, unknown or other
  misc_feature (434)..(434): n is a, c, g, or t
  modified_base (541)..(541): a, c, t, g, unknown or other
  misc_feature (541)..(541): n is a, c, g, or t
  modified_base (556)..(556): a, c, t, g, unknown or other
  misc_feature (556)..(556): n is a, c, g, or t
tcagtctagcgactcacgaccggtgctcgatttagtgtcgtcgcaagagagagggggacccaaaaaaccacacccctcctagggagaatcccctagaccacagctcctcaccatggactggacctggagcatccttttcttggtggcagcagcaacaggtgcccactcccaggttcaaatgctgcagtctggaggcgaggtgaagagccgtggggcctcgagtgagggtcctccgtgcgagacttcgtggttacagtctttaccgattagtggtatgagcgtgggtgcgacgacggcccccgagaagggtcttgagtggagtgggagtggancgagcctacttaacaagttgggtacacaacaaactagtacgacaacgagtaacgttaccgaggaacagtagtaccaacgtatacgaaccaacgagaaacccnctaacctaccccaacgtaacgaccaacgtacgaccttaagtaggttagggagtaggaacgtacgctacggatactcgacgaacgcgaccggtattacgtattaacgngtacgacggatacgntacgaggtacggtaggtagacggttcggacctttggctaggagtac

SEQ ID NO: 232620 - DNA, 556 bp, Homo sapiens
  misc_feature: GYAE6OF02FT6V0.40.71.G05.1.454.CMB.1.raw
  modified_base (296)..(296): a, c, t, g, unknown or other
  misc_feature (296)..(296): n is a, c, g, or t
  modified_base (330)..(330): a, c, t, g, unknown or other
  misc_feature (330)..(330): n is a, c, g, or t
  modified_base (447)..(447): a, c, t, g, unknown or other
  misc_feature (447)..(447): n is a, c, g, or t
  modified_base (551)..(551): a, c, t, g, unknown or other
  misc_feature (551)..(551): n is a, c, g, or t
tcagtctagcgactcacgaccggtgctcgatttagtgtcgtcgcaagagagagggggacccaaaaaccacacccctcctagggagaatcccctagaccacagctcctcaccatggactggacctggagcatccttttcttggtggcagcagcaacaggtgcccactcccaggttcaaatgctgcagtctggaggcgaggtgaagaagcctggggcctcagtgagggtctcctgcgagacttctggttacagtctttaccgactatggtatgagctgggtgcgacaggcccccgganagggcttgagtggatgggatggagcagcacttanaatgggtgaacacaaactatgacacgagaattccgaggacagacgtcacatcgacacgagacacactccacagccacacgcctaagtagtagggacggtgaaggacgtcctagaacngtactagaaccgacgaccggtacgttaattacgttacctaggtcgacgtaaggagcttaacggacgtacgggagggttagacgttcggcccggttagtcgtagngtacg

SEQ ID NO: 232621 - DNA, 636 bp, Homo sapiens
  misc_feature: GYAE6OF02GQQ0W.40.71.G05.1.454.CMB.1.raw
  modified_base (296)..(296): a, c, t, g, unknown or other
  misc_feature (296)..(296): n is a, c, g, or t
tcagtctagcgactcacgaccggtgctcgatttagtgtcgtcgcaagagagagggggacccaaaaaccacacccctcctagggagaatcccctagaccacagctcctcaccatggactggacctggagcatccttttctggtggcagcagcaacaggtgcccactcccaggttcaaatgctgcagtctggaggcgaggtgaagaagcctggggcctcagtgagggtctcctgcgagacttctggttacagcttttaccgactatggtatgagctgggtgcgacacggcccccgganacgggcttggagtggagtgggatggagcagcacttaacagtggtgacaacaaactatgactacagaacgttccgaaggacagagtccaacagtacgaaccaacaacgaaccaacctaacgtacccaacccgaacgaccgaaccaacgtaccctaagtaggttacgggtaggtacgggaagggaacggtccgtacgaaccgactacgtaccggaacgaccgaccgggtacccgttaattaccgtttacgtagttggaccggtaaggacggtaacgtactaacggtacggggtaaggttaagggacgttacgggttcccggtagtttccggagacggtaacg

SEQ ID NO: 232622 - DNA, 614 bp, Homo sapiens
  misc_feature: GYAE6OF02GA59M.40.71.G05.1.454.CMB.1.raw
  modified_base (325)..(325): a, c, t, g, unknown or other
  misc_feature (325)..(325): n is a, c, g, or t
  modified_base (336)..(336): a, c, t, g, unknown or other
  misc_feature (336)..(336): n is a, c, g, or t
  modified_base (357)..(357): a, c, t, g, unknown or other
  misc_feature (357)..(357): n is a, c, g, or t
  modified_base (382)..(382): a, c, t, g, unknown or other
  misc_feature (382)..(382): n is a, c, g, or t
  modified_base (411)..(411): a, c, t, g, unknown or other
  misc_feature (411)..(411): n is a, c, g, or t
tcagtctagcgactcacgaccggtgctcgatttagtgtcgtcgcaagagagagggggacccaaaaaccacacccctcctagggagaatcccctagaccacagctcctcaccatggactggacctggagcatccttttcttggtggcagcagcaacaggtgcccactcccaggttcaaatgctgcagtctggagcgaggtgaagaagcctgggcctcagtgagggtctcctgcgagacttctggtacagcttaccgactatgtatgagcgtagggtcgcgacgacggcccccggacgaagggtctggaggtggacgtgggagtggngcagcacgtanagtgtgacacaacgtatgcanagtactcgagtacagcgtacacacncgacagaacgactacactaccaacccganccaacacgtaccctaagtacgttagggaggttagggaacgggacgtaccgtggtaacctacgtaggtaccgaacgtacccggtaacccggtaccgttaataccctttagtacgtacgggacgtacggaggttaactccgtaacggttacgggtaagggtacggtaacgtccggttaaccgggtcgtacggttaccgaggtacg

SEQ ID NO: 232623 - DNA, 780 bp, Homo sapiens
  misc_feature: GYAE6OF02IY1SJ.40.71.G05.1.454.CMB.1.raw
  modified_base (257)..(257): a, c, t, g, unknown or other
  misc_feature (257)..(257): n is a, c, g, or t
tcagtctagcgactcacgaccggtgctcgatttagtgtcgtcgcaagagagagggggaccaaaaaccacacccctcctagggagaatccctacgaccacagctcctccacatggactggacctggagcactctttcttggtggaccagcagacaacaggtgccactccaggttccaatgctgcatctggaggcgaggtagaagacgtccgtggggctcgagtgagggtcctcctaggcgaggtacttcgtggtaccngtactttaccgactagttggtagtggacgtcgtggggtacgtccgaaccgtaccgggcccccggaacgaacggggtcctttagggagtaggggtagttcggggggtattacggggaacgcgtaacggtaccctaaacctttaacggaagttaccggggttaacgaaaaccgtaaccgtaaaccgttactacgtaccgtaacgaacgtaacgttaccgaacggtacagggtaactccgaaacacgtacaaccgacgtaacgacacctactacccacgaccaacgtacaacgaccttaacggttagtaccggggtaagggtacgaaacgggggtaccctacgtacggtaaacgtccgttaacggttaccgggaacctaaccgggcccgggttaaaccgtttaatttaacccggtttaccgtacgggttaccggcggttaaacgtaacggtcggttaccggtaacgtccggggtagtacgggttaaccgacggttaccccggttggtacccgttagtacggaaccg

SEQ ID NO: 232624 - DNA, 776 bp, Homo sapiens
  misc_feature: GYAE6OF02GVVQD.40.71.G05.1.454.CMB.1.raw
tcagtctagcgactcacgaccggtgctcgatttagtgtcgtcgcaagagagagggggacccaaaaaccacacccctcctagggagaatcccctagaccacagctcctcaccatggactggacctggagcatcccttttcttggtggcagcagcaacaggtgcccactcccaggttcaaatgctgcagtctggaggcgaggtgaagaacggccgtggggcctcgagtggagggtctcctgcgagacttctggttacagtctttaccgactatggtatgagtcgtgggtgcgacacggcccccggagacgggctggacggtggagtggggacgtgggacgcgtagcctacgttacaacgtgggtagaactaactaaacgtatagacctaagaacgaacgtttaccgaacggactagaacgtacaaccgtacgacgtaaacccgacgtaaccgaaacctaccgaacgtaacccaacccgtaaaccgaccgtaacctaaccgtaacccttaacgttaaacgttaacggggtaacgggttacggggtaacgggaaccggttaccggtacggtaacctaacgttaaccgtacggaaacccgtaaccggtaacccgggttaccgttaaacgtttaaccgtttaacggttacggttaccgtacgggttacgggtaacgttaacggttaaccggtaaccgggttacggggttaacggggttacggttaaacggttcccgggttaccgggttaccgggtttaccgggttacggtaacgggtaccgg

SEQ ID NO: 232625 - DNA, 234 bp, Homo sapiens
  misc_feature: GYAE6OF01EOSSE.38.35.D02.1.454.CMB.1.raw
  modified_base (233)..(234): a, c, t, g, unknown or other
  misc_feature (233)..(234): n is a, c, g, or t
tcagtcgatcacgtcacgaccggtgctcgatttagcacacgatagttgggtttggggagttatgtctgggccagggaaccctggccaccgtctcctcagcctccaccaagggcccatcggtcttcccctggcgccctgctccaggagcacctccgagagcacagcggccctgggctgcctggtcaaggactacttccacgtgatcgactgagcgggctggcaaggcgcatagnn

SEQ ID NO: 232626 - DNA, 237 bp, Homo sapiens
  misc_feature: GYAE6OF01BZH00.38.35.D02.1.454.CMB.1.raw
  modified_base (233)..(237): a, c, t, g, unknown or other
  misc_feature (233)..(237): n is a, c, g, or t
tcagtcgatcacgtcacgaccggtgctcgatttagcacacgatagttgggtttggggagttatgtctgggccagggaaccctggccaccgtctcctcagcctccaccaagggcccatcggtcttcccctggcgccctgctccaggagcacctccgagagcacagcggccctgggctgcctggtcaaggactacttccacgtgatcgactgagcgggctggcaaggcgcatagnnnnn

SEQ ID NO: 232627 - DNA, 238 bp, Homo sapiens
  misc_feature: GYAE6OF01DEYEX.38.35.D02.1.454.CMB.1.raw
  modified_base (234)..(238): a, c, t, g, unknown or other
  misc_feature (234)..(238): n is a, c, g, or t
tcagtcgatcacgtcacgaccggtgctcgatttagcacacgatagttgggtttggggagttatgtctggggccagggaaccctggccaccgtctcctcagcctccaccaagggcccatcggtcttcccctggcgccctgctccaggagcacctccgagagcacagcggccctgggctgcctggtcaaggactacttccacgtgatcgactgagcgggctggcaaggcgcatagnnnnn

SEQ ID NO: 232628 - DNA, 239 bp, Homo sapiens
  misc_feature: GYAE6OF01CSS5I.38.35.D02.1.454.CMB.1.raw
  modified_base (234)..(239): a, c, t, g, unknown or other
  misc_feature (234)..(239): n is a, c, g, or t
tcagtcgatcacgtcacgaccggtgctcgatttagcacacgatagttgggtttgggggagttatgtctgggccagggaaccctggccaccgtctcctcagcctccaccaagggcccatcggtcttcccctggcgccctgctccaggagcacctccgagagcacagcggccctgggctgcctggtcaaggactacttccacgtgatcgactgagcgggctggcaaggcgcatagnnnnnn

SEQ ID NO: 232629 - DNA, 244 bp, Homo sapiens
  misc_feature: GYAE6OF01C9W9O.38.35.D02.1.454.CMB.1.raw
  modified_base (235)..(244): a, c, t, g, unknown or other
  misc_feature (235)..(244): n is a, c, g, or t
tcagtcgatcacgtcacgaccggtgctcgatttagcacacgatagttgggtttgggggagttatgtctggggacagggaaccctggccaccgtctcctcagcctccaccaagggcccatcggtcttcccctggcgccctgctccaggagcacctccgagagcacagcggccctgggctgcctggtcaaggactacttccacgtgatcgactgagcgggctggcaaggcgcatagnnnnnnnnnn

SEQ ID NO: 232630 - DNA, 236 bp, Homo sapiens
  misc_feature: GYAE6OF01DE27U.38.35.D02.1.454.CMB.1.raw
  modified_base (235)..(236): a, c, t, g, unknown or other
  misc_feature (235)..(236): n is a, c, g, or t
tcagtcgatcacgtcacgaccggtgctcgatttagcacacgatagttgggtttgggggagttatgtctggggccagggaaccctggccaccgtctcctcagcctccaccaagggcccatcggtcttcccctggcgccctgctccaggagcacctccgagagcacagcggccctgggctgcctggtcaaggactacttccacgtgatcgactgagcgggctggcaaggcgcatagnn

SEQ ID NO: 232631 - DNA, 241 bp, Homo sapiens
  misc_feature: GYAE6OF01DC6CB.38.35.D02.1.454.CMB.1.raw
  modified_base (234)..(241): a, c, t, g, unknown or other
  misc_feature (234)..(241): n is a, c, g, or t
tcagtcgatcacgtcacgaccggtgctcgatttagcacacgataggttgggtttgggggagttatgtctgggccagggaaccctggccaccgtctcctcagcctccaccaagggcccatcggtcttcccctggcgccctgctccaggagcacctccgagagcacagcggccctgggctgcctggtcaaggctacttccacgtgatcgactgagcgggctggcaaggcgcatagnnnnnnnn

SEQ ID NO: 232632 - DNA, 237 bp, Homo sapiens
  misc_feature: GYAE6OF01DGWU7.38.35.D02.1.454.CMB.1.raw
  modified_base (235)..(237): a, c, t, g, unknown or other
  misc_feature (235)..(237): n is a, c, g, or t
tcagtcgatcacgtcacgaccggtgctcgatttagcacacgatagttgggtttgggggagttatgtctggggccagggaaccctggccaccgtctcctcagcctccaccaagggcccatcggtcttcccctggcgccctgctccaggagcacctccgagagcacagcggccctgggctgcctggtcaaggactacttccacgtgatcgactgagcgggctggcaaggcgcatagnnn

SEQ ID NO: 232633 - DNA, 237 bp, Homo sapiens; identical to SEQ ID NO: 232632
  misc_feature: GYAE6OF01CM9N0.38.35.D02.1.454.CMB.1.raw
  modified_base (235)..(237): a, c, t, g, unknown or other
  misc_feature (235)..(237): n is a, c, g, or t

SEQ ID NO: 232634 - DNA, 525 bp, Homo sapiens
  misc_feature: GYAE6OF01A8RLP.38.35.D02.1.454.CMB.1.raw
  modified_base (288)..(288): a, c, t, g, unknown or other
  misc_feature (288)..(288): n is a, c, g, or t
  modified_base (459)..(459): a, c, t, g, unknown or other
  misc_feature (459)..(459): n is a, c, g, or t
  modified_base (519)..(519): a, c, t, g, unknown or other
  misc_feature (519)..(519): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtctgggggagtcgtggtccagcctggggggtccctgagactctcctgtgcagcctctggattcaacttcaaaaattntgggatgcactgggtccgccaggctccaggcaaggggctgggagtgggtggcaactatatcatatgatggaaagttttaaagactatgcggactccgtgaagggccgattcaccatctccagagacaatccaagagcacactctattgacaaatgaacagcctagggacgntagaggacacggctgtctattactgtgacgaaagacccggtcctactagtcgggtcgggngttacg

SEQ ID NO: 232635 - DNA, 236 bp, Homo sapiens
  misc_feature: GYAE6OF01C2PPR.38.35.D02.1.454.CMB.1.raw
  modified_base (234)..(236): a, c, t, g, unknown or other
  misc_feature (234)..(236): n is a, c, g, or t
tcagtcgatcacgtcacgaccggtgctcgatttagcacacgatagttgggtttggggagttatgtctggggccagggaaccctggccaccgtctcctcagcctccaccaagggcccatcggtcttcccctggcgccctgctccaggagcacctccgagagcacagcggccctgggctgcctggtcaaggactacttccacgtgatcgactgagcgggctggcaaggcgcatagnnn

SEQ ID NO: 232636 - DNA, 648 bp, Homo sapiens
  misc_feature: GYAE6OF01EH0IF.38.35.D02.1.454.CMB.1.raw
  modified_base (291)..(291): a, c, t, g, unknown or other
  misc_feature (291)..(291): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccagccgtggggggtccctgagactctcctgtgcagcctctggattcaacttacaaaaattntagggatgcacgtgggtcccgccaggcctccgaggcgaaggggctgggaggtgggtggcaactatatcatatgataggtaaagttttaaagacttagtgacggtactccggtaggaacgggtccgtattccaacctattcctaccaagaacgaactaaacttacccgaaagacgaccaactaccttacttaactttacgaactaaaagttacgaaacgtaacggtcccgttaggggactaccgtaggaacggaaccgaccgggtcttaggttacttacgtttaacgtggttacgaaccgaaaaccggaaccccggtcccttacgttaaggttcgggggttacggggtagtttaacgg

SEQ ID NO: 232637 - DNA, 199 bp, Homo sapiens
  misc_feature: GYAE6OF01A3GHS.38.35.D02.1.454.CMB.1.raw
  modified_base (199)..(199): a, c, t, g, unknown or other
  misc_feature (199)..(199): n is a, c, g, or t
tcagtcgatcacgtcacgaccggtgctcgatttagcacacgatagttgggttttgggggaagaggaagactgacggcccatcggttcttccccctggcgccctgctccaggagcacctccgagagcacagcggccctgggctgcctggtcaaggactacttccacgtgatcgactgagcgggctggcaaggcgcatagn

SEQ ID NO: 232638 - DNA, 240 bp, Homo sapiens
  misc_feature: GYAE6OF01C270L.38.35.D02.1.454.CMB.1.raw
  modified_base (235)..(240): a, c, t, g, unknown or other
  misc_feature (235)..(240): n is a, c, g, or t
tcagtcgatcacgtcacgaccggtgctcgatttagcacacgatagttgggtttgggggagttatgtctggggccagggaaccctggccaccgtctcctcagcctccaccaagggcccatcggtcttcccctggcgccctgctccaggagcacctccgagagcacagcggccctgggctgcctggtcaaggactacttccacgtgatcgactgagcgggctggcaaggcgcatagnnnnnn

SEQ ID NO: 232639 - DNA, 666 bp, Homo sapiens
  misc_feature: GYAE6OF01DCO3W.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtctgggggagtcgtggtccagccgtggggggtccctgagactctcctgtgcagcctctggattcaacttacaaaaattatggatgcacgtggtccgccaggcctccgaggcgaaggggctgggaggtgggtaggcaacgtatagtacaatatgataggtaaagttttaaagactagtgacggtacgttccgaggaacgggccgtattccgaacctagtacctacccgaaggaacgtaacctaatttacccgaaagacgaccaactaccttaccttaagttttacgaactaaaattcgaaaaccgtaggtcccgttaggggaatccgttacggaaggtaaccgacgggcttaggtaccgtttaaacttacgttcggtacgaaaccgggtaaaacgtaaccccgggtccccctttaacggttaacggttacgggggttccggggtaagtttaacggg

SEQ ID NO: 232640 - DNA, 687 bp, Homo sapiens
  misc_feature: GYAE6OF01BUEC4.38.35.D02.1.454.CMB.1.raw
  modified_base (316)..(316): a, c, t, g, unknown or other
  misc_feature (316)..(316): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccaggccgtggggggtccctggacgactctcctgtgcagcctcgtggacttcaacttacaaaaattgtgggatgcacgtcgggtccnccgaggcctccgaggcgaaggggctgggaggtgggtggacaacgtatatcaatagtgaagttagggtaaagttttaaagacttagtcgacggtacgtccggtaggaacgggtccgtaattccgacctataccctaccgaagaacgtaacctaacgttacccgaaaggacgacctaactaaccgttacttaagtttacgaactaaaagttacggaaacctacggtacccgttaggggaacgtaccgtaggaacggtaccgaccggtcgttacgttaccgttaacgtttacgtcggtacggaaccggtaaaaccggaccccggtaccccgttacgttaacgggttcgggggtaccggggttaactttaacggg

SEQ ID NO: 232641 - DNA, 647 bp, Homo sapiens
  misc_feature: GYAE6OF01AJZGO.38.35.D02.1.454.CMB.1.raw
  modified_base (289)..(289): a, c, t, g, unknown or other
  misc_feature (289)..(289): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtggggagtcgtggtccagccgtgggggtccctgagactctcctgtgcagcctctggattcaacttacaaaaattntgggatgcacgtgggtcccgccaggctccgaggcgaaggggctgggaggtgggtgcaactatatcatatgataggtaaagttttaaagactatcgacggtactccggtagaacgggcctattccacctatcctacccgaagacgaacctaacttaccaaagtacgacctaacacttacttaatttacgaactaaacgttacgaaaccgtacgtcccgttaggggaacgtcgttaggaacgggaccgtacgggccttacggtacctttaagttaccgttggtcggaaaccgggaaaaccgtaaccccgggtccccttacggttaacgggttccgggggttacgggggtaagtttacggg

SEQ ID NO: 232642 - DNA, 649 bp, Homo sapiens
  misc_feature: GYAE6OF01CLJ2U.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccagccgtgggggtccctgagctctcctgtgcagcctcgtggacttcaacttacaaaaattatgggatgctacgtcgggtccgccgaggcctccgaggcgaaggggctgggaggtggggtggaccaacttatatcaattatagattaggtaaagttttaaagacttagtgacggtactccggtaggaacgggtcctagttaccaaccgtactccgtaccagaacgtaactaacttaccgaagaacgaccaaccacttactatttacgaactaaagtacgaaaccacgtccgtagggaacgtcgtagggaacggaccgacggtcgtagttaccgttaacgtttatacggtacgaaccggtaaaacggtaaccccggtacccgttacgttacggttacgggggttcggggtaagtttacggg

SEQ ID NO: 232643 - DNA, 646 bp, Homo sapiens
  misc_feature: GYAE6OF01CC2A4.38.35.D02.1.454.CMB.1.raw
  modified_base (289)..(289): a, c, t, g, unknown or other
  misc_feature (289)..(289): n is a, c, g, or t
  modified_base (354)..(354): a, c, t, g, unknown or other
  misc_feature (354)..(354): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtctgggggagtcgtggtccagccgtggggggtccctgagactctcctgtgcagcctctggattcaacttcaaaaattntgggatgcacgtgggtccgccaggctccgaggcaaggggctggagtgggtgcaactatatcatangatggtaaagtttaaagactagtcgacggacttccggtagaacgggccgtaattccgaacctaatcctaccgaagaacgtaacctaaacttacccaaaggacgtaccaaccgtaaccttacttaagttttacgaactaaaagttcgaaaccgtacggtacccggtaaggggacgccgtagggaacggtaccgacgggtccttaggttaccgttaagttacgtaggttacgaaccggtaaaacggaccccggtaccccttacgtaggtcgggggtacggggtaagtttacggg

SEQ ID NO: 232644 - DNA, 238 bp, Homo sapiens
  misc_feature: GYAE6OF01DZO7G.38.35.D02.1.454.CMB.1.raw
  modified_base (236)..(238): a, c, t, g, unknown or other
  misc_feature (236)..(238): n is a, c, g, or t
tcagtcgatcacgtcacgaccggtgctcgatttagcacacgatagttgggtttgggggagttatgtctggggccagggaaccctggccaccgtctcctcagcctccaccaagggcccatcggtcttccccctggcgccctgctccaggagcacctccgagagcacagcggccctgggctgcctggtcaaggactacttccacgtgatcgactgagcgggctggcaaggcgcatagnnn

SEQ ID NO: 232645 - DNA, 265 bp, Homo sapiens
  misc_feature: GYAE6OF01CJDMH.38.35.D02.1.454.CMB.1.raw
  modified_base (190)..(190): a, c, t, g, unknown or other
  misc_feature (190)..(190): n is a, c, g, or t
  modified_base (206)..(265): a, c, t, g, unknown or other
  misc_feature (206)..(265): n is a, c, g, or t
tcagtcgatcacgtcacgaccggtgctcgatttagcacacgatagttggggttttgggggggaagaggaagactgacggcccatcggtcttccccctggcgccctgctccaggagcacctccgagagcacgagcggccctgggctgcctgggtcaaggacctacgttccgacgtgatcgactgagcgggntggcaaggcgcatagnnnnnnnnnnnnnnnnnnnnnnnnnnnnnnnnnnnnnnnnnnnnnnnnnnnnnnnnnnnn

SEQ ID NO: 232646 - DNA, 199 bp, Homo sapiens
  misc_feature: GYAE6OF01BOBK9.38.35.D02.1.454.CMB.1.raw
  modified_base (197)..(199): a, c, t, g, unknown or other
  misc_feature (197)..(199): n is a, c, g, or t
tcagtcgatcacgtcacgaccggtgctcgatttagcacacgatagttgggttttgggggaagaggaagactgacggcccatcggtcttccccctggcgccctgctccaggagcacctccgagagcacagcggccctgggctgcctggtcaaggactcttccacgtgatcgactgagcgggctggcaaggcgcatagnnn

SEQ ID NO: 232647 - DNA, 750 bp, Homo sapiens
  misc_feature: GYAE6OF01D8WRB.38.35.D02.1.454.CMB.1.raw
  modified_base (290)..(290): a, c, t, g, unknown or other
  misc_feature (290)..(290): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccagccgtgggggtccctgagactctcctgtgcagcctctggattcaacttacaaaaattntgggatgcacgtgggtccgccgaggctccgaggcgaagggctgggagtgggtgacaactatatcatatgagtaggtaaagttttaaagactagtcgacggtacgtccggtaggaacggggtccgtaacgtttaccacctaacttccgttaccccgaacggtaacggtaacctaaacgtttaccccgaaaaggtaacgacccgaaccgtaaccttacctttaagttttacgaactaaaacgttacgaaaaccgtacgggtaaccccgttagggggaacgtaccgttacgggaacgggtacccgtaaccggggtccttaccgggtttaacctttaacggttttaacccgttagggttaccggaaacccgggtaaaaacccgggtaaacccccgggttacccccgtttaaccggttaaacggggtttcggggggttaaccggggggttaaggttttaaccggg

SEQ ID NO: 232648 - DNA, 597 bp, Homo sapiens
  misc_feature: GYAE6OF01BCYZ9.38.35.D02.1.454.CMB.1.raw
  modified_base (288)..(288): a, c, t, g, unknown or other
  misc_feature (288)..(288): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtctgggggagtcgtggtccagcctggggggtccctgagactctcctgtgcagcctctggattcaacttcaaaaattntgggatgcacgtgggtccgccaggctccgaggcaaggggctgggagtgggtggcaactatatcatatgataggtaaagttttaaagacttaagtgacggtactccggtaggaacggggtccgtagttccaacctattcctacccaaggacgaactaacttacccgaaagtacgaccaacctacttacttatttacgactaaagtacgaaccgacgtccgtagggaacgcgtaggaggacgacggtctagtactacttacgtgtcgacgtaaacgacccggtcctacgtaggtcgggtcgggtgttacgg

SEQ ID NO: 232649 - DNA, 237 bp, Homo sapiens
  misc_feature: GYAE6OF01B3QD5.38.35.D02.1.454.CMB.1.raw
  modified_base (235)..(237): a, c, t, g, unknown or other
  misc_feature (235)..(237): n is a, c, g, or t
tcagtcgatcacgtcacgaccggtgctcgatttagcacacgatagttgggtttgggggagttatgtctggggccagggaaccctggccaccgtctcctcagcctccaccaagggcccatcggtcttccccctggcgccctgctccaggagcacctccgagagcacagcggccctgggctgcctggtcaaggctacttccacgtgatcgactgagcgggctggcaaggcgcatagnnn

SEQ ID NO: 232650 - DNA, 241 bp, Homo sapiens
  misc_feature: GYAE6OF01EZ01W.38.35.D02.1.454.CMB.1.raw
  modified_base (229)..(229): a, c, t, g, unknown or other
  misc_feature (229)..(229): n is a, c, g, or t
  modified_base (235)..(241): a, c, t, g, unknown or other
  misc_feature (235)..(241): n is a, c, g, or t
tcagtcgatcacgtcacgaccggtgctcgatttagcacacgatagttgggtttggggggagttatgtctggggccagggaaccctggccaccgtctcctcagcctccaccaagggcccatcggtcttcccctggcgccctgctccaggagcacctccgagagcacagcggccctgggctgcctggtcaaggactacttccagtgatcgactgagcgggctggcaaggcncatagnnnnnnn

SEQ ID NO: 232651 - DNA, 644 bp, Homo sapiens
  misc_feature: GYAE6OF01EKW2N.38.35.D02.1.454.CMB.1.raw
  modified_base (286)..(286): a, c, t, g, unknown or other
  misc_feature (286)..(286): n is a, c, g, or t
tcagtcgatcacgtcacgaccggtgctcgatttagcacacgatagttgggtttgggggggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccaggcctggggggtccctgagactctcctgtgcagcctctggattcaactttacaaaaattntgggatgcacgtgggtcccgcaggcctccgagggcgaaggggctgggaggtgggtgacaactatatcatagtagagtagggtaaagttttaaagacttagtcggaccggactccggtaggaacgggcctagttccaccgtactcctaccaagagaactaacttaccgaagacgaccaacctactacttactttagactaaagtcgaaacacggtacctaggggacacgtaggaaccggacaccggtcgttcgtacgttacttacgtaggtacggtaaccggaaaccggaacccggtcccctacgtaacgggtccgggggttacgggtaacgttaggtcggtcggtcggggtaccccgg

SEQ ID NO: 232652 - DNA, 664 bp, Homo sapiens
  misc_feature: GYAE6OF01CWA9J.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccagccgtggggggtccctgagactctcctgtgcagcctctggattcaacttacaaaaattatgggatgacacgtgggtccgccaggctccgaggccgaaggggctgggagtgggtggacaactatagtcaatatgtaataggtaaagttttaaagaacttagtcggacggtactccggtaggaacgggtccgtattccaaccgatcctaccgaagaagaactaaattacccgaaagacgaccaactaacgtacttaatttacgaactaaaattacgaaaccacggtacccgtaggggaacgtacgtacggaaggaaccgtaccgggccttaggtaccttaagttaccgttaggtacggaacccggtaaaaaccggaacccccggtaccccgttaaccgtaagggttcgggggtaccgggggtaaggtttacggg

SEQ ID NO: 232653 - DNA, 566 bp, Homo sapiens
  misc_feature: GYAE6OF01AK4QQ.38.35.D02.1.454.CMB.1.raw
  modified_base (296)..(296): a, c, t, g, unknown or other
  misc_feature (296)..(296): n is a, c, g, or t
  modified_base (558)..(558): a, c, t, g, unknown or other
  misc_feature (558)..(558): n is a, c, g, or t
tcagtcgatcacgtcacgaccggtgctcgatttagcacacgatagttgggtttgggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcggtggtccagccgtggggggtcccctggagactctcctgtgcacgcctctggattcaacttacaaaaattntgggatgcacgtgggtccgccaggctccgaggcgaaggggctgggaggtgggtgcaactatatcatatgataggtaatttaagactatgacggtactcggtaggaacgggccgtatcaccatctccagagacaataccaagacgcacactctattcacaaatcaacgacgtacctagggatcgtaggacggacacggtctggtacttacgttagtaggtcgacggaaacgaccccggtccttacgtaggtcgggtacggggngtttacgg

SEQ ID NO: 232654 - DNA, 259 bp, Homo sapiens
  misc_feature: GYAE6OF01A9QGL.38.35.D02.1.454.CMB.1.raw
  modified_base (256)..(259): a, c, t, g, unknown or other
  misc_feature (256)..(259): n is a, c, g, or t
tcagtcgatcacgtcacgaccggtgctcgatttagcacacgatagttgggtgtgggggagtgggggctactcctggcgttttgactactggggccagggagccctggtcaccgtctcctcagcctccaccaagggcccatcggtcttccccctggcgccctgctccaggagcacctccgagagcacagcggccctgggctgcctggtcaaggctacttccacgtgatcgactgagcgggctggcaaggcgcatagnnnn

SEQ ID NO: 232655 - DNA, 238 bp, Homo sapiens
  misc_feature: GYAE6OF01CEI0L.38.35.D02.1.454.CMB.1.raw
  modified_base (228)..(228): a, c, t, g, unknown or other
  misc_feature (228)..(228): n is a, c, g, or t
  modified_base (234)..(238): a, c, t, g, unknown or other
  misc_feature (234)..(238): n is a, c, g, or t
tcagtcgatcacgtcacgaccggtgctcgatttagcacacgatagttgggtttgggggagttatgtctggggccagggaaccctggccaccgtctcctcagcctccaccaagggcccatcggtcttcccctggcgccctgctccaggagcacctccgagagcacagcggccctgggctgcctggtcaaggctacttccagtgatcgactgagcgggctggcaagggcncatagnnnnn

SEQ ID NO: 232656 - DNA, 811 bp, Homo sapiens
  misc_feature: GYAE6OF01EEEAA.38.35.D02.1.454.CMB.1.raw
tcagtcgatcacgtcacgaccggtgctcgatttagcacacgatagttgggtttggggagctctgggagaggagcccagcactagaagtcggcggagtttccattcagtgatcagcactgaacacagaggactcaccatggagtttgggctgaacttgggttttcctcgtagtcttcttttaagaggtgtccagtgtcagatgcagcgtgggtggagtcggtgggggagtcggtggtccgaggtcccggttcggggggtccctggacgtaccgttccgtccgtggtcgccgacgtcccgtcgtaggtactttacctaaacctttaactaaaaaagtttcgtagggtaatcggtccgtacggttccggggtcccgaccgacggtccctaccggacgggaccggaagggggtccgtaggggtacgggtcggggtacggaaccgtaaagttaacgtacgttactaaagttagtaggtaaagttaacggggttaaaagttttaaacgtacgttaaaggtcggtaaccgggtaccgttaccggtaaggggtaaccgggtacccttaagtaacccgtacctaaccgttacccgaacgaacggtaaccgaaacgtaaaccttaccgaaaggtaccgaacctaaccgtacttaccgtttaagttacgaactaaaacgttcgaaaccgtccggtaccggttagggacgtacgtaacgggaacggtacccgacggtacgttacgttaacgttgtaacgtggtaaccgaaccggtaaaccgtacccggtcccgttaagtccggggttggggtaccgggttacg

SEQ ID NO: 232657 - DNA, 607 bp, Homo sapiens
  misc_feature: GYAE6OF01A9ZV9.38.35.D02.1.454.CMB.1.raw
  modified_base (288)..(288): a, c, t, g, unknown or other
  misc_feature (288)..(288): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtctgggggagtcgtggtccagcctggggggtccctgagactctcctgtgcagcctctggattcaacttcaaaaattntgggatgcactgggtccgccaggctccgaggcgaaggggctgggagtgggtggcaactatatcatatgataggtaaagttttaagactagtgcggtactccggtagaacgggtccgattccacctatcctaccaagaacgaactaaacttcccaaaggacgaccaacctacttacttaatttcgactaaaagtacgaaaccagtacccgtagggacgcgtaggacggaccacggtcttaggtacttagttacgttggtcggaaccggaaaacggaccccggtcccttacgtaaggtcgggggttcggggtagtttacgg

SEQ ID NO: 232658 - DNA, 585 bp, Homo sapiens
  misc_feature: GYAE6OF01DNRTB.38.35.D02.1.454.CMB.1.raw
  modified_base (312)..(312): a, c, t, g, unknown or other
  misc_feature (312)..(312): n is a, c, g, or t
  modified_base (452)..(452): a, c, t, g, unknown or other
  misc_feature (452)..(452): n is a, c, g, or t
  modified_base (578)..(578): a, c, t, g, unknown or other
  misc_feature (578)..(578): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccagccgtggggggtccctgagactctcctgtgcagcctctggattacaacttacaaaaattgtgggatgcacgtcgggtccnccgaggctccgaggccgaaggggctggagtgggtacggactaatagtatacataagtgtatagggtaaatttaaagactagtgacggtactcggtaggacgggcctattccaactatcctacagagacaacttccaagancactactactatttgactaaatcgaaacctagtcctaggggctacgtaggacgaccgacggtcttgtacttaagttacgtgtcggaacgaaacgacccggtcctacggtagtcggggtaccgggtnttaacgg

SEQ ID NO: 232659 - DNA, 632 bp, Homo sapiens
  misc_feature: GYAE6OF01A9F36.38.35.D02.1.454.CMB.1.raw
  modified_base (293)..(293): a, c, t, g, unknown or other
  misc_feature (293)..(293): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccagccgtggggggtccctggagactctcctgtgcagcctctggattcaacttacaaaaatttntgggatgcacgtgggtcccgcgacggcctccgaggcgaaggggctgggaggtgggtggacaactagtatcatagtgataggtaaagttttaaagacttagtgtacggactccgtaggaacgggccgtattcaacctactcctacccgagacgaactaacttccgaaagacgtaccacgtaaccttcttagtttacgaactaaatacgaaacacggtccgttagggacgtacgtagacggaccgacgggtcttacggttacttagtttacctggtcggaaccggaaacgaaccccgggttccctacggttagggtaccgggggttcgggtaagttacggg

SEQ ID NO: 232660 - DNA, 595 bp, Homo sapiens
  misc_feature: GYAE6OF01EH27Y.38.35.D02.1.454.CMB.1.raw
  modified_base (485)..(485): a, c, t, g, unknown or other
  misc_feature (485)..(485): n is a, c, g, or t
  modified_base (499)..(499): a, c, t, g, unknown or other
  misc_feature (499)..(499): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccagccgtggggggtccctggacgactctcctgtgcagcctctggattcaacttacaaaaattgtagggatgctacgtcggggtccgccgaggcctccgaggcgaaggggctgggagtgggtgcaactatatcatatagataggtaaagttttaaagactagtgacggtactcggtaggaacgggtcctattaccactactctccgaagacactaattacccgaagcacaactactacttattcacaaatcgaacngtaccgtagggacncgtagacggacacggtctacggttactacgttagtaggtacggaacggaaaaccgaccccggtccctagtaagggtcggggtcgggtagtttacgg

SEQ ID NO: 232661 - DNA, 244 bp, Homo sapiens
  misc_feature: GYAE6OF01A6BQS.38.35.D02.1.454.CMB.1.raw
  modified_base (237)..(244): a, c, t, g, unknown or other
  misc_feature (237)..(244): n is a, c, g, or t
tcagtcgatcacgtcacgaccggtgctcgatttagcacacgatagttgggtttggggggagttatgtctggggccagggaaccctggccaccgtctcctcagcctccaccaagggcccatcggtcttccccctggcgccctgctccaggagcacctccgagagcacagcggccctgggctgcctggtcaaggactacttccacgtgatcgactgagcgggctggcaaggcgcatagnnnnnnnn

SEQ ID NO: 232662 - DNA, 242 bp, Homo sapiens
  misc_feature: GYAE6OF01EW8Q5.38.35.D02.1.454.CMB.1.raw
  modified_base (236)..(242): a, c, t, g, unknown or other
  misc_feature (236)..(242): n is a, c, g, or t
tcagtcgatcacgtcacgaccggtgctcgatttagcacacgatagttgggtttggggggagttatgtctggggccagggaaccctggccaccgtctcctcagcctccaccaagggcccatcggtcttccccctggcgccctgctccaggagcacctccgagagcacagcggccctgggctgcctggtcaaggctacttccacgtgatcgactgagcgggctggcaaggcgcatagnnnnnnn

SEQ ID NO: 232663 - DNA, 242 bp, Homo sapiens
  misc_feature: GYAE6OF01BK0OK.38.35.D02.1.454.CMB.1.raw
  modified_base (237)..(242): a, c, t, g, unknown or other
  misc_feature (237)..(242): n is a, c, g, or t
tcagtcgatcacgtcacgaccggtgctcgatttagcacacgatagttgggtttggggggagttatgtctggggccagggaaccctggccaccgtctcctcagcctccaccaagggcccatcggtcttccccctggcgccctgctccaggagcacctccgagagcacagcggccctgggctgcctggtcaaggactacttccacgtgatcgactgagcgggctggcaaggcgcatagnnnnnn

SEQ ID NO: 232664 - DNA, 692 bp, Homo sapiens
  misc_feature: GYAE6OF01BR6AH.38.35.D02.1.454.CMB.1.raw
  modified_base (262)..(262): a, c, t, g, unknown or other
  misc_feature (262)..(262): n is a, c, g, or t
tcagtcgatcacgtcacgaccggtgctcgatttagcacacgatagttgggtttgggggggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtggggagtcgtggtccagccgtggggggtccctgagactctcctgtgcagcctntggattccaactttacaaaaattgtgggatgcacgtgggtcccgccaggcctccgagggcgaagggggtcctggggaggtggggtaggacctaacgtatatctaatagtagtaagttaggtaaagttttaaagacttagtcggacggtactccggtaggaacgggcctactcacctactcctaccgaagacgaacctaacttaccgaagacgtaccacctaccgttacttaatttacgaactaaacgtacgaacgaaggtccgtagggacgtacgtagggaacggacgtaccggtcttacggtacttagttaccgtgttacgggaaacccggtaaacgggtacccccggttccgttacggttaacgggttacgggggttacgggggttaacgtttaggttcgggttacggggtcggggtaaaccccgggg

SEQ ID NO: 232665 - DNA, 689 bp, Homo sapiens
  misc_feature: GYAE6OF01EK23K.38.35.D02.1.454.CMB.1.raw
  modified_base (267)..(267): a, c, t, g, unknown or other
  misc_feature (267)..(267): n is a, c, g, or t
tcagtcgatcacgtcacgaccggtgctcgatttagcacacgatagttgggtttgggggggaggaggagcccagcactagaagtcggcggagtttccattcggtgatcagcactgaacacagaggactcaccatggagtttgggctgaactgggttttcctcgtagcttcttttaagaggtgtccagtgtcagatgcagctggtggagtcgtgggggagtcgtggtccaggccgtggggggtccctgagactctcctgtgcacgcctntggattacaacttacaaaaattgtgggatgcacgtcgggtccgcaggctccgaggcgaaggggctgggaggtgggtgcaactatatcatagtgagttaggtaaagttttaaagacttagtacggaccggtacgttcccggtaaggaacggggtaccctaacgtttacccaaccgtattaccccgtaccaaggaacgtaacctaaacttacccgaaaggacgaccaacctacttacttaagtttcgactaaaagtacgaaaccacggtcccgtaagggaccgtacgtacggaacggtaccgaccgggtcttacgttactaacgtttacgtaggtacgggtaccgaaaaaccgggtaccccggtacccgtcgttaaggtcggggttacggggtatttacggtcggtcggtcgggggaaccccgg

SEQ ID NO: 232666 - DNA, 237 bp, Homo sapiens; identical to SEQ ID NO: 232632
  misc_feature: GYAE6OF01AM55V.38.35.D02.1.454.CMB.1.raw
  modified_base (235)..(237): a, c, t, g, unknown or other
  misc_feature (235)..(237): n is a, c, g, or t

SEQ ID NO: 232667 - DNA, 568 bp, Homo sapiens
  misc_feature: GYAE6OF01B7R91.38.35.D02.1.454.CMB.1.raw
  modified_base (480)..(480): a, c, t, g, unknown or other
  misc_feature (480)..(480): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccagccgtggggggtccctgagactctcctgtgcagcctctggattcaacttacaaaaattatggggatgcacgtcgggtccgccaggcctccaggcgaaggggctgggagtgggtggacaactatatcatatgataggtaaagtttaaagacttagtgacggactcgtaggaacgggccgattcacctatcctccaagacactaattccaagacgcacactactatttgacaatgaacagccgtagggancgtaggacggacgacggtctagtcgttacttacgtggtcgacgaaacgacccggtcccttacgtaggtcggggtcggggtagttacgg

SEQ ID NO: 232668 - DNA, 593 bp, Homo sapiens
  misc_feature: GYAE6OF01B3XXA.38.35.D02.1.454.CMB.1.raw
  modified_base (287)..(287): a, c, t, g, unknown or other
  misc_feature (287)..(287): n is a, c, g, or t
tcagtcgatcacgtcacgaccggtgctcgatttagcacacgatagttgggtttgggggggagaggagcccagcactagaagtcggcggagtttccattcggtgatcagcactgaacacagaggactcaccatggagtttgggctgaactgggttttcctcgtagctcttttaagaggtgtccagtgtcagatgcagctgggtggagtcgtggggggagtcgtggtccagccgtggggggtccctgagactctcctgtgcagcctctggattcaacttacaaaaattntgggatgcacgtgggtccgccaggcctccgaggcgaaggggctgggaggtgggtggcaactatatcatatgataggtaaagtttaaagactagtgcggactccggtaggaacgggtccgaattccacctatcctaccagacgaactaattaccgaagagactacacttactatttagactaaatgaaacagccgtagggagcgtaggaggaccgacggctgtacttattacgtaggtaggaccgtaaacggacccggtccctacgtaggtcggggtcgggtagttagtcggtcggtcggggacccg

SEQ ID NO: 232669 - DNA, 635 bp, Homo sapiens
  misc_feature: GYAE6OF01DV6L4.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtctgggggagtcgtggtccagccgtggggggtccctggagactctcctgtgcagcctctggattcaacttacaaaaattatggatgcacgtgggtcccgccaggctccaggcgaaggggctagggagtgggtggaccaacgtatatcatatgaattaggtaaagttttaaagacttataggcggtaaccgtccggtaggaacgggtccgtattccgaacctatcctaccgagaacaacaacttaccgaaagtacaccgaacacttcttaagtttagactaaaagtggaaacctagtacccgtagggacgtcgtagggaacggacaccgggtctggtacccttagtttaaccgtggtaccggaacgaaaacggaaccccgggtccccttaacggtaggttcggggtccgggggtaagtttacggg

SEQ ID NO: 232670 - DNA, 627 bp, Homo sapiens
  misc_feature: GYAE6OF01A9TKL.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccagccgtggggggtccctgagactctcctgtgcagcctctggattcaacttacaaaaattgtagggatgcacgtcgggtccgccgaggcctccgaggcgaaggggctgggagtggggtggacaacgtatatcaatatagataggtaaagttttaaagactagtgacggtactccggtaggaagggccgtattccacctactcctaccgaagacgaactaacttaccgaagacgacctaacaccttacttatttacgaactaaattacgaaaccgtacgtaccgttaggggacgtcgtagggaacggaccgtacggtcttaggtacttacgttactggtacgaaccggaaacgtaacccggtcccttagtacggtcggggttacggggtagtttacgg

SEQ ID NO: 232671 - DNA, 680 bp, Homo sapiens
  misc_feature: GYAE6OF01EBGIY.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccagccgtggggggtccctgacgactctcctgtgcagcctctggacttcaacttacaaaaattagtgggatgctacgtgggtccgcgaggcctccgagggcgaaggggctgggaggtggggtaggacaacgttatacgtcaatatgaagttaggtaaagttttaaagaacgttagtacggtacggtacgttcccggtagggaacggggtccgtaactttaccaacccgtaacttccctaccgaagaacgtaactaaacttacccgaaagtacgacctaacctaccttacttaatttacgaactaaagttacgaacacgggtccgttagggactcgtaggaacggtaccgacgggtcttcgttacgttacgtttacgtacggttcggaaaccggaaacgtaccccgggtacccttacgtaacgggtttcgggggtacgggttaagttacggg

SEQ ID NO: 232672 - DNA, 747 bp, Homo sapiens
  misc_feature: GYAE6OF01C8IJ1.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagagactcaccatggagtttggctgaacttgggttttcctcgtagcttcgttttaagaggtgtccagtgtcagatgcagcgtggtggagtcgtgggggagtcgtggtccagccgtgggggtcctgagctcgtcctgtcgcacgtcctcgtggtacttactaaacctttaacaaaaaagtttgtagggtaatcgaccgacggtcgggtcccgccgaacggcctccgaggcgaaggggcgtagggacggtaggggtcggaccgtaaattagtaactcaatagtaggtaagtaaggttaaaagtttaaagaacttaagtcggtaacggtaccgttaccggtaaggaacgggtaccgtattaccaaccgtactaccgtaccgaaagaacgtaaaccaaacttacccgaaaggacgtaccaacgttactactttaattacgaactaaactacggaaaccgtacgacccggttagggacgtacggtacggaacgggaacccgtacgggtccgttaagttaaccgttacgtttaaccgtacggttaaccggaaacccgggtaaaaccgtacccccggtaccccgttaacgggtaacgggttacgggggtaccggggttaagtttacgggg

SEQ ID NO: 232673 - DNA, 662 bp, Homo sapiens
  misc_feature: GYAE6OF01AIK06.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcggtggtccagtcccgtgggggttcccctggagacctctcctgtgcagcctctggattccaacttacaaaattgtgggatgcacgtcggtcccgccgacggcctccgaggcgaaggggcgtgggaggtgggtgactaacgtatactacattagtaggtaagttaggtaaagttttaaagacttagtggtaccggtactccggtaggaacgggtccgtattaccaccgtactcctaccgaagaacgtacctaaacgttaccgaaagaccgacctaactaccttacttatttacgaactaaagtcgaaacacggtacgtagggacgtcgtaggacggaccgacggtacttagttacgttaacgtttacgaggtaccgaaccggtaaacccggacccggtcccttacggttacgggttacgggggttacggggtgttacggg

SEQ ID NO: 232674 - DNA, 771 bp, Homo sapiens
  misc_feature: GYAE6OF01CENUK.38.35.D02.1.454.CMB.1.raw
  modified_base (289)..(289): a, c, t, g, unknown or other
  misc_feature (289)..(289): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccagccgtgggggtccctgagctctcctgtgcagcctctggattcaacttacaaaaattntgggatgcacgtgggtccgccgaggcctccgaggccgaaggggcctgggaggttggggtggactaacgtagtatcatagtgaattagggtaaagttttaaagacttagtcggacggtacgttccggtagaacggggtccgtaatttcccaaccgtacttccgtaccccgaaaggtacggtaaacctaacgtttaccccgaaaggtaaccgtaccctaaaccgttaccctttaacgtttaacgttttaccggaaccgttaaaaacgtttaccggaaaaccgtaacgggtaccccggttagggggaaccgtacgttacgggaacgggtacccgtaaccggggtcttaccgggttttaccgtaagtttttacccgtagggttaccggtaaaccgggtaaaaacccgggttaacccccgggtaccccgtttaacggttaagggggttccggggggtttaaccgggggttaacggttttaaccgggg

SEQ ID NO: 232675 - DNA, 686 bp, Homo sapiens
  misc_feature: GYAE6OF01DV6L7.38.35.D02.1.454.CMB.1.raw
  modified_base (287)..(287): a, c, t, g, unknown or other
  misc_feature (287)..(287): n is a, c, g, or t
  modified_base (544)..(544): a, c, t, g, unknown or other
  misc_feature (544)..(544): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtctgggggagtcgtggtccagcctgggggtccctgagactctcctgtgcagcctctggattcaacttcaaaaattntgggaactgcaacgtgggtccgccaggactccgaggccaagggctaggagtgggtggcaacgtatagtccaatacgtgatacgggtaaagttttaaaagacttaatcggacggtaccttaccggtagaacggggccgtaagtttccaacccagttccctaccgaagaacgaactaaacgttacccaaaggtacgcgaacaacctacgttaatttcggaacctaaaagttcggaaaaccagggtccctagggggaacnccgttagggaacggaacccaacggggtccttggtaccgttaacgtttaacccgtaggtcggaacccggttaaaaacggaacccccggggtacccctttaaccggtaggttacgggggtcccgggggtaaagttttaaccggg

SEQ ID NO: 232676 - DNA, 615 bp, Homo sapiens
  misc_feature: GYAE6OF01ET2IO.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatgggagtttgggctgaactgggttttcctcgtagctcttttaagaggtgtccagtgtcagatgcagctggtggagtcgtgggggagtcgtggtccaggcctggggggtccctgagactctcctgtgcagcctctggattcaacttcaaaaattatgggatgcacgtgggtccgccgaggctccgaggcaaggggctgggaggtgggtcggacaactagtatcaatatgatggtaaagttttaaagactagtgcggacttccggtagaacggggccctaagttccaccgattcctaccgaagaacggaactaacttacccaaaggacgtaccaactaccttacttaagtttcgaactaaatacgaaacgacgtccgtaggggatcggtagaggaccacggtctacgttctaacgttgtagtggaaccgaaacgaccccgggtcccttacggtaaggtcgggggtacgggtagttacggg

SEQ ID NO: 232677 - DNA, 598 bp, Homo sapiens
  misc_feature: GYAE6OF01BY9VV.38.35.D02.1.454.CMB.1.raw
  modified_base (482)..(482): a, c, t, g, unknown or other
  misc_feature (482)..(482): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccagccgtggggggtccctgagactctcctgtgcagcctctggattcagtctttgatgattatggcatgcacgtgggtccgacacgctccgagggacggcctgggaggtggtctcgaggttattaggttaggaactaggtagggtaggagtacggctagtggacggtactcgtggtaggaagggtccgtaattcgagcatcctacgaagacgaccaaccgtccaaagtaaccttccctagtaactacctaaanaacgtacgaaactgttacaggagacgtcgtaggacggaaccgtacgggtcctttaggtaactttcgtgtacgaacgttaaaggttattttaggaaggtttaggaaggtttaacggg

SEQ ID NO: 232678 - DNA, 639 bp, Homo sapiens
  misc_feature: GYAE6OF01AOZF4.38.35.D02.1.454.CMB.1.raw
  modified_base (552)..(552): a, c, t, g, unknown or other
  misc_feature (552)..(552): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtggggagtcgtggtccaggccgtgggggtccctgacgactctcctgtcgcacgcctcgtggtacttcaacttacaaaaattagtgggtatcgacctacgtcgggtcccgccgacggcctccgaggacgaaggggcgtgggaggtgggtggacctaacgtatactctaatagtagtagtaggttaaagtttaaagacttagtcggtacggtacgtcggtaggaacgggtcctacttaccgacctacgtcctacgaagacgtaactaacgtaccgaaagaccgacctaacgtacttacttaagtttacgaactaaagtacgaacgtcgtacgtagggacncgtagacggacgtacgtctagtacgttactagtagtacgaaccgtaaacgcccgtactacggttaggcggggttcgggtattacggg

SEQ ID NO: 232679 - DNA, 238 bp, Homo sapiens
  misc_feature: GYAE6OF01EX4AW.38.35.D02.1.454.CMB.1.raw
  modified_base (236)..(238): a, c, t, g, unknown or other
  misc_feature (236)..(238): n is a, c, g, or t
tcagtcgatcacgtcacgaccggtgctcgatttagcacacgatagttgggtttggggggagttatgtctggggccagggaaccctggccaccgtctcctcagcctccaccaagggcccatcggtcttcccctggcgccctgctccaggagcacctccgagagcacagcggccctgggctgcctggtcaaggactacttccacgtgatcgactgagcgggctggcaaggcgcatagnnn

SEQ ID NO: 232680 - DNA, 862 bp, Homo sapiens
  misc_feature: GYAE6OF01CQPXD.38.35.D02.1.454.CMB.1.raw
  modified_base (268)..(268): a, c, t, g, unknown or other
  misc_feature (268)..(268): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagtctcttttaagaggtgtccagtgtcagatgcagcgtggtggagtcgtgggggagtcggtggtccaggccgtgggggtccctggacgactctctgtgcncgcctcgtggtacttactaacttaactaaaattgtagggtatcgactacggtcggtcccgccgacggtcctaccggacggtacggaacggggtcgtacggggagggttcggggtcggaaccgtaaacgttataacgttacaaagtttagtaggtaaagtttaagggttaaaagttttaaacgaacgttagtacggaccgggtaaccgttaccgggtagggtaaccggggtaccgtaaccgtttaccaacccgttacgttaccccgtaaccgaaaggtaaccgtaaaacccgtaacgtttaaccccgaaacggtaacgtaccaacccgttaacctttaccgtttaagtttaccgaaacttaaaacgtacggtaaaaccgtaccggtaccggtacggggtaaccgtacgggtacgggtaaaccgggaacccggtaacccggtccgtttaacggttacccgtttaaacggtttacccggttacgggtaaccgggaaacccgggtaaaaacccgggtaccccccgggttaccccgtttaaacgggttaaccgggggtttacgggggggttaaccgggggttaacggttttaccggggg

SEQ ID NO: 232681 - DNA, 754 bp, Homo sapiens
  misc_feature: GYAE6OF01BX136.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtctgggggagtcgtggtccagcctggggggtccctggagactctcctgtgcagcctctggattcaacttacaaaaattatgggatgcactgggtccgccaggcctccgagggcgaagggggctagggacggtgggtaggactaacgttagtactcaattaatgaagtaggtaaagttttaaaagacttaagtcggacggtaccttacccgggtaggtaaacgggggcccgtaagtttccaacccgtattcccgtaccgaaggtaacgaactaaacgtttacccaaaggtacgacctaacctaacctactttaatttacgaactaaaagttagaaaccctacgggtacccgttaggggtaagcccgttacggaaacgggggtaacctaccggggtaccttacgggttaccgtttaaacgttttacccgtaggtttaccggggaaaccgggtaaaaaacccgggtaaacccccggggttacccccgttacgggtttaaaccggtttcggggggggttaaacccgggggtttggttttaaaccggg

SEQ ID NO: 232682 - DNA, 659 bp, Homo sapiens
  misc_feature: GYAE6OF01DRDFP.38.35.D02.1.454.CMB.1.raw
  modified_base (554)..(554): a, c, t, g, unknown or other
  misc_feature (554)..(554): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaacttgggttttcctcgtagcttcttttaagaggttgtccagtgtcagatgcagcgtggtggagtcgtgggggagtcgtggtccagccggtgggggtccctgacgacttctcctgtcgcagcctcgtggactttactaacttactaaaaaattgtggatgctacgtcggtccgccgcggcctaccgaggcgaagggctagggaggtgggtaggactaatagtatcattatggtagttaaggttaaaagttttaaagacttagtacggaccggtaacgtccggtaggaacgggtcccgtattaccgaacctatacccgtaccgaagaacgaaactaacttaccgaaagacgaccactacttacttatttcgaacgaaattcgaaactacggtaccgtagggacncggtacggaggacctacggtcttagtaccgttagttacgtggtacgaaccgtaaaccggacccggtacccgttacgtagggtacgggtcggggtagtttaacggg

SEQ ID NO: 232683 - DNA, 878 bp, Homo sapiens
  misc_feature: GYAE6OF01DSDKO.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaacttgggttttcctcgtagtcttcttttaagaggtgtccagtgtcagatgcagctggtggagtcggtgggggtagtcgtcggtccgaggtccggtcggggggtccctggtacgtccgtctccgtgtcgcacgtcctcgtggtacttacctaaacctttaactaaaaaagttaggtaggtatcggtaccgtacggttcggggtacccgaccgaccggtccgtacccggaacgggacgggaacgggggtcgtacggggtaacgggttcggggtacggaaccgttaaacgtaacgttaacgtacgtaaagttaaggtacggttaaggtttaaggttaaaaacggtttttaaaaacggtaacgttaacgtaccggggtaaccgggtaccggttaaccgggttaacggggaaccgggtaccccgttaacgttaacccggaacccgtaacgtttacccgaacccggtaaaggtaacggtaaccctaaaaccgtttacccgaaaacgggtaaccgtaaccctaaacccgttaaccgtttaccgtttaaacgttaacgaaaccctaaaaaggtaccgtaaacccgtacgggtaccggtaaggggaaccgtacgtacggggaaccgtaccgacggttacttaacggttacttacggttacgtaggttaaccggaaacggtaaaccccggtacccgtaccttagggtaagggttacggggtaggttacgttacggg

SEQ ID NO: 232684 - DNA, 710 bp, Homo sapiens
  misc_feature: GYAE6OF01CH54L.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccaggccgtgggggtccctgacgactctcctgtcgcagcctcgtggtacttccaacttacaaaaattgtggtatacgctacgtgggtcccgccgtacggcctccgagggaccgaaggggcgtgggtacggttggggtggacctaaacgttagtactacgaattagtaggtaagttaggttaaaagttttaaacgacttaagtcggaccggtaccgttccgggtaggtaacggggtccgtaacttccgaacctacgtacctaccgaagtaacgtaactaacgttaccgaaagtacgacctaactaccttacgttaactttacgaacttaaagtacgtaaacgacggtccgtagggacgtacgtacggaacggaccgtacggtcttacgttaccgttagttaccgttaggtacgaaccggtaaaccggtaccccggtacccttacgggtacggttacgggggttacggggttacgtttacggg

SEQ ID NO: 232685 - DNA, 623 bp, Homo sapiens
  misc_feature: GYAE6OF01BQ2F7.38.35.D02.1.454.CMB.1.raw
  modified_base (329)..(329): a, c, t, g, unknown or other
  misc_feature (329)..(329): n is a, c, g, or t
  modified_base (367)..(367): a, c, t, g, unknown or other
  misc_feature (367)..(367): n is a, c, g, or t
  modified_base (385)..(385): a, c, t, g, unknown or other
  misc_feature (385)..(385): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcggtggtccagccggtggggggtccctggacgactctccgtgtcgctacgcctcgtggtacttactaaacttactaaaaattagtagggatgctacgtcgggtccnccgacggctccgaggcgaaggggctagggacggtgggngactaactatatcatagngtagtaggtaaatttaagatatgacgtactcgagacgggtcagttcaccgtactctaccgagtaacgactaagtaccaagtacgacaactaccttacttaattacgaactaatacgaacgtacggtccggtaggacgtacgtaggaacgacgtacggtctacgttactagtttacgcggttacgaccgtaaaccggacccgtacctacgtacgggtcggggttacgggtggtttacgg

SEQ ID NO: 232686 - DNA, 832 bp, Homo sapiens
  misc_feature: GYAE6OF01C1IIA.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagttggctgaacgttggttttcctcgtagtcttacttttaagaggtgtccagtgtcagtagtgcgagcgtgggtggagtcggtgggggagttcggtcggtccgacggtccgggtcggggggtccctaggacgtaccttccgtccgtggtcgaccgacgtcccttcgtacggtaactttacctaaaacctttaaacgtaaaaaagtttgtacggggaattcggtaccgtaaccgggttccgggtacccgccggtaacggtacccgtaccgggagggtaccgggaacggggttcggttaaggggtagggttcgggggtaacggtacctaaacgttaagttacgttacgaagttacgtaggtaagttaaggtttaaaatttaaacgacgttagtccgggacggttaaccggttacggacggtaacgggcctaacgtacctaccgtacgtaccgtacgaaacgacgtaacctaacgttaccgaagacgaaccacgttactttaccgttaagtttacaaacgttaacgtaaccgaaaccgacggtacccggtaggacgtacggtaggaaccgggtaccgtacggtccgttacgttaacgtaccgttaaggttacggaaccggtaacggtaaaacccggtccccggttaccgttaacgggtacggggtttaccggggtacgggttaaggtttaccggg

SEQ ID NO: 232687 - DNA, 739 bp, Homo sapiens
  misc_feature: GYAE6OF01AQZHH.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtggggagtcgtggtccgagccgtggggggtccctgagtacctctccgtgtgccacgcctcgtggtacttcaactttacaaaaaattgtagggatgcacgttcgggcccgccaggcctccgaggtcgaagggtctgggaggtgggtcggactaactagtatcctaagtacgtagtagttagggtaaaacgttttaaagaccgttaagttcggtaccgggtaccgttaacggtagggtaaacggggtaccgtaacgtttaaccgaacccgtacgtttacccgtacccgtaaaggaaccggtaaactaaaccgtttaccccgaaaggaccggtaccaaaccgtaacctttacgtttaatttacgaaactaaacgttaaccgtaaacaccgggtaccgttagggaaccggtcgtaacgggaaccggtaacgtaccgggcttacggtttaccgttagtttaccgttaggtacgtaacggaaacccgtaccggtacccttagtacgggttaggggtagggttacgttacgg

SEQ ID NO: 232688 - DNA, 679 bp, Homo sapiens
  misc_feature: GYAE6OF01EGJW8.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagcttacttttaagaggtgtccagtgtcagatgcagctgggtggagtcgtgggggtagtcgtggtccaggccggtggggggtccctggagactctcctgtgcagcctctggattcaacttaacaaaaattgtagggatgcacgtcgggtccgccgaggcctccgaggcgaaggggtcgtgggtacggtggggtacgacctaaacgtataatacaatagtagtaagttagggtaaaacgtttttaaagaacttagtacggtaccggtaaccgttccgggtaaggaacgggtaccgtacttacccgaacctacttcctaccgaggtaacgaactaacttaccgaaagacgacctaactaccttactttactttacgaactaaagtacgaaccgtacggaccggtaggacgcgtacggaacggtaccgacgtccgttgttacttacgttacgtggtacggacgaaacggaccccgtccgtacgtaggtcggggttcggtagttaccccccccgg

SEQ ID NO: 232689 - DNA, 731 bp, Homo sapiens
  misc_feature: GYAE6OF01EPSH7.38.35.D02.1.454.CMB.1.raw
  modified_base (318)..(318): a, c, t, g, unknown or other
  misc_feature (318)..(318): n is a, c, g, or t
  modified_base (348)..(348): a, c, t, g, unknown or other
  misc_feature (348)..(348): n is a, c, g, or t
  modified_base (367)..(367): a, c, t, g, unknown or other
  misc_feature (367)..(367): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctgggtggagtcgtgggggagtcggtggtccgaggccgtggggggtccctgagactctcctgtgcagcctcgtggacttacaacttacaaaaattgtgggatgcacgtcgggtccnccgaggcctccgaggcgaaggggcgtgggnggtgggtgacaacgtatancatagtgagtaggtaaagtttaaagactagtcggacggtaccgtaccggtagggtaacggggccgtaacgttacccgacctaacgttccgtacccgaaaggaacgtaactaaacgttaccgaaacggacacccgtaacctaccttaacgtttaactttacgtaaacctaaagttaacggaaaccgaacggtaaccgggtacggggaacgtaccgttaaggggaaccgtaaccggaaccgggttcgttaccggttaacgtttaacgttaccgtaggttaacggaacccggtaaaaccgggtacccccggtaacccttaccgggttaacggggtcgggggtttaacgggggtaacgtttaacgggg

SEQ ID NO: 232690 - DNA, 734 bp, Homo sapiens
  misc_feature: GYAE6OF01AZRIU.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagcgtggtggagtcgtgggggagtcgtggtccagccgtgggggtccctgagctctcctgtgcagcctgtggattcaacgttacaaaaagttgtagggtatggcctacgttcgggtccgcccgtacggcctccggaggccgaaggggctgggaggtgggagacaacgtatacgtccgaagttacgtaggaacgttaggtaaagttttaaaggaaccttagtaccggacggtacgtaccggttaggaacgggtccggtaattccgaacctacgtcctaccgagaacgtaacctaacttaccgaaggacgaccctaagtaccttcgttaatttcgaactaaacgtacgaaaccgtacgtacccgtagggtaaccgaccgtaggtaaacgggtcccgtaaacgggtccgttaaccgttacggttaacgttaaccggttacgggtaccgggtaaaccgggaaaacccggtacccggttaccccggttacccgttaagggtttaccggggggttacccgggggtaattttaaaccggggg

SEQ ID NO: 232691 - DNA, 656 bp, Homo sapiens
  misc_feature: GYAE6OF01C66FZ.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaacttgggttttcctcgtagcttcttttaagaggtgtccagtgtcagatgcagctgggtggagtcggtgggggagtcggtggtccaggtcccgtgggggtccctggagtcctctcgtgtgcacgcctcgtggtactttacaaacgtttaacaaaaaattgtagggatggactacggtcgggtcccgaccgagggcctcccgaggaccggaaggggcctggggaggtggggtcgacctaactatatcaatagtagtagtaggttaaagtttaaagactagtacgacggtacgtcggtagtacggaccgtactaccaacctatcctacgaagagaaacctattacccgaagtaacgaccactaccttcttaacttagaactaagtactaaacgcgtacggtaggactacgtagaacggaccgacggcttgtacgttaacgttcgtaggtacgaaacggtaaaccgcccggtacccgttagtacgggtacggggtgggttgttacggg

SEQ ID NO: 232692 - DNA, 844 bp, Homo sapiens
  misc_feature: GYAE6OF01DFCT8.38.35.D02.1.454.CMB.1.raw
  modified_base (794)..(794): a, c, t, g, unknown or other
  misc_feature (794)..(794): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttggctgaacttgggttttcctcgtagcttctttaagaggtgtccagtgtcagatgcagctggtggagtcgtggggagtcgtggtccacgcccgttcggggggtcccctaggacggtaccttccgttcccgtggtacgccgacgtccgtccgtaggtacttacctaaactttaacaaaaaaagtttgtaggggtaactcgtacctacggttccggggtacccgccggaacgggtcccttacccggacgggaccggaaacgggggtccgtaggggtaacgggttcgggggttacggaccgtaaaacttaagtaacttccgtaaagttaagttacggtaaagtttaagggtttaaaaaagtttttaaacgaacgttaacgttacgggtacccggtaaaccgttcccgggtaaacgggtaaaccgggggtcccttaaacgtttccccgaaaaccgttacgtttacccgtaaccccggaaaggtaaaccgtaaaccgttaaaccgtttaaacccggaaaacggtaaccggtaaccctaaaccgttaaccctttacggtttaaacttttacggaaactaaaacgttacgaaaaccgtcggtaccggttagggacacggttacggacgtaaccgacggtcctagttacgtagttacnggtacgaaacggtaacgaaccgtctaggtaggttcggggtggcgttacgg

SEQ ID NO: 232693 - DNA, 802 bp, Homo sapiens
  misc_feature: GYAE6OF01D6Z34.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttggctgaacttgggttttcctcgtagcttacttttaagaggtgtccagtgtcagatgcagctggtggagtcgtgggggagtcgtggtccagccgtgggggtccctgagactctcctgtgcagcctctggtacttacaacttaacaaaaattgtagggatcgctacgtcgggtcccgaccgaggcctaccgagggacggaaggggtcgtagggaggtgggtacggactaaactagtatacgtaatagtaggtaagttaggttaaaagttttaaacgacttagtcggtaccggtaaccgttccggtaagggaaccggggtacccgtaactttacccgaaccctacgttaccctaaccgaacggtaaacgtaaacctaaaccgttacccgaaaggtaccgaacctaaccgttaacctttacgtttaactttacgaactaaaacgttacggaaacctcgggtacccggttagggaccgtaaccggtacgggaaacgggaacccgtacgggtaccgtttacggttaacccgtttaaacgtttaaccggttacggtaaccgggtaaaacccgggtaaaacccggggaaaccccccggtttccccggtttaaacggttaaccgggggtttacgggggttaaccgggggttaagttttaaccgggg

SEQ ID NO: 232694 - DNA, 789 bp, Homo sapiens
  misc_feature: GYAE6OF01BF62Z.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgacacagaggactcaccatggagtttgggctgaacgttgggttttcctcgtagtcttacgttttaagaggttcgtccgtaggtgtacagtagtgcgaggtcgtgggtggaggtcggtggggtagttcggtcggtccgacggtccggtcggggggtccctggacgtaccgtccgtccgtgtcgtcacgtccgttacgtaggtaacttaccgtaaaacttaactaaaaagttaggtagggtacgtcggtaccgtacggttccgggacccgccggacggtccgtaccggagggtacgggtaacggggtcgtaggggacgggttagggtacggtaactaaacgtattaagtactaagttaagtacgtaaacggtttaaggttaaagttttaaagacttaagggtacgtaccgtaacggtacggtacgggtaaccgggtaccgtaacttaccaaccggtacttaccgtaacgaacgtaacgtaactaaccgtacgaacggacaccgtaaactacttaactttagttaagaacgtaacgtaacgtaacgacggtacgtacgggacgaccggtaggaacgtaacgtacggttctacggttactacggttagttacggaaacggaaccgtaaccggaccccgttacgtacggttaagggtcgggtaagggtcgttacgg

SEQ ID NO: 232695 - DNA, 628 bp, Homo sapiens
  misc_feature: GYAE6OF01BBIYX.38.35.D02.1.454.CMB.1.raw
  modified_base (314)..(314): a, c, t, g, unknown or other
  misc_feature (314)..(314): n is a, c, g, or t
  modified_base (326)..(326): a, c, t, g, unknown or other
  misc_feature (326)..(326): n is a, c, g, or t
  modified_base (346)..(346): a, c, t, g, unknown or other
  misc_feature (346)..(346): n is a, c, g, or t
  modified_base (365)..(365): a, c, t, g, unknown or other
  misc_feature (365)..(365): n is a, c, g, or t
  modified_base (468)..(468): a, c, t, g, unknown or other
  misc_feature (468)..(468): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaacttgggttttcctcgtagcttcttttaagaggtgtccagtgtcagatgcagctggtggagtcgtgggggagtcggtggtccaggccgtgggggtccctggagctctcctgtgcagcctgtgacttacaacttacaaaaattgtaggatgctacgtcggccncgaggcctacgnggcgagggctgggaggtggngactaactatatacatagngtagttaacggtaaagttttaaagacgttagtacggacggtacgtcggtaggacgggtcgtacttaccgaactactcctacaagaactactaactacaagacnccaactactacttattacgaactaaagtacgaaccgtacgtacgtacggagtacgaggaacggacgacggtcgtacgttacttaagttacgtaggtacggaacccgtaaaccgggtcccgttcccttagggtacgggttcggggtacggttagttacggg

SEQ ID NO: 232696 - DNA, 631 bp, Homo sapiens
  misc_feature: GYAE6OF01A2IY6.38.35.D02.1.454.CMB.1.raw
  modified_base (318)..(318): a, c, t, g, unknown or other
  misc_feature (318)..(318): n is a, c, g, or t
  modified_base (513)..(513): a, c, t, g, unknown or other
  misc_feature (513)..(513): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaacttgggttttcctcgtagctcttttaagaggtgtccagtgtcagatgcagctggtggagtcgtgggggagtcgtggtccagccgtggggggtccctggagactctcctgtcgcacgtcctcgtggacttcaacttacaaaaattgtgggatgctacgtggtaccnccgaggcctcgaggcgaaggggtctgggaggtgggtcggacaacgtattatctaatagtagagttagggtaaacgttttaaagacttagtcggtaccggtacctacggtaggaacgggccgtacttaccgaacctatacctcgaacgacaactaactaccaagacacactacttactattacactaatacgaacncgtccggtaggactacgaggaacgtacacggtccttagtactacgttacgtaggtacggaacggtaaaccggaccccgtccgttacgttacgggtcggggttacggggtagttacggg

SEQ ID NO: 232697 - DNA, 614 bp, Homo sapiens
  misc_feature: GYAE6OF01B0ILG.38.35.D02.1.454.CMB.1.raw
  modified_base (491)..(491): a, c, t, g, unknown or other
  misc_feature (491)..(491): n is a, c, g, or t
  modified_base (504)..(504): a, c, t, g, unknown or other
  misc_feature (504)..(504): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccaggcccgtggggggtccctgagactctcctgtgcagcctctggattccaacttacaaaaattgtgggatgcacgtgggtccgccaggcctccgaggcgaaggggctgggagtgggtgcaactatatcatagtgagtaggtaaagtttaagactagtgtcggtacctcggtaggaacgggtcctagttccaacctatcctaccaagacgaactaacttacccaagacgacaactaccttcttattcgactaaagtcgaacngaccgtagggacncgtaggacggtaccgacggtctacggtacttacgttacgtaggtacgaaccggtaaacggtaccccggtccccgttagtaacgggtcggggttacggggtaatttacggg

SEQ ID NO: 232698 - DNA, 667 bp, Homo sapiens
  misc_feature: GYAE6OF01DDUGG.38.35.D02.1.454.CMB.1.raw
  modified_base (381)..(381): a, c, t, g, unknown or other
  misc_feature (381)..(381): n is a, c, g, or t
  modified_base (571)..(571): a, c, t, g, unknown or other
  misc_feature (571)..(571): n is a, c, g, or t
  modified_base (600)..(600): a, c, t, g, unknown or other
  misc_feature (600)..(600): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagagactcaccatggagtttggctgaacttggtttcctcgtagcttctttaagagtgtcagtgtcagatgcagctggtggagtcgtgggggagtcgtggtccaggcccgtggggggtccctgacgtactcgtccgtgtcgcacgcctcgtggtactttacctaactttaactaaaaaatttggtagggatcggacctacggttccggtacccgtccgtacggtcctacccgaggggacggaacggggtcgttagggngggtgggtacgggaacctaagtatatctaatagtagtaagttaaggttaaagttttaaagcgtaagttcggacggtaccgttccgggaacggtacgggtaccgtagttacccaaccgttactaccgtacgaagaacgtaactactaaccgaagacgacaccgtacttacgttattgaactaatacgaacncggtacgaggatacgtagacgtacgcgtnttcgtagttacttgtaggcgaaaccgaacgacccgttccctagtagggtcgggtcggttattacggg

SEQ ID NO: 232699 - DNA, 929 bp, Homo sapiens
  misc_feature: GYAE6OF01DDXS7.38.35.D02.1.454.CMB.1.raw
  modified_base (272)..(272): a, c, t, g, unknown or other
  misc_feature (272)..(272): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaacttgggttttcctcgtagcttcttttaaggaggtgtccaggtgtcagatggcagcgtggtggagtcggtggggagtcggtgtccgaggtccggtgggggtccctgacgacctctctgtncacgtccctgtggtactttaccgtaaaccttaactaaaaatttggtacgggtaattcggaccgtaaccggttccgggggtacccccgtccggtaacgggtcccgttacccggaaggggacccggtaaagggggtcccgttagggggtacgggttacgggggtacggaaccgttaaaacttacggttaacttaaccgtaagttaagttaggtaaaggttttaaaggggtttaaaaaaggtttttaaaacgtaccggtttaagttaccgggtaccgggttaaacccgtttaccgggtaaacggggtaacgggggtaaccccttaacgttacccaaacccggttacgttaaccccggtaaccccgtaaggtaaacggtaaaccttaaaccgtttacccgaaaggtaacccgtaccctaaccgttaaccttttaacttacgttttaaccggaaacttaaacgttaaggaaacccgtacgggttacccggtaagggaccgttaccggtacggaaccgggaaccccgttacggaccgtttacggttaacctttacgttttaaccgggcgttaaagggaaacccccgggtaaaaacggcccccggttaccccgttaaccggttagggggttttaaccggggggtccggtttaacggttaccggg

SEQ ID NO: 232700 - DNA, 560 bp, Homo sapiens
  misc_feature: GYAE6OF01A2Y26.38.35.D02.1.454.CMB.1.raw
  modified_base (360)..(360): a, c, t, g, unknown or other
  misc_feature (360)..(360): n is a, c, g, or t
  modified_base (370)..(370): a, c, t, g, unknown or other
  misc_feature (370)..(370): n is a, c, g, or t
  modified_base (463)..(463): a, c, t, g, unknown or other
  misc_feature (463)..(463): n is a, c, g, or t
  modified_base (549)..(549): a, c, t, g, unknown or other
  misc_feature (549)..(549): n is a, c, g, or t
tcagtcgatcacgtcacgaccggtgctcgatttagcacacgatagttgggtttgggggggaagaggaagactgacggtcctgccacaggtggtgctgggcacggtgggcactcgacacaacatttgcgctcaactgtcttgtccagcctggggggtccctgagactctcctgtgcagcctctggattcaacttcaaaaattatgggatgcactgggtccgccaggctccaggcaaggggctggagtgggtggcaactatatcatatgatggaagttttaaagactatgcggactccgtgaagggccgattcaccatctccagagacaattccaagagcacactctatttgcaaatgaacngcctgggganctggagacacggctgtctattactgtgacgaaacgaccggcctactagtgggtcggggtattagtgtcgtgggccgagggaaccctggacccnccgtcctcctcgcgccctccgacccgacggcccacgtccggtccttcccccgtggcccgtccctcgtcccgtacgacggaccgccncccgtcgacgg

SEQ ID NO: 232701 - DNA, 819 bp, Homo sapiens
  misc_feature: GYAE6OF01CM3XA.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccagtggtagtttgggctgaacttgggttttcctcgtagtcttcttttaaggaggttcgtccagtgtcagatgcagcgtgggtggagtcggtgggggagtcggtggtccgaggtccggtcggggggtccctggacgtaccgtccgttccgtggtcgccgtacggtcccttcgtaggtactttaccgtaaacttaactaaaaagttggtagggtaatggaccgtacggtcgggtacccgccgacggtcctaccggagggacggaacggggcgttaggggaggttcggggtacgaacctaagttactaacgtactaagttaagtaggtaaggtttaaagggttaaaacgttttaaaaggaccgtttaaaggttccgggtaaccggtaaccggttaccgggtaagggaaccgggtaccgttaacttaccaacccgtacgttacccgtaccgaaggtaacgtaacgttaaacgttaaccgaaaggtaccgtaccaaaccttacttaacgtttaattaccgaacttaaacgacgaactacgggtcgtacgggagtaccggtacgggaacggtaaccgtacgggtccgtttacgttaaccgttaggttaccgtagggtacccgaaaccggtaaacccggtacccgtcccggttaaggtccggggttacggggttacggttacgtttacggg

SEQ ID NO: 232702 - DNA, 657 bp, Homo sapiens
  misc_feature: GYAE6OF01DUFVK.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgacacagaggactcaccatggagtttgggctgaactgggttttcctcgtagctcttttaagaggtgtccagtgtcagatgcagctggtggagtcgtgggggagtcgtggtccagccgtgggggtccctgagctctctgtgcagcctctggtattacctaacttacaaaaattgtagggattggcaacgtcggggtcccgccgaggcctaccgaggccgaaggggtctgggaggtggggtacggactaaactagtactacgatagtgtaagtaggttaaagttttaacgatagtggacggtaccgttcggtaaggacgggtccgtaacttccgaacctacttcctacgagaacgtaactacttaccgaagtacgaccacttacctacttatttacgactaaaacgtcgaaacgacgtaccggtagggacgtcgtagggaacggaaccgtacgggtctggttacttaacgttacgtaggttacggaacggtaaacggaaccccggttccttaacggtaggttcggggtagggtagttacgg

SEQ ID NO: 232703 - DNA, 836 bp, Homo sapiens
  misc_feature: GYAE6OF01A9DYG.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggtgtttgggctgaacttgggttttcctcgtagcttcttttaagaggtgtccagtgtcagatgcagctggtggagtcgtgggggatcggtggtccagccgtggggggtccctgagacctctccgtgtcgcagcctcgtggacttacaactttaacaaaaagtttagtggggtatcggcgtaccggtcggggtacccgccgaggtccctaccgaggggaccggaagggggtcgtaggggtagggtggggtacgacgtaaacttattaacgtctaagttagtaggtaagtttaagggttaaaagtttttaaaacgaatttaaggtccggtaccgggtaacccgtttaccgggtaacggggaaccggggtcccgttaacgttaccccaaccgtaaccgtttcccgtaacccgaaaggtaaccgtaaaaccctaaccgttaacccgaaaaggtaccgaacccaacccgttaacttaccttttaacgtttacggaaaccttaaaacgtaccgtaaaacggtacccgggttacccgggtaggggaacgttaccggtacggaacggggtaccctaccggggttactcggttttaaccgtaacggttttaacgtcggtaaaccgggtaacccgaaaacccggggtaccccggttaccccgttacggtttaaggggtccggggggttacgggtttaaggtttaccgg

SEQ ID NO: 232704 - DNA, 896 bp, Homo sapiens
  misc_feature: GYAE6OF01D1PL5.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaacgttgggttttcctcgtagtcttcttttaagaggtgtccagtgtcagatgcagcgtggtggagtcgtgggggagtcgtcggtccgaggccggtcgggggtccctgacgtacctctccgtgtcgctacgtcctcgtaggtacttaccgtaaacttaactaaaaacgttgtacggtatcgactacggtcgggtacccgcgacggcctaccggagggacggtaaggggtccgttaggggaggttcggggtaggtaaccctaaactttaacgtaacgttaccgtaaagtttaggtaacggtaaggtttaaagggtttaaaacggttttaaaacggtaccgttaaagggttcgggtaacccgggtaaccggtttacccggggttaacgggaaccgggggttaccccttaacggtttaacccgaacccttaacgttacccgtaacccgtaaggtaaaccgtaaacgttaaacccgtttacggaaaacgtaccggaacctaaccgttacccgtttaactttaagttaccgtaaaaccgtaagtaaccggtaaaccgtaccgggtaccggttaacgggaccggttaacggtacgggaaaccgggtacgtacccggttacgttaccggttaaccgtttaacggttacccgtacgggttaacccggtaaaaccggtaaaccccgggttaacccccgttaccggttaacgggttaccggggtttacgggggtaccggttaaggtttacccgggg

SEQ ID NO: 232705 - DNA, 854 bp, Homo sapiens
  misc_feature: GYAE6OF01ED5UP.38.35.D02.1.454.CMB.1.raw
  modified_base (162)..(162): a, c, t, g, unknown or other
  misc_feature (162)..(162): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttggctgactggttttccncgtagctcttttaagaggtgtccagtgtcagatgcagtcgtggtggagtcgtgggggagtcgtcggtccaggtccggtcgggggtccctggagtacctctccgtgtcgcacgcctgtcgtaactttccgtaaactttaacgtaaaaatttacgtagggtacttcggacctacggttcggggtcccgaccgtacgggtccctaccggacgggacggtaaacggggtccgttaggggtaagggttcggggtaacggtaccgttaaacgtaacgtttaacgtaccgtaagtttaacggttagttaaaggtttaacgggtttaaaagtttttaaacgtaaaccggttacgttacgggtacccgggtaaaccgtttccgggtaacgggaaaccggggttcccttaacggttaccctaaccctaccgttaccgtacccgtaaagggaaccgtaaaccgttaaacgtaacccgaagtaaccgtaccgtaaacccttacgtttaccgttaacgtttacgaactaaaaccgttacgaaacccgtacgggtaccggttaagggtcgtacggtacgggtaacggtaccgccggtttaaccgtcgtttaacccgtttaagttaccgttaggttaccggaaaccgttaaacccggacccggtcccgttaagttaccgggtacgggggtaccgtttagggttacgg

SEQ ID NO: 232706 - DNA, 765 bp, Homo sapiens
  misc_feature: GYAE6OF01B5TB8.38.35.D02.1.454.CMB.1.raw
  modified_base (280)..(280): a, c, t, g, unknown or other
  misc_feature (280)..(280): n is a, c, g, or t
tcagtcgatcacgtcacgaccggtgctcgatttagcacacgatagttgggtttgggagctctgggagaggagcccagcactagaagtcggcgagttccattcggtgatcagcactgaacacagaggactccacaatggagtttggctgaactggttttcctcgtagctcttttaagagtgtccagtgtcagtatcgcagtctggtgagtcgtagggggatcgtggccaggtcccgtggggggtccctagacgtactccgtccgtgtcgcgtagtcccgtntaggacttacgtaaccttacgtaaaaaattgtacgggaattgactacgttcgggacccgaccgacggtcgtacccggaaggcgtaaacggggctaggaggttcggtacgactaaccgtataacgtacaagttagtagtaataggttaaagttttaaacggaacttagtaacggtaccggttaacgtaccggttacggaacggggtccctaacgtttaccgaaccgactttacccggaccgtacggtaaacgaccccgttaaaattacccgaaaggtaaccgtacctaaccgttaaccgttactttaaacgtttcgaaaccttaaaacgttaagaaacccgtaaccgggttacgaaacccgggttaggtaacccggtaggaaaccggacccgtaagggtccttaccgttacgttaactacgtacggttaaccgaccgttaaaaccgacccggtaccacgttagacggggttcgggtagtttaccgg

SEQ ID NO: 232707 - DNA, 704 bp, Homo sapiens
  misc_feature: GYAE6OF01C2YJG.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccagccgtgggggtccctgagactctcgtgtgcagcctcgtggtattctaacttacaaaaatttagtaggggactcgaccaacgttccggggtacccgccgacggtcctacccgagggaccgaagggggccgtgggaggtggggtcggaccaacgttatactcaattagtgaagttaggtaaagtttaaagactagtggacggtacgtcggtaggaacgggccgtacttccaacctataccgtaccctaaggaacgtaacctaacgtacccaaaggacgtaccgaacctaacctttcgttaacgttttacgaacgtaaaatacggaaacgtaccggtaccggtagggaccgtacggtaggaacggaaccgtacggtcgttagtaccgttaaagttacggtggtaaccggaacggaaaaccggtaccccggtacccgttacgttaacgggtcgggggtacgggttaggtttacggg

SEQ ID NO: 232708 - DNA, 729 bp, Homo sapiens
  misc_feature: GYAE6OF01AWMJJ.38.35.D02.1.454.CMB.1.raw
  modified_base (608)..(608): a, c, t, g, unknown or other
  misc_feature (608)..(608): n is a, c, g, or t
  modified_base (722)..(722): a, c, t, g, unknown or other
  misc_feature (722)..(722): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccagtgggtaggtttgggctgtaacgttgggttttcctcgtagtcttcttttaaggaggtgtccagttgtcagatgcaggcgtgggtggaggtcggtagggggagtcggtggtccgacggtccgggtcggggggtccctggaacgtacctccgttccgtggtacgccgtacgtccttcgtaggtacttactaaacttaactaaaaagttgtaggatgacctacggtcgggtcccgaccgtacggtcccgtccgagggacggaaggggtcgtagggagggtgggtacgacgtaacttagtactacgtatagtacgtaaggttaaggttaaagttttaaacgagttacgtcggtacggtaccggtacgtacgggtaacggtacctattacccaacgtacgtacctaacccgaagtaacgtaacctaaagtaccgaaacgtacgtaccaactacgtttacttattacgaactaaacncgaaacgtcgaccggtgacgcgtacggacgtcgtacgtcgtagttcgttagtagtacggcgtaaaccgtaacccggtacccgtcgttaggtaacgggtcgggttaacggggttntaccggg

SEQ ID NO: 232709 - DNA, 705 bp, Homo sapiens
  misc_feature: GYAE6OF01BVDNF.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaacttgggttttccctcgtagtctcttttaagaggtgtccagtgtcagatgcagcgtggtggagtcgtgggggagtcggtggtccaggtccgtggggggtccctggagacctctcctgtgcagcctgtggacttacgaaacttacaaaaattgaggtatgcacgtcgggtccgccgacggcctccgacggcgaaaggggcgtacgggaggtgggtacggactaacctaagtactcaagtatagattaggttaaagttttaaagacttagaggtacggtacgtaccggttaggaacgggtaccgtaacggttaccaaccgtacgttaccgtacccgaaaggtaacgtaacctaaaccgttaccgaaagtaaccgtaccgaaacctactttaccgtttaattaaccggttaacaaacgtttaaccgaacgaacgtccgtaggggactcggtaggaaccgtacgtacgacttcgttacttacggttaatcggtaaaccgacggtaaacccggacccgtcccgtaggttaaccgggtagggttacgggttagttacgg

SEQ ID NO: 232710 - DNA, 812 bp, Homo sapiens
  misc_feature: GYAE6OF01AQ3EK.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaacttgggttttcctcgtagcttacttttaaggaggttgtccagtgtcagatgcagtcgtggtggagtcggtgggggtagtcggtcggtccgacggtccggtcggggggtccctggacgtaccgttccgtccgtggtcgcgacgtccttcgtaggtacttacctaaacttaactaaaaagtttggtaggtatcgccgtacgttcggttaccggtcccgaccgacggtcccgtaccggagggtaccggaacggggtccggttagggacgggttggggtacgaacctaaccgttaatacgttactaagttagtaggtaagttaacggttaaagtttaaacgacgtagtacggaccggtaccgttacggtacgggtaacgggtcctaacgttaccgaacgttacctaccgtaccgaacggtaacgtaaacctaacgttaaccgaaagtaacccgacctaaccgttaccgttacttacgttaacaaccgttaaaacgacggtaaacgtaccggtaccgggtagggaacttcggaaggaccggaaccggtaccggttcgtttaacgttccgttaagttacggttggaaccgggtaaacccggtaaaccgggtaacccccgttccggttaagggtacgggggttaccggggttacggggtttaacgg

SEQ ID NO: 232711 - DNA, 697 bp, Homo sapiens
  misc_feature: GYAE6OF01BYQPT.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagcgtggtggagttcgtgggggagtcggtggtccaggccgtggggggtccctggagactctcctgtgcagcctcgtggattacaacttacaaaaattgtgggatgcctacgtcgggtccgccgacggcctccgagggcgaagggggctgggaggtggggtacgacgtaacgtatactctaatagtagtagtagggttaaaacgttttaaacgagttacgtcggaccgggtaccgttaccgggtagggaaccggggtccgtaactttacccgaacctacgttccctaccaacggaacgaaactaacgttaccaaaggcgaccaactacctactttattacgaactaaatacggaaccacgggtccgtagggaacgtcgtacgggaacggtaccggtacggtcgttacggttccgttaacgttacgtaggtacgaaaccggaaaccggtaaccccggtcccttacggtaacgggtttggggtaccggggttgttacggg

SEQ ID NO: 232712 - DNA, 817 bp, Homo sapiens
  misc_feature: GYAE6OF01DJAEJ.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaacttgggttttcctcgtagcttctttaagaggtgtccagtgtcagatgcagctggtggagtcgtgggggagtcgtggtccaggcccggtgggggtccctggacgtcctcgtcctgtgcacgtcctcgtaggtactttacctaaacttaactaaaaattagtgggaatcggacaccggttcgggtcccgccgtacggcctaccgacgggacggaacggggtctaggggaggtacggggtacggactaaaccgttagtatacgtaattaagtaggtaagtttaagggttaaaacgttttaaaagacttaggttacggccgggttaaccttccggtaagggaaccgggtccgtaacgtttccccaaccgtagttaccccgtaaccgtaacgaaccgtaaacccttaaacgtttaaccccgaaaggtaaccggtaccctaaaccgtaaccgtttaccgttaaacgtttttacggaaacttaaaaccgtacgaaaacccggtaacgtacccggtaggggtacgacgtacggggacggtaaacccgtccgggttaactcgggtttaaccttaaacgtttaccgtacggttaaccgggaaaccgaaaacccgggtacccgttaccccgttacggtttaacgggtacggggttacggggttaagtttacgggg

SEQ ID NO: 232713 - DNA, 272 bp, Homo sapiens
  misc_feature: GYAE6OF01EFW8H.38.35.D02.1.454.CMB.1.raw
  modified_base (157)..(157): a, c, t, g, unknown or other
  misc_feature (157)..(157): n is a, c, g, or t
  modified_base (240)..(272): a, c, t, g, unknown or other
  misc_feature (240)..(272): n is a, c, g, or t
tcagtcgatcacgtcacgaccggtgctcgatttagcacacgatagttggggtttggggggagttatgtctggggccagggaaccctggcccaccgtctcctcagcctccaccaagggcccatccggtcttccccctggccgccctgctccagggacncacctccgagagcacagcggccctgggctgcctggtcaaggctactccagtgatcgactgagcgggctggcaaggcacatagnnnnnnnnnnnnnnnnnnnnnnnnnnnnnnnnn

SEQ ID NO: 232714 - DNA, 756 bp, Homo sapiens
  misc_feature: GYAE6OF01CAOW8.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaacttgggttttcctcgtagcttcttttaagaggtgtccagtgtcagatgcagctggtggagtcgtggggggagttcggtggtccaggccgttggggggtccctggagactctccgtgtgcagtcctctggtacttactaactttacaaaaatttagtagggtatggctacgtcgggtcccgccgacggcctccgaggacgaaggggctagggaggtggggtcgacgtaacgttatacgtacaagttataggtaagttaagggttaaagttttaaaacgaccgtttaagtcgggtaaccggtaaccgtttaccgggtaagggtaaccgggggtacccgtaagtttaaccccaccgtaaccgttcccgttaacccgaaacggtaaacggtaacctaaaacgtttaccccaaaggtaccgaacccgtaacctaacctttactttaactttagaaccttaaatacggaaaccgtacgtaccggtaggtacgacgttaggaggacccgtacggtcgtacgttacttacgttacgtaggtacggaaccgtaaaccgggaacccggtcccgttacggttaagggtcgggggttacgggtaggtttaaccgg

SEQ ID NO: 232715 - DNA, 715 bp, Homo sapiens
  misc_feature: GYAE6OF01DVKTM.38.35.D02.1.454.CMB.1.raw
  modified_base (203)..(203): a, c, t, g, unknown or other
  misc_feature (203)..(203): n is a, c, g, or t
  modified_base (623)..(623): a, c, t, g, unknown or other
  misc_feature (623)..(623): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagagactcaccatggagttgggctagtaacgttgggttttcctcgtagcttacgttttaagaggttgtccagtgtcagntgcagcgtggtggacgtcggtagggggtagtcggtcggtccgacggtccggttcggggggtccctaggacgtacctccgttccgtggtcgctacgtcctgtaggtactttaacctaaaccttaaacgtaaaaaacgttagtagggtaactcgtacgtaaccggttccggggtccgacccggtacgggtccctaccggacgggacggtaacggggtcgtaggggaggttgggtacgactaacgtatcgtactagttacgtgaacgttaaggttaaaagtttaacgcgtagtcggaacggtacgttcggtaaggtacggtctaacttccgaactctacccgtatacgaacgtactaacctacgaagacgacctaccgtacttagttacttacgactaaagtacgtaaacgcgtaggtacggngtacgacgacggacgtgtctagttacgtaacgttagtacggacgtaaccgaccgtaccgttacctacgtgggtaacgggtgggtagttacgg

SEQ ID NO: 232716 - DNA, 720 bp, Homo sapiens
  misc_feature: GYAE6OF01CN3LV.38.35.D02.1.454.CMB.1.raw
  modified_base (159)..(159): a, c, t, g, unknown or other
  misc_feature (159)..(159): n is a, c, g, or t
  modified_base (371)..(371): a, c, t, g, unknown or other
  misc_feature (371)..(371): n is a, c, g, or t
  modified_base (376)..(376): a, c, t, g, unknown or other
  misc_feature (376)..(376): n is a, c, g, or t
tcagtcgatcacgtcacgaccggtgctcgatttagcacacgatagttgggtttgggggggagaggagcccagcactagaagtcggcggagtttccattcggtgatcagcactgaacacagagactcaccatggagtttgggctgaacttgggttttccncgtagcttcttttaaggagtgtccagtgtcagatgcagcgtagggtggaggtcgtgggggagttcgtggtccaggcccgttggggggtccctgagtacctctccgtggtgccgacgcccttagtggacttaacgtaaccttaataaaaaagttgtaggaatgacctacgtcggtcgcaggcctcgaggcgaagggctggaggtgggtacganaactntagtctaatatacgtagttaaggtaaacgtttaaagcttaagtcgacggtaaccgtcggtagaacgggtaccctagtaccaaccctgttacccgacgaacggaacgtaacctaaacttaccggaaagtaacccgataaccctaacgtttacctaagtttacccgaaataaataccgaaacggcgttaaccggtagggaaccgttcgtaacgggcggtaaacacccgggtattacggttaaccttagtacgttacggtaccgaaaacggaaaccggcccggaaccttaaacggtcgtaaggtttccggggtaacggttagtagttacgggtccggtaaccggggg

SEQ ID NO: 232717 - DNA, 750 bp, Homo sapiens
  misc_feature: GYAE6OF01AWSIY.38.35.D02.1.454.CMB.1.raw
  modified_base (111)..(111): a, c, t, g, unknown or other
  misc_feature (111)..(111): n is a, c, g, or t
  modified_base (168)..(168): a, c, t, g, unknown or other
  misc_feature (168)..(168): n is a, c, g, or t
  modified_base (190)..(190): a, c, t, g, unknown or other
  misc_feature (190)..(190): n is a, c, g, or t
  modified_base (246)..(246): a, c, t, g, unknown or other
  misc_feature (246)..(246): n is a, c, g, or t
  modified_base (290)..(290): a, c, t, g, unknown or other
  misc_feature (290)..(290): n is a, c, g, or t
tcagtcgatcacgtcacgaccggtgctcgatttagcacacgatagttggggtttggggagctctgggagaggacgcccagcactagaagtcggcggagtttccattcggtnatcagcactgaacacagaggactcaccatggtagttgggctgaacttgggttttccngtagcttacttttaagaggttntccagtgtcaggtatgacagtcgtgggtggagtcgtgggggactcggtcggtccgngtccggttcggggggtccctaggacgtccttcgtccgttggacncgacggtcccttgtacggtacttactaaaccgtttaagaaaaacgtttcggtgggtaactacggccttaaccgggtcggggttacccaccgggaacggtccgtaccggaacggggacggtaacggggtcgtaggggtacggtggggtaacgacgtaactagtagtactaagttacgtagtaagttacgttaaagtttaacgacttagacggtacggtactacgggacggtacgtacgtactaccactctactcgaagtacgaactacgtacgaacgtaccgactacctaacttccgtttaataccgaataaccgtagtaaccgaccggtacggttacgggacttacgggacgaacggtaccgtccggtcttacggttacgtaccgttaggtacggaacggtaaccgaaacccggtcccggttaccgtacggtagggttacggggtcggtaaacgttcggg

SEQ ID NO: 232718 - DNA, 1081 bp, Homo sapiens
  misc_feature: GYAE6OF01AR1RN.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagttggctgaactgggttttcctcgtagcttcgttttaagaggtgtccagtgtcagatgcagcgtggtggagtcggtggggagtcggtcggtccgagtccggtcgggggtccctggacgtacctcctccgtggtcgcgtacgtccctcgttcggtaactttaccgtaaaacctttaaccgtaaaaaaagtttcgtacggggtaacttcggacccgttaaccggttccggggtaccccgtacccggacgggttacccgttacccggaacggggtaccggtaaagggggtcccgttaggggaacggggtttacgggggtaccggtaacccgttaaaaccgtttaaccgttaacgttaaccgtaaagtttaaggtaaccggttaaagggtttaaacgggtttaaaaaacggtttttaaaaacggaaccggtttaacggttaccggggtaaaccccggttaacccggtttacccggggttaacggggtaaacccggggttacccgttaaacctttaaccccgaaccccgtaacgtttaccccggtaaaccgtaaaacgggtaaccttaaaacccgttaaaccgtttaaccccgaaaggtaccccggtaacccttaaacccgttaaccgtttaaccgttttaacgttaaccggaaaaccttaaaacgtaaccgaaacccggtaccggttacccgggttaacggggtaaaccttaccgggtaaccgggtaacggttaaaccccggtaccgggtttaaccgtttaaaccgggtttacccgtttaaaccggttttaaccggggttaccgggttaaaaccccggggtaaacccggttaaaaacccccgggttacccccccgggtttacccggtttaaaaccgggggtttaacccggggtttaaccgggggggttaacccggggggttttaaacgtttaaaccccgggggg

SEQ ID NO: 232719 - DNA, 256 bp, Homo sapiens
  misc_feature: GYAE6OF01DVU76.38.35.D02.1.454.CMB.1.raw
  modified_base (222)..(222): a, c, t, g, unknown or other
  misc_feature (222)..(222): n is a, c, g, or t
  modified_base (256)..(256): a, c, t, g, unknown or other
  misc_feature (256)..(256): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtaggagtcgtgggggnggtcggtggtccgacgccggtcggggggttcccn

SEQ ID NO: 232720 - DNA, 753 bp, Homo sapiens
  misc_feature: GYAE6OF01DES1F.38.35.D02.1.454.CMB.1.raw
  modified_base (206)..(206): a, c, t, g, unknown or other
  misc_feature (206)..(206): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagagactcaccatggatttgggctgacttgggttttcctcgtagctcttttaagaggtgtccagtgtcagatgcagcgtggnggagtcgtaggggagtcgtggtccagccgtcggggcctgagctcgtcctgtgcacgtcctcgtggtacttacgtaaacttaacaaaaagttgtagggaatcgactaacggttcgggtaccccgccgaaggtccctaccggaggcggaaggggtccttagggagggtcgggtacggaacctaacgttatagtacaagtagtagtagttaaggttaaagtttaaagactagttacggaccggtacgttccggtaagggtacgggtaccgtaacttccgaacctagtaccgtacccgaagtaacgtaaactaccttaccgaaacgtacgtaaccgaccgtaacttaacgtttactttacggaaactaaaagttaccgaaaacgtacgggtaccggtagggaacctaccggttaaggaacgggttaacccgagggtccgtttacggtaccgtttaacgtttaccggtacggtaacgtaaccgggtaaaccggtaacccccgttaccgtacggttaacgggtttccggggtacggggttaagtttaaccggg

SEQ ID NO: 232721 - DNA, 788 bp, Homo sapiens
  misc_feature: GYAE6OF01CWBAP.38.35.D02.1.454.CMB.1.raw
  modified_base (307)..(307): a, c, t, g, unknown or other
  misc_feature (307)..(307): n is a, c, g, or t
tcagtcgatcacgtcacgaccggtgctcgatttagcacacgatagttgggtttggggagctctgggagaggagcccagcactagaacgtcggcggtagtttccatttcggtgatcagcactgaacacagacggactcaccatggagtttgggctgtaacttgggttttcctcgtagtcttacttttaaaggcggttgtacctaggttgtaccagagtgccgaagccgttgggtggtaacggtcggtgggggatccggtggtaccgagcccggtggggggtccctaggagtaccttcgtaccgttggngcgtacgtcccgtacgtggaactttacctaaacttaactaaaaagttactagggattgaccgtacgcggtaccgacgacgttccgaccgacggacggtaagggcgttagggacgggttagggtacgaacgaaacttgtaaacgtcgtaaagtatacgtaagttaaggtaaaccgtttaaagacgttagaggacgtacctggaacgacgggacgtacttacaacctattccaacgtagaacgtaacaaacttaccgaaacgacgaaccacctaacttccgtaatttaacgaactaaacgaaccggtaataaccgggacgttaacggacgttaaccggaagggaacggacccgtaaacgttccggtaaccgtaaacgttacgttacgttaacggtaaccggaaacccgttaaaacccgggtaaaccggttcccccgaaagggttttacggaaccgggggtttaggtaacggttttaaccgggg

SEQ ID NO: 232722 - DNA, 801 bp, Homo sapiens
  misc_feature: GYAE6OF01CFD3I.38.35.D02.1.454.CMB.1.raw
tcagtcgatcacgtcacgaccggtgctcgatttagcacacgatagttgggtttgggggggagaggagcccagcactagaagtcggcggagtttccattcggtgatcagcactgaacacagaggactcaccatgggagtttgggctgtaacttgggttttcctgtagcttacttttaaggaggtgtccagtgtcagatgcagtcgtgggtggagtcggtggggagtcgtggtccgaggccggtcgggggtccctgacgtacctctccgtggtcgacgacgtcctcgtaggtacttacctaaccttaaagtaaaaattaggtagggtatacgaccgtacggtcgggtcccggaccgacgcccgtacggacggacgggaacggggtcggtaggggtaacgggtcgggtacgacgtaaacgtatacgtactaagtagtagtaagttaaggttaaagtttaaacgatagtacggaccggtaacgtacgggtacggaacggtacctataccgactactcgtaccgaagtactaacctagtaccgaagactaccacgtacttattaacgttcaaagtaacgtacgaaccgtcggtaacccggtagggaaccgtacgtaacgggaaaccgtacgaccgggttcttacccggttacgttacgtttaaccggaggttaacggaaacccgggttaaaacccgggtaaccccccgtccggtttaaacgggtaacgggggtttccgggggttaacgggtttacgggtttaaccggtaccgggtttccggggggtaacgggtaaaccccccgggg

SEQ ID NO: 232723 - DNA, 832 bp, Homo sapiens
  misc_feature: GYAE6OF01BQ69W.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggtagtttgggctgtaacgttgggtttttcctcggtagtcttacttttaagaggttcgtcctagttgtcagatcgcagtcgtgggtggacgttcggtgggggagttcggtcggtccgacggtcccggttcgggggggttcccctggtacgtaccttccttccgtggtacgccgtacgtcccttcgttacggtactttaacctaaactttaaacgtaaaaatttgtacgggatcgaccgtacggtcgggtacccgccgacggcctaccggagggacggaaggggtcgtaggggtaggtggggtacgaactaacgttagttaactacgtaattagtagtaacggttaaggtttaaaagtttaacgtaactagtacgggtacggtacccggtaccggtagggtaaccggtacccgttaacttacccgtaaccgtacttacccgtaaacgaaagttaacgaaacccgttaacgtaaccgtaacgaacccgtacctaccgttaacttacgtttaacgttaacgaataaccggttaacaaccggtcggtaccgggagtccggtagacggtaacgtaccgtaccggttacttagttaccgtttaagtacccggacggtaaaccgtaaaccgggtaaacccgttccccggttaacggtttagggtacccgggttagggggttaaaccggtttgttaccgggg

SEQ ID NO: 232724 - DNA, 639 bp, Homo sapiens
  misc_feature: GYAE6OF01AXB2G.38.35.D02.1.454.CMB.1.raw
  modified_base (359)..(359): a, c, t, g, unknown or other
  misc_feature (359)..(359): n is a, c, g, or t
  modified_base (368)..(368): a, c, t, g, unknown or other
  misc_feature (368)..(368): n is a, c, g, or t
tcagtcgatcacgtcacgaccggtgctcgatttagcacacgatagttgggtttggggggaagaggaagactgacggtcctgccacaggtggtgctgggcacggtggcactcgacacaacatttgcgctcaactgtcttgtccagcctggggggtccctgagactctcctgtgcagcctctggattcaacttcaaaaattatgggatgcactgggtccgccaggctccaggcaaggggctggagtgggtggcaactatatcatatgatggaattttaaagactatgcggactccgtgaagggccgattcaccatctccagacgacaattccaagagcacactctatttgacaaatgaacngcctgggancgtagacggacacggtctgtacttattacgtgtcgacgaaacgacccggtccctcgtagtcggggtacgggtagtttagtcggtcgtcggggaccgacggggtaaccctcgggacccgtacccggttcctcccgttacgaccgtccccttacccgaacccggaaccgggtccccctaacgttcccgggttcccctttaccccccggtcgggcccccgtccccgttcggtcccctacccggacgggtaccgcccgtacccgtccggaaccgg

SEQ ID NO: 232725 - DNA, 852 bp, Homo sapiens
  misc_feature: GYAE6OF01DUJSU.38.35.D02.1.454.CMB.1.raw
  modified_base (199)..(199): a, c, t, g, unknown or other
  misc_feature (199)..(199): n is a, c, g, or t
tcagtcgatcacgtcacgaccggtgctcgatttagcacacgatagttggggtttggggagctcgtgggagaggagcccagcactagaaggtcggcggtagtttccattcggtgatcagcactgaacagaggagactcacgagtggtaggtttggctaggtacgtttcgggtttccacggtagtctttacgttttaaggnggttcgtaccgtaggtcgtacgaagtgtcggacgtacggtcggttgggtagggtacggtcggggtagggggtacgttcggttcggaccgtacgggtccggggttacgggggtcctgacggtccttcggtcgttggccgactcgtcctggtactattaacgtaaacgttaaagtaaaacgttggtacggatccggtaccggtacgggtccggcccgtacgacggccgtacggacggggtaacgacgggtggtagggtcggggttacggcggtaacctaaaggttagacttacgtagtaagtttagggtaaaccgtttaaagggtttaaaacgtttaacgtacgggttagaccggggttacccgtacccggtaagggtaccgggtaacgtaccgtacctaccgaacgttaccgttacaacggtaaacgtacgtaaaccttaacgtaacggtaacgaacccgtactaacgttaacgttacgttacgtaaacccggtaagtaaacccgtaagtacccgggtccggtaaaccggggtagggtaccgtaacggtaccgggaacgtccgtagtccgttagttaaacgtcgtaacggtacgaccgggtaaacgtacccggaccccggttgaccgggttagggtccgggttaggtcgttcgg

SEQ ID NO: 232726 - DNA, 898 bp, Homo sapiens
  misc_feature: GYAE6OF01BBR0U.38.35.D02.1.454.CMB.1.raw
  modified_base (298)..(298): a, c, t, g, unknown or other
  misc_feature (298)..(298): n is a, c, g, or t
  modified_base (820)..(820): a, c, t, g, unknown or other
  misc_feature (820)..(820): n is a, c, g, or t
tcagtcgatcacgtcacgaccggtgctcgatttagcacacgatagttgggtttggggagctctgggagaggagcccagcactagaagtcggcggtagtttccattcggtgatcagcactgaacacaggacggactcacctagtggtaggtttgggctaggtaacgttgggttttcccacggtagtctttacgttttaaggaggtcgtacctagtcgtacgaagtgtgcgaggtcgtggggtggtagtcgggtgggggtacgttcggtacggtccgagggtccgggttcgggggtcccnggtacgcgttccgtcgtggtcgacgcgtccgttcgtacggtacttaacctaaactttaaacgtaaaagtttagggtacggtacgtacgtaccggtaccgggttccggtaccccggacggtacccggtcccgtaccgggaacggggaccgggtaacggggttcgggtagggggtaccgggttacggggtaccggtaaaccttaacgtttaaccgtaacgtacttaaagttaggttaagggttaaagttttaacggggtttaaaagttttaaaggtacccggttaaagggtttacccggtaaacggttaccgggttaaccgggtaaccgggtaaccggggttaccggtaaccgtttaacccgaacctttaccgtacccccggtaagtaaaccggtaaaccgtaacgttaaacccgttaaccgaaacgaccggtacccctaacgttaaccctttaagtttacgtaacgtaaaccttaacgaactaaccggtacggtacgggaacgtacgcggtaacggcgtacgngtactttacgacgtatacggtacgtacgtaaccgtacggtaccgtacggtgtagggtcgggtacggttaggtaccggg

SEQ ID NO: 232727 - DNA, 646 bp, Homo sapiens
  misc_feature: GYAE6OF01CICDN.38.35.D02.1.454.CMB.1.raw
  modified_base (300)..(300): a, c, t, g, unknown or other
  misc_feature (300)..(300): n is a, c, g, or t
  modified_base (313)..(313): a, c, t, g, unknown or other
  misc_feature (313)..(313): n is a, c, g, or t
  modified_base (316)..(316): a, c, t, g, unknown or other
  misc_feature (316)..(316): n is a, c, g, or t
  modified_base (321)..(321): a, c, t, g, unknown or other
  misc_feature (321)..(321): n is a, c, g, or t
  modified_base (370)..(370): a, c, t, g, unknown or other
  misc_feature (370)..(370): n is a, c, g, or t
tcagtcgatcacgtcacgaccggtgctcgatttagcacacgatagttgggtttgggggggaagaggaagactgacggtcctgccacaggtggtgctgggcacggtggcactcgacacaacatttgcgctcaactgtcttagtccagccgtgggggtccctgagactctcctgtgcagcctctggattcaactttacaaaaattgtcgggatgacacgtgggtccacaggcctccagggcaaggggctggagtgggtggcaactatatcatatgatggtaattttaagctatgcgactcgngacggccatcacntcncaganacattccaagcgacactactctattgacaaatgaacagccgtagggacncgtggaacgcacggtctgtacttagttacgtgtacgacgaaacggtacccggtaccttacgtagggtcggggtcgggtagtttacgtcggtcggtacgggtacccgtaacgggtacccgtacggcccctaccggttcctcccgtacgtaccgcccttaacccgaaccggtaaccgggtcccctacggttacccggttccccttcccccgggtcggtacccccgtcccgttcggacccgttacccggaggtacccgccccgtaaccgtcccggaacg

SEQ ID NO: 232728 - DNA, 912 bp, Homo sapiens
  misc_feature: GYAE6OF01CNX9Y.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggtagtttgggctgaacttgggttttcctcgtagtcttcttttaagaggtgtccagttgtcagtatgcagcgtggtggaggttcggtgggggtagtcggtcgggtccgaggtcccggttcggggggtccctggacgtccgttccgtccgttggtcgccgtcgtcccgttaccgtaggtacttacctaaacctttaaactaaaaagtttaggtacgggtagtcgtaccgtacggtccgggtacccgaccggtacggtccgtacccggacgggtaacggaacgggggtccgttaggggtaacgggtcggggttacggaaccgtaaacgttaacgttactacggtaattacggttaagttaaggtttaaacgggtttaaaagtttaaacggtacgttaacggttacgggaacccgggttacccggttaacgggtacggggtaaccggggtaccccgtttacgttacccgtaaacccgtaccgttacccgtaaccgtaaacggtaccgtaaaccgtaaccctttaacggaaacggtaacctaacccctaaccgttaaccgtttactttaaaccgtttaacgtaaactaaacgtaaccgtaaccggaacggtccgggtagggtaacgtaccgggtagaacccgggaccgtaccggttcgttacggtttaaccgtttacttacggtaacggtacccgggtaaacccgggtaaaccgttcccggttaccccgtttaagggttaccgggggtaacgggggtttacgggttacgtttaacggg

SEQ ID NO: 232729 - DNA, 821 bp, Homo sapiens
  misc_feature: GYAE6OF01B6W8D.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttggctgaactgggttttcctcgtagctcttttaagaggtgtccagtgtcagatgcagcgtggtggagtcgtgggggagtcggtcggtccgacggtccggtcggggggtccctggacgtccgttcctccgtggtcgacctagcccttcgtaggtacttacctaaacgtttaactaaaaattagtagggattgaccgtacggttcggggtcccgaccgacggtccgtacccgaaggggtacggaacgggggtccgttaggggacgggttcgggggtacggtaaccgtaaacgtaagttacttaccgaagtttaagttaggtaacggtttaaagggttaaaagtttttaaaacgacgtttaagttaccgggtaaccggtaacggttaccgggtaagggtaaccgggtaccgttacttacccgtaaccgtacttacccgaccgtaaacggtaaccgaacctaaacgttacccgaaaaggacgtaccctaaccttaacttctttaacgtttaacgaacctaaagtacgaacgacggtaccggtacgggactacggaggaaccggtaaccggtggtcctaggtttactaacgtttacgaacgggttacggaaaccgggtaaacccgtacccccggtccgttaacgggttaccgggttaggggtaacccggggtgttaaccggg

SEQ ID NO: 232730 - DNA, 666 bp, Homo sapiens
  misc_feature: GYAE6OF01BT7LO.38.35.D02.1.454.CMB.1.raw
  modified_base (596)..(596): a, c, t, g, unknown or other
  misc_feature (596)..(596): n is a, c, g, or t
  modified_base (619)..(619): a, c, t, g, unknown or other
  misc_feature (619)..(619): n is a, c, g, or t
  modified_base (627)..(627): a, c, t, g, unknown or other
  misc_feature (627)..(627): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaacgttgggttttcctcgtagtcttactttaaggaggtgtccagtgtcagatgcagcgtggtggagtcggtgggggagtcggtggtccgacggtccggtcggggggtccctggacgtactcctcgtgtcgcacgtcctgtggtacttactaacttaactaaaaagttgtagggtatcgaccgtaccggtcgggtcccgaccgacggcctaccggacgggacggtaacggggtcgtagggagggttcgggacgggaacaacttagtacgtacaagtagtaggtaaggttaacgggttaaaagttttaacgacgttagtacggacggtacctcgggtagggaacgggtactacttacgacctactcctaccgaagtaaccgaactaacgtacccgaagacacctaactaccgtattactagaactaatacgacgacgtcgaggcganaggacacgtcgctgtctagtacngacggaanaacccggacccgtacgtggtaggtcgggtggtattcggg

SEQ ID NO: 232731 - DNA, 877 bp, Homo sapiens
  misc_feature: GYAE6OF01CYOA1.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagttttgggctgaacttgggttttcctcgtagcttcttttaagaggttgtccagttgtcagatgcagcgtggtggagttcgtgggggtagtcggtcggtccgacggccggttccggggggtccctaggacgtaccgttccgttccgtcggtcgccgtacgtcccgttacgtacggtacttaaccgttaaaacctttaacgtaaaaaacgtttggtacggggtaacgttccggtaccgttaaccgggttccgggggtaccccgtacccggtacgggtacccgtacccgaggggaaccgggaaacggggggtcgtacgggggtacgggttcgggggtacggtaaccgtaaacgttacttaacgttacgaaacgtttagtaacggttaaggttaaaggggtttaaaaacttttaaaaggtacctaagggttccgggaccggttaacccggttaccggggtagggaaccggggtacccgtttaagtaccccgaaacccgttacggttacctaaaccccggaaggtaaccgtaaactaaccgttacccgaaagtaccgacctaaccttacgttcgttaagtacgtaaacaacgtacgtaacgcggtaccggaggcgtaggcgggaacgtccgggacgttgttccggttaacttacgttaggttaacggtaacggaacccggaaaaccggttcccccgtacggttacggttacggggttcgggggttcggtagtttaacgggg

SEQ ID NO: 232732 - DNA, 897 bp, Homo sapiens
  misc_feature: GYAE6OF01B4G5L.38.35.D02.1.454.CMB.1.raw
  modified_base (165)..(165): a, c, t, g, unknown or other
  misc_feature (165)..(165): n is a, c, g, or t
  modified_base (350)..(350): a, c, t, g, unknown or other
  misc_feature (350)..(350): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttccncgtagcttcttttaagaggtgtccagtgtcagtatgcagtcgtggtggagtcgtgggggagttcggtcggtccaggcccggtggggggtcccctggacgtacctctcctgtcgcacgccttcgtaggtacttacctaactttaactaaaaagtttgtacgggatgaccgtacggtcggggtcccnccgtaggtccctaccggagggaccggaaggggtccgtaggggtagggttcggggtacgacctaaacgttagtaactactaagttagtacggtaagtttacgggttaaaagttttaaacgacgtttagtaccggtacggtaacccggttccgggttaacgggaacggggttaccctaagttacccgaaccgttaccgttacccgtaacccgaaaggtaacctaaacctaaaccgttaccgaaaggtaccgtaccctaaaccttaccgtttactttaacgttacgaaacttaaacgttaaccggtaaaccgtaccgggttacccggttacggggggtaaacctccgggtaaacgggtaaaccggtaaccccggtacggggtttcccttaacggttttacccgttaaacgtttacccgggttaacggggtaaaccccggtaaacccgggtaaaaacccccgggttacccccggttaccccggtttaacggggtttaaccggggggtttaccggggggtttaaacccggggtttacgggttttaaccgggg

SEQ ID NO: 232733 - DNA, 927 bp, Homo sapiens
  misc_feature: GYAE6OF01CA3W9.38.35.D02.1.454.CMB.1.raw
  modified_base (204)..(204): a, c, t, g, unknown or other
  misc_feature (204)..(204): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggtagtttggctgaacgttgggttttcctcgtagcttcttttaagaggtgtccagtgtcagatgcngcgtggtggaggtcgtggggagttcggtcggtccgaggtccggtcggggggtcccctggacgtaccttccgtccgtggttcgccgacgcccgttacgtggtacttacctaaactttaactaaaaaagtttagtggtattgacgtaaccggttcggggtacccgccgtacggtcccgtaccggacgggaccggaaaggggggtcccgttagggggtacgggttagggggtacggtaaccgtaaacttaaagttaacttaccgtaaattaaggttacggtaaagttttaagggttaaaaacggttttttaaaaacggtaaccgttaaacggtttacgggtaacccggggttaacccgtttacccggggttaacggggtaaacccggggtaccccgttaacgtttaaccccgaaccccgtaaaccgtttcccgttaaacccgtaacggtaaaccgtaaaaccgtaaccgtttaccccgaaaagacccgtacctaaacttacccttacgtttaactttaccgtaaacgtaaacgtttaacgaaaaccgtaccgggtacccggtagggaaccgtacgtagggaaccgggtaaccgtaacggtccgttaggtttaccgttaagtttaacccggtaggttaaaccggaaacccggttaaacccggtaccccgggttacccttaccgggttaacggggtttacgggggttaacggggtcggttttaacggg

SEQ ID NO: 232734 - DNA, 775 bp, Homo sapiens
  misc_feature: GYAE6OF01EOJ11.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaacttgggttttcctcgtagcttacttttaagaggtgtccagtgtcagatgcagctggtggagtcgtggggagtcgtggtccacggtccgtggggggtcccctggacgtaccttcgtaccgtgtcgcgacgtccttgtaggtacttacctaaacttaacgtaaaaaatttgtggggtaatacggtaccgtacggtcgggtacccgaccgtacggtacctaccggaggaccgggtaacggggtcgtaggggtaacgggtggggtacggtaacctaaacgttacttaacgtacgtaaagttagtaggtaagttaagggtttaaaacgttttaaagacttaggtacggtacggtaccgtcgggtaaggaacggggtacctactttacccacgtactccgtaaccaaggaaccgtaactaaaccgttacgacgtaacgacctaactacgttacctttagtacgaaactaacgtaacgaacgtaccggtaccgtagggtacgtagtaacggaaccggttaacgaccggttcttaacgttacgttacgtttaagcggttaacgaaaccggtaaacccgaccccggttacctacgggttaagggtccggggttaagggtagtttaccgggg

SEQ ID NO: 232735 - DNA, 276 bp, Homo sapiens
  misc_feature: GYAE6OF01CUT52.38.35.D02.1.454.CMB.1.raw
  modified_base (136)..(136): a, c, t, g, unknown or other
  misc_feature (136)..(136): n is a, c, g, or t
  modified_base (159)..(159): a, c, t, g, unknown or other
  misc_feature (159)..(159): n is a, c, g, or t
  modified_base (250)..(250): a, c, t, g, unknown or other
  misc_feature (250)..(250): n is a, c, g, or t
  modified_base (256)..(276): a, c, t, g, unknown or other
  misc_feature (256)..(276): n is a, c, g, or t
tcagtcgatcacgtcacgaccggtgctcgatttagcacacgatagttggggtttggggggattatgtctggggccagggaaccctggccaccgtctcctcagccctccaccaagggcccagtcggtcttacccccnggccgcccctgcctaccgaggancacctccgagcgcacgtgccggccctagggctgcctggtacaagtcctacttccgagtgactcgactgcggcggcgtgaacctaggcctanagtgcnnnnnnnnnnnnnnnnnnnnn

SEQ ID NO: 232736 - DNA, 810 bp, Homo sapiens
  misc_feature: GYAE6OF01CTS0P.38.35.D02.1.454.CMB.1.raw
  modified_base (592)..(592): a, c, t, g, unknown or other
  misc_feature (592)..(592): n is a, c, g, or t
tcagtcgatcacgtcacgaccggtgctcgatttagcacacgatagttgggtttggggggagaggagcccagcactagaagtcggcggagtttccattcggtgatcagcactgaacacagagactcaccatggagtttgggctgaacttgggttttcctcgtagtcttcttttaaggagtgtccagtgtcagatgcagctggtgagtcgtggggatcgtggtccgaggccggtgggggtccctgacgtacctctcctaggtcgcgacgtcccttagtacggtaacttaacctaaacctttaacgtaaaaaactttaggtaacgggtaacttcggtacccgtaaccggttcggggttaccccgtaccgaacggtcccgttaaccggaacggggacccgggttaaaagggggcccggttaagggggtacggggttacggggtacggtaacccctaaaacgtttagtaacgttaacgtaagttaagtacggtaagtttaaagggttaaaaggttttaaacgtaactaacggtaggtaacccggttaacggtaccccgggtaaggtaacccggtaccgttaacttaccgaccttaanaccgtacccgaagtaacgaactaacttacgaaagtaccgactacctacttaactactttaccgaataaacgtacgaacgtacggtacgtagggtacgacgtacgaacggctaggtcgttagttactacgttatcggtacgaaaccgggtaaccgtacccggcgttaacgtaagggtcgggtacggttaacgttgacccgggtggtccgggtaacccgg

SEQ ID NO: 232737 - DNA, 894 bp, Homo sapiens
  misc_feature: GYAE6OF01CZHO8.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactacaccagtggtagtttgggctgtaacgtttgggttttccctacggtacgtcttacgtttttaaggagggttcgtaccgtaggtcgttcgaaggatcgcgtaggtcgttggggtgggtaggttcggggtagggggtaggttcggtacgggtcccgtacggggtcccggggttccgggggggtacccctaggaacgtaccgtttcctcgggtttgcgaccgaccgtccgtacgttcggttaacttaaccgttaaactttaaaacgttaaaagttaggtacgggtagtacggaccggttacgggtccggtacccgaccggacggtcccgtaccggacgggacggagggacggttacgggaggggtacgggtacgaccgtaaattacgtacgtataacgtagtagttaacggttaaggtttaaacgttaacgacgttaaacgtcggtaccggttaccgtacgggtaacggtaaccgggtccgtaaccgtaccgtaaccttaaccggtacttaacccggaaagtaaacgaaacccttacgttaaacgaacgtacgtaccctaacgtacctttaagttttaacgtaacgttaacgtaacgtaacgtaaccggtaccgggtacgggtaggtaacgtcggtaaccggggagtacccggttaaggtccttaacggttcgtaacgttaaccggtcgtaaccggttaaacgaacccggggttacccctacgggttagttacccggggtaaggggttccggttagggttacggg

SEQ ID NO: 232738 - DNA, 802 bp, Homo sapiens
  misc_feature: GYAE6OF01BPAEP.38.35.D02.1.454.CMB.1.raw
  modified_base (302)..(302): a, c, t, g, unknown or other
  misc_feature (302)..(302): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaacttgggtttttccctgttacgtcttactttttaaggagggttgtcctagtggtcaggatggcaggtcgtgggtggtaggtcggtgggggtagtcggtcggtccgacggccggtcggggggtccctggagtccgttctccgtggtcgacncgtccttgtggtaacttaccttaaaccttaactaaaaagttaggttaggtactgaccgtacggtccgggtaccccgtccgaacggtcctaccggacgggtccggaacggggtcgtagggagggttggggtacggacctaacggtatatacgtagtagagtagtaaggtttaaattaacgagttacgtcggtaacgtaccggtcggtaagggacccggtacgttaactacccgaacgtctaccgaccgtaagtacaaccgtaaacgttaccgaaggaacctaccgtaaccgtacctttacgttttaacgtaacgtaacgtaaacgtaacccggtaacgacccggtaaggggttacggaacgtcggggtaacgggtaaacgccggttaaccggtcgttacggttacctttaacggttacgtacgggttaacggtaaacccgggtaaaccgtcccccgggttaactacggggttagggtacggggttcggggtgtttaccggg

SEQ ID NO: 232739 - DNA, 861 bp, Homo sapiens
  misc_feature: GYAE6OF01CQE6M.38.35.D02.1.454.CMB.1.raw
  modified_base (597)..(597): a, c, t, g, unknown or other
  misc_feature (597)..(597): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccagtggagtttgggctgaacgttgggttttcctcgtagtcttacttttaagaggtcgtccagtgtcagtatgcagcgtggtggaggtcggtggggtagtccggtggtccgacggccggtcggggggtccctaggacgtaccgttccgtccgtggtcgacgtacgtccgtcgtaggtacttacctaaaccgttaacgtaaaagttacggtacgggtactacggtaccgtaccgggttaccgggtaccccggtccggaacggtcccgttaaccgggaacgggtaccgggtaaacggggtccgtacgggggtacggggtcggggtaacggtaacccttaacggtaacgtacgttaacctaagttaacgtaggttaagttaaacggtttaaagttaaacgtacgttaagtacggtacccggtagttaccgggtaagggaaccgggtaccgtaccgttaccaacctntacccgaccgaaggaacctacgtaacctaacggacgaccgtacctaaccgttacttacctaagttaaccgaacgtaacgttaccgaaacggtccgtacggtaaccgggtataccggtacgggaacggttacccgtcgggttaactttcggttaaaccttacggttaccgggtacgggttaacccgaaccgggttaaaaccccggccgtttacccggtaacgggttaccgggggttacgggttaacggggttacgttaccggggg

SEQ ID NO: 232740 - DNA, 691 bp, Homo sapiens
  misc_feature: GYAE6OF01AMAIH.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcggtggtccaggccgtggggggtccctggacgactctcctgtgcacgcctctggacttcaacttacaaaaatttgtggggatcgacacgtcgggtcccgcgaggcctccgaggccgaaggggctgggaggtgggtaggacctaactagtatcattagtgtaacgtagggttaaacgttttaaagacgttagtcggaccggtactaccgggtaggaacggggcctaagttccaaccgtacttccctaccaaaggtacgaaactaacgttacccgaaaggtaccgacctaacgtaccttactttaacttacgaactaaacttacgaaccgtagtacccggtagggtacaccgtaggaacgggtactaccgggtacttacgttacgttacgttacgtggtaaccgaaccgggtaaaaccgtaccccggttacccgtagttacgggtcgggggttacgggtaaggtttcggg

SEQ ID NO: 232741 - DNA, 808 bp, Homo sapiens
  misc_feature: GYAE6OF01C59O9.38.35.D02.1.454.CMB.1.raw
  modified_base (259)..(259): a, c, t, g, unknown or other
  misc_feature (259)..(259): n is a, c, g, or t
tcagtcgatcacgtcacgaccggtgctcgatttagcacacgatagttgggtttggggagctcgtgggagaggacgcccagcactagaagtcggcggtagtttccagttcggtgatcagctactcgaacacagagactcacagtggagtttgggctgtaacgttcgggtttttcctacgtagtacttacgttttaaggcggttgtacctggttacgtagtagatcgcgtacgtgttgggaggtcggttcgggtacggggngttccggttcggtaccgtgggtccgggtacgggtcctaaggcgtactcgtcgtgtcgacgtctcgttacgacggttaacttaaccgttaaacctaaagtaaagtcggtaacggactcggtaccgtaaccggtcggtacccgtcggaccgtacgtaccggaggtaccggaaggggtctggggttaggtcgggtaacgtacgttaacgtaaatcgaactttaaggtagttaaggttaaggtttaaacggttaaaagttttaacaacggttcgtaacggtacgtaaccggttcggaacggtaacggtaccgtacctacgtaaccgacgttaccgaaccgtaataacgtaacgttaaaccgtaacggaactaaccgtactaaccgtactttagtttaacttagaacgaaagtacgtaccgtacgggtcggacgtacggaaccgtgaaccgtggttacccgaggttacgtacgttaacgttgtaacggtaccgtaacggtaaccggacccttacggggttaacgtgggtaaacccggtgggttaaggttaccgg

SEQ ID NO: 232742 - DNA, 767 bp, Homo sapiens
  misc_feature: GYAE6OF01DHQDF.38.35.D02.1.454.CMB.1.raw
  modified_base (243)..(243): a, c, t, g, unknown or other
  misc_feature (243)..(243): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcgccatggagtttgggctgtaacgttgggttttcctcgtagtcttacgttttaagaggtcgtccgtaggtcgtcgaggatgccgagtcgtgggtggtacgtggtagggggngtccggttggtaccgacggtcccgggttcggggggtaccctcggacgtccgtcgtccgtggtgccgacgtccctgtagtacttactaaccttaacaaaaagttggtaggtaactggtacccgtacggttccggccgccgacggtaccctaccgggaacggacgggaacgggtgtacggggtaggtcgggtacggaactaaacgttagtacgtacaagtaggtagtaaagtaacggtttaaagtttaaacacgttagacggtaccgttaccgtacggtaaggaaccgggtcgttactaccgtacgtaaccgttccgaaccgtaagtaacgtaccgtaaactaacccgaagccgtaaccaactaccgtttataactacgaactaagtaaccgactacgggtcggtaggtaccgtaggacggtaaccggacggtaaccgtctaggttaacttgtaagtccgaagtacccgggtaaaccgacccgttcccggttaaggtaccgggttcgggtacggttgttaaccggg

SEQ ID NO: 232743 - DNA, 879 bp, Homo sapiens
  misc_feature: GYAE6OF01AEE8E.38.35.D02.1.454.CMB.1.raw
tcagtcgatcacgtcacgaccggtgctcgatttagcacacgatagttgggtttgggggagctctgggagaggagcccagcactagaagtcggcggagtttccattcggtgatcagcactgaacacagaggactcaccagtggtagtttgggctaggtaacgttgggttttccctacggtacgtcttacgtttttaaggacggttgtccctaggttggtactaggtatggccgtaggtcgttgggtagggtacggttcgggtggggggtacgttcggtcgggtcccgtagggtcccgggttcgggggggtacccctgggacgttaccgttccgtccgttagtcggtacctacggtcccgttcggtacggttaacttacctaaaccgtttaaacgtaaaaacgttttggtacgggtactaccggtaccggttaccggttccgggggtaccccgtaccggtaccggtcccgttaccgggaacggggtaccgggtaaacgggggttcggtacggggttacgggtacgggggttacgaaccgtaagttacgtaactaccggtaaattcggtaggtaaggttaaacggtttaaaggttaacgaggttacgtcggtacggtaccggttacggtacgggacggggtccttaacgtacgaccgtacgttaccgaacggtaacgaacgttaaccgttaacgaccggtaacgacgtaccaaccttagttactaccgttaagaactaggtaacaacggtcgtacggtagacggactacgggactacgtcgttcgtacggtttacctaggttcggtaacggacggtaacccgtaaccgggttacccgtccggttagggttaccgggtaacgggttgggttaagttacccggg

SEQ ID NO: 232744 - DNA, 853 bp, Homo sapiens
  misc_feature: GYAE6OF01A6MW6.38.35.D02.1.454.CMB.1.raw
  modified_base (180)..(180): a, c, t, g, unknown or other
  misc_feature (180)..(180): n is a, c, g, or t
  modified_base (713)..(713): a, c, t, g, unknown or other
  misc_feature (713)..(713): n is a, c, g, or t
tcagtcgatcacgtcacgaccggtgctcgatttagcacacgatagttgggtttggggggaagaggaagactgacggtcctgccacaggtggtgctggcacggtggcactcgacacaacatttgcgctcaactgtcttgtccagccgtggggtccctgagactctcctgtgcacgtcctcngtacttcaacttactaaaaattgtaggatgactacggtcgggtccaccaggtacctccgagggaccggtaacggggtcgtagggtaggttgggtacggaacctaaacgttatacgtctaagttactacggtaattagggttaaaacttttaagacgttagacgggtccgtaaccgtacgggtaacggaacgggtcctacgttccaacctacgttccaacgtaaggtaacgtaactaaccgttacgaaacgtacctctaacttacccgttatttacggtttaacgaaacgtaaagttaccgaaaccggtaccgtaacggggttggaccgtagtaacgggtaaccgaccgtacggtcttaacgttaccgtttaattacgggtacgtaaccgtaaaaccgggtaaacccggtcccggttacgttacggttacggggttaccggggttagggttaaacggtttccggtaccgggttaccgggacgggtaacccgaacgggttacccgtccggtaacccggttcccgtacgtaacccncggtaaccctaccccggtacccgaaccggtacccggtaccccgttaggttacccccgttcccggttccccggtaccgtcccggtcccgtacccgtacccgtacccggaggaccccggtacccttacggacccggtaccgg

SEQ ID NO: 232745 - DNA, 873 bp, Homo sapiens
  misc_feature: GYAE6OF01AK4BY.38.35.D02.1.454.CMB.1.raw
  modified_base (107)..(107): a, c, t, g, unknown or other
  misc_feature (107)..(107): n is a, c, g, or t
  modified_base (786)..(786): a, c, t, g, unknown or other
  misc_feature (786)..(786): n is a, c, g, or t
  modified_base (823)..(823): a, c, t, g, unknown or other
  misc_feature (823)..(823): n is a, c, g, or t
tcagtcgatcacgtcacgaccggtgctcgatttagcacacgatagttgggtttggggagctctgggagaggagcccagcactagagtcggcgagtttccattcggtnatcagcactgaacacgagacgactcacagtggtagttcggctaggtaacgttgggtttcctgtacgtccgttagttttaacggaggttcgtccgtagtgtacgatagtcgactcggtacgtgggtaggtaggtcggtggggacgttcggtacggtccgtacggttcccgggtacgggggtccctaggtaaccgtccgttccgtccggttgtaccgtaccgaaccgtccgtttaacggtaccggttaactttaaccgtaaaaccttaaccgtaaaaaggttttggaccgggttacttaccggaccgttaaccgggtcccggtaacccgtacggtacccggtcccgttaaccggaacgggttacgggtaacggggttcccgtaaggggtaccgggttcgggtaaacggtacctaaaaggttaccgtaccggtaaagttaaccgtaacgttagggtaaacggtttaacggttaaaaagttttaacgaccgtttacgggtaccggacggtaccgtacgggttaacgggtaaaccgtacccgtaacttaccgtaccgttaaccgtaccgttaacccggtaacgtaaccgtaaaccgttaaacccggtaacgggtaacgtacccggaaacccttaacggtaacctttacggtttaaacgtaaccgtaaacgtaaacccggttaancgagtacgtagtacaggttccacgtacgacgtacgtnacgtaccgtgactcgtacgtacgttacgaccgtgaccgtacgtacgtgcg

SEQ ID NO: 232746 - DNA, 844 bp, Homo sapiens
  misc_feature: GYAE6OF01EHCAL.38.35.D02.1.454.CMB.1.raw
  modified_base (152)..(152): a, c, t, g, unknown or other
  misc_feature (152)..(152): n is a, c, g, or t
  modified_base (698)..(698): a, c, t, g, unknown or other
  misc_feature (698)..(698): n is a, c, g, or t
tcagtcgatcacgtcacgaccggtgctcgatttagcacacgatagttgggtttggggagctctgggagaggacgcccagcactagaagtccggcggagtttccattcggtgatcagcactgaacacagacggactcaccatggagtttgggntgaacgttggtttcctcgtagtcttacgtttaagaggtgtccagtcgtacagatgctagcgtggtggaggtcggtgggggagtcggtcggtaccgacggtccggtcggggggtcccctaggacgtaccgttccgtccgtggtcgaccgtacgcccttcggtacggtaactttacctaaaccttaaactaaaaacgtttggtagggtactcgtaccgtacggtacggggtcccgacccgtacgggcccgtaccggaacgggacgggtaacggggtcgtaggggtacgggttggggtacggtaacctaacgtagtactacgtaagttagtaggtaagtttaaacgggttaaaagttttaaacgacgttaacggtccggtacggtacccgttaaccgggtaacggtacccggggtaaccttaccgttaacccgaacgttaccgtacccgtaacggtacgtaaacgtaacccttaaacgtaacccgtaaacggtacaaaccctcgttaacttacgttttaacgtaaccgaaactaacgtaaccggtaacnccgggtaccgttaggaccggtgtaaccggggaacgttccggacggtttacgttaaccgttacgttacgttcgtaacgggtaacccgaacgggtaacccgtaccccgtacgtacgggtaggggttaaccgggttggtacgttcgggg

SEQ ID NO: 232747 - DNA, 785 bp, Homo sapiens
  misc_feature: GYAE6OF01AO26Q.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagcttacttttaagaggtgtccagtgtcagatgcagctggtggagtcggtgggggagtcggtggtccgaggccggtcggggggtccctgacgtacctctccgtgtacgcacgtccgtcgtggtacttacgaacctttaacaaaaaattggtagggtatcgaccgtacggtcgggtcccgccgacggtccctccgaaggcggaaggggcgtgggaagggtgggtacggaccgtaagttatacgtacgtaagttaagtggtaacgttaaggttaaaagttttaaagacttaagtccggtacggtaaccgttaccggtaagggaaccgggtaccgtacctttaccgaaccgttaccgttcccgtaaccgaaggtaacgtaaacccttaaacgttacccgaaaacggttacaacccgtaactaccgttttacgttacgtttaacgaataaaacgtacaacgggtaccgtacccggttaagggaccgtacgtacgggaacccgtacggtaccggtaccgttcgttaacgtttacttaacggtcggtaaccggaaccggttaaaacccggtcccgtacccgttaggttaaggggttccgggggtaccggttaaaggttccggg

SEQ ID NO: 232748 - DNA, 699 bp, Homo sapiens
  misc_feature: GYAE6OF01CEF7B.38.35.D02.1.454.CMB.1.raw
  modified_base (299)..(299): a, c, t, g, unknown or other
  misc_feature (299)..(299): n is a, c, g, or t
  modified_base (303)..(303): a, c, t, g, unknown or other
  misc_feature (303)..(303): n is a, c, g, or t
  modified_base (339)..(339): a, c, t, g, unknown or other
  misc_feature (339)..(339): n is a, c, g, or t
  modified_base (399)..(399): a, c, t, g, unknown or other
  misc_feature (399)..(399): n is a, c, g, or t
  modified_base (409)..(409): a, c, t, g, unknown or other
  misc_feature (409)..(409): n is a, c, g, or t
  modified_base (424)..(424): a, c, t, g, unknown or other
  misc_feature (424)..(424): n is a, c, g, or t
  modified_base (461)..(461): a, c, t, g, unknown or other
  misc_feature (461)..(461): n is a, c, g, or t
  modified_base (601)..(601): a, c, t, g, unknown or other
  misc_feature (601)..(601): n is a, c, g, or t
  modified_base (622)..(622): a, c, t, g, unknown or other
  misc_feature (622)..(622): n is a, c, g, or t
tcagtcgatcacgtcacgaccggtgctcgatttagcacacgatagttgggtttggggagctcgtgggagaggagcccagcactagaagtcggcggagtttccattcggtgatcagcactgaacacagaggactcgacagtaggtagtttgggctgaacgttgggttttcctcggtagtccttacgtttttaaaggaggttcgtacctaaggttcgtcaaggtatcgcagcgtgggtggtagtcggtggggtagtcgtggtccaggtccggtcgggggtacctgacgtacgtcctcgtgntacncgtcctgtgtactacgtaacttaactaaaagttcgnggatacgcgtacggttccgggtccgacgacggtctacggagggaccgagggtcgtagggngggtcggganaacgtaactgtctanattagtacgagttttaaggaaagtttaaagcgtacgnggtaccggtactccggtaagggaccgttcgtactacccgactatacgtacagaactaactctaccaagacgtacaacgtctacgttactagaacctaagacgaacctggtcgtaggacgtctagggaacgtcgtacggtnttacccgggttattacggtanacgggttaaaccgacccggttaaaacgccccgttacgttacgggttgggtaaccggggttcgggttgttacccgggg

SEQ ID NO: 232749 - DNA, 316 bp, Homo sapiens
  misc_feature: GYAE6OF01EWAFX.38.35.D02.1.454.CMB.1.raw
  modified_base (244)..(244): a, c, t, g, unknown or other
  misc_feature (244)..(244): n is a, c, g, or t
  modified_base (251)..(316): a, c, t, g, unknown or other
  misc_feature (251)..(316): n is a, c, g, or t
tcagtcgatcacgtcacgaccggtgctcgatttagcacacgatagttgggtttgggggggagttagtgtctggggccagggaaccctggccaccgtctcctcagcctcaccaagggcccatcggtcttccccctggcgccctgctcccaggagtccacctccggagagcacagcggccctgggctgcctggtccaaggtactacttccacgtgatccgactggcggcgggactggacaaggccngaattgnnnnnnnnnnnnnnnnnnnnnnnnnnnnnnnnnnnnnnnnnnnnnnnnnnnnnnnnnnnnnnnnnn

SEQ ID NO: 232750 - DNA, 834 bp, Homo sapiens
  misc_feature: GYAE6OF01BO9D0.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagttgggctgaacttgggttttcctcgtagtcttcttttaaggaggttcgtccagttgtcagatgctagcgtggtggtagtcggtgggggagttcggtggtaccgagtcccggtggggggtcccctggacgtcctccttcgtgttcgctacgtccgttctaggtacttacctaaactttaaaccgtaaaaaatttgtagggaactacggtccgtaacggttccggggttcccgacccggtacgggtaccgttccggaacggggaccggtaaacgggggtccgtaggggttagggtggggtccggtacgtaaacgtacttactaactagttaacgtggtaaatagggtttaaaagttttaaacgtactagtacggacgtaacccggttcgggtacggtaacggggtccgttacgtaccctaacgtaccgttcccgtaacgaagtaaccgaaacgttaacctaacgaaaggtaacgaaccgtaacctaacctttaacgtacttacggtaaactaacggttaactaaccggacgttcgggtacgtaacgtcggtaaacgacggtaaccggaccggttcttaacgggtttcttaaaccgttaggtaacgtaacccggtaaacccgggtaaaacccgggtaccccgtacccgtttaacgggtaacgggtttacggggggttaggtacgtttaaccgggg

SEQ ID NO: 232751 - DNA, 811 bp, Homo sapiens
  misc_feature: GYAE6OF01D4L0D.38.35.D02.1.454.CMB.1.raw
  modified_base (206)..(206): a, c, t, g, unknown or other
  misc_feature (206)..(206): n is a, c, g, or t
  modified_base (713)..(713): a, c, t, g, unknown or other
  misc_feature (713)..(713): n is a, c, g, or t
tcagtcgatcacgtcacgaccggtgctcgatttagcacacgatagttgggtttggggagctctgggagaggagcccagcactagaagtcggcggagtttccattcggtgatcgagccactgaacacgaggtacgactccgacctagtggtaggtttcggactagtaacgttgggttttcctaccgttagtcctttagttttaaggnggttcgttcaggtcgtcgtaagcgttggccaggtcggttggggtaggacggttgggtacggggggtagttccggttaggggtccctaacggtcccgggtagggggtcccctaggtacgtaccctttctccggttgcgtacccgtgtcccgttaggttaccggaactttaaccgtaaaacgttaaacctaaaaaggttggaagggtaatccggtaaccgtcgggtttaccggtacccggacggtccgtacgtaccgggaaggtccgggtaaagggtccgtagggtacgggttggtacgtaactaagtacgctacgtaaacgtagtagtgtaaaggttaagttaacacggtacgaggtaccgtacgtacgggtaaggtacgtcgtaactcccgaattcgacgttacgagacgtaactaagtccgaagtcaacttacgtactacgttataacgactaaagggccaacgtacgttacggacggtacgtgtacgaacggtcgttaacgggtnttaacggttacttaccggttagtggtaaccggaaacccgttagggttaaaccccctcggttaaacgttggggaaccgggttcgggttggttaacccgg

SEQ ID NO: 232752 - DNA, 907 bp, Homo sapiens
  misc_feature: GYAE6OF01CP05S.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcatagaacacagaggactccaccagtggtagttcggactgaacgttggtttccacgtagcttacgtttaaggaggttcgtccgtagttcgtacagtatgacagtcgtgggtagggagttcgggtaggggtacgtcggtcggtaccgacggtcccgggttcgggggtccctgtaacgtccgtccgtccgtcgtagtccgaccgtccgttacgtacggtactttaacctaaaaccgtttaataaaaagttcggaaggttactacggtaccgtaccgggtacccggtccccgaccgtaccggttacccgacccgggaacgggaacgggtaaccgggttgggacggggttacgggtagggttaccggaaacttaaaggtacttaacgtacctaaaggttacggttaacgtaagggtttaaacgttttaaaagggttaactaacgttacggttacggtacccggttaccggtaaaccggtaacggggtaccggtaccgttaacccgttaccgtaaccccgtaccgttacccgttaaacggaaacgtaacgttaaaaccgtaccgttaaccgaaccgtaccgtaaaccgtacctttaacgttaccgttaacgtttaacgaaacgttaacgaaccgtaacgtaccggtccgggtagtaaccgacggtagaaccgtaacgtcgttacgtacgttacgttaacgttacggtaccggtaaaggtaaacccccgtaaaccgggtaaccccgttcggtttaaaccgggcggggtttaacgggggttccggtttaagtacccgggg

SEQ ID NO: 232753 - DNA, 807 bp, Homo sapiens
  misc_feature: GYAE6OF01A8VF4.38.35.D02.1.454.CMB.1.raw
  modified_base (367)..(367): a, c, t, g, unknown or other
  misc_feature (367)..(367): n is a, c, g, or t
  modified_base (725)..(725): a, c, t, g, unknown or other
  misc_feature (725)..(725): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaacttgggttttcctcgtagtcttcgttttaagaggtgtcctagtgtcagatgcagctggtggagtcgtggggagtcggtgtccagccggtgggggtccctggacgtactctccgtagtcgctacgccgtcgtacggtacttacccgtaaactttaacctaaaaagtttacggtcggggtaattcggtaccgtaaccgggttccgggggttacccncccggtaaacgggtcccttacccgggtaagggtaccgggtaaacggggggtcgtcggggtaacggggttaggggtacggtaaacgtaaaacgtagttaacgtcgtaacgttagtaacggtaagtttaacgggttaaaaggttttaaacgaacggtttacgtaacgggtacccggtaaaccgttacccgggtagggaaaccgggttcctaacgtacccggtaacctacgtacccgtccgaaaacgtacgtaaccgttaacgtaccgaacgggtactaaccgtactaaccgtttgttaagtttacgaaattaacgacgtaaccgtacgtcggtaaacggtcacgtacgggaacgtaccgnggttaccagtttacgtcgttacggtgtcccggaaacggtaccgtaccgtcccgtaggtagggtcggggtacgttagtacggg

SEQ ID NO: 232754 - DNA, 936 bp, Homo sapiens
  misc_feature: GYAE6OF01C82NX.38.35.D02.1.454.CMB.1.raw
  modified_base (147)..(147): a, c, t, g, unknown or other
  misc_feature (147)..(147): n is a, c, g, or t
  modified_base (207)..(207): a, c, t, g, unknown or other
  misc_feature (207)..(207): n is a, c, g, or t
tcagtcgatcacgtcacgaccggtgctcgatttagcacacgatagttgggtttggggagctctgggagaggagcccagcactagaagtcggcgagtttccattcggtgatcagcactgaacacagagactcacagtggtagttcggntagtacgtttggtttccgacgtagtcttacgttttaagaggttcgtccgagtcgtacagntcgcgaggtcggtggtaggtggtacggtggggcgtcgtccggtaccgcgggtccggtacggggggtccctagtaccggtccttccgtccttggcggtcctaccgtaccgtcggttacggaacgtttaaccttaaaccggttaaaccttaaaaacgttaggtaccgggtaagtccggtaacctccggggtttaccggtacccgcccgggtacggtaccggtaccgggaaccggggttaacgggaaaccgggggtcggtaaacggggttaggggtcgggggaacggttaaacccgtaaattacggttaaccgttaagttaaaacggtaggtaagtttaaagggttaaaacccggttttaaaaggtttaaaaggttaaaccccggttagggttaaccccgggtaacggttaaaccgtaccggggtaagggtacccggtaacgtaacccgttaaccgaaccgttaacccgttccgtaacggtaaaccgtaaacgtaaaccgttaacgttaaccggaaaccggtctaaaccctaccggtaacttaaccgttacgtaactaaacgtaacgtaaaccgtaaggtaaccgggttacgaaagggtcgttacgaccgggtacggttaccggtacgtaaaccggttcgtacttaaaccggtgtaacggtaacggaacccggtaacgttaacccgtccggtaacgttaggggtagggttaaacccggttgggttaaacggg

SEQ ID NO: 232755 - DNA, 826 bp, Homo sapiens
  misc_feature: GYAE6OF01EQ2PF.38.35.D02.1.454.CMB.1.raw
  modified_base (302)..(302): a, c, t, g, unknown or other
  misc_feature (302)..(302): n is a, c, g, or t
  modified_base (802)..(802): a, c, t, g, unknown or other
  misc_feature (802)..(802): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggtagtttggctgaacgttgggttttcctcgtagtcttacgttttaaggaggttcgtcctagttgtcagtagtgcaggtcgttgggtcggagtcggtggggtagttcggtcggtaccgacggtccggttcgggggtccgtacgacgtacctctccgtgtcgacncgtctcgtagtacttactaacttaagtaaaacgttagtacggtagtacgtaccgtaccggtacgggtcccgaccggaccggtccgttacccgggaacgggtaccgggaaacggggtaccgttagggggtacgggttacggggtacggtaaccgtaaacgtttactaacgttacgtaagtttagtacggttaaggtttaaaggtttaaaacgtttaaacgtacgttagtaccggtacggtacggttaccgacggggtaaccggtaccgtaacttaccgtaacctacttacccgtacgaacgtaacggtaacctaaccgttaaccggaacgtaacgtaccctacgtaaccctttaggttaacttacgaacttaaacggtaacgacgtacgtacggtaggtacgacgtacggaacggtacgtacgggttctagttacgtttacgtacggttacggaacggtaaccggtaaacccggtacccgtaccgttacggtttaacgggnggggtttaacggtggtttaccggg

SEQ ID NO: 232756 - DNA, 768 bp, Homo sapiens
  misc_feature: GYAE6OF01A4KHQ.38.35.D02.1.454.CMB.1.raw
  modified_base (668)..(668): a, c, t, g, unknown or other
  misc_feature (668)..(668): n is a, c, g, or t
  modified_base (705)..(705): a, c, t, g, unknown or other
  misc_feature (705)..(705): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttggctgaactgggttttcctcgtagcttacttttaagaggtgtccagtgtacagatgcagcgtgggtggagtcggtgggggtagttcggtcgggtccgacggtcccggtcgggggggtcccctggacgtaccttccgttccgtggtcgcctacgtcccttcgttcggtaacttacctaaaccgtttaactaaaaaacgttaggtaggggtactacggcctacggttcggggtccccgccgtacgggtcctaccggaacggggacggaacggggggtcgtacgggggtaagggttcgggggtacggtaccgaaacgtttacgtaactaccgttaagtacggttaaggtaaggtttaaagggtttaaacgtttaaacgaacttaggtaccgggtaaccggtaccgtccgggtagggtaccgggtaccgtactaccgacctactccgtaaccgagaacgtaactaacgtacaagaccactactacttacttagtacgaactaacgacgtacgtacgtcgtagggacncggagaccggtacgaccgtcgtctacgttacttacgngtaaccggaaccgaaccggtacccgtacgttacggtagggtcggggttcggttaggttccggg

SEQ ID NO: 232757 - DNA, 820 bp, Homo sapiens
  misc_feature: GYAE6OF01EJQHW.38.35.D02.1.454.CMB.1.raw
  modified_base (226)..(226): a, c, t, g, unknown or other
  misc_feature (226)..(226): n is a, c, g, or t
tcagtcgatcacgtcacgaccggtgctcgatttagcacacgatagttgggtttgggggggaagaggaagactgacggtcctgccacaggtggtgctgggcacggtgggcactcgacacaacatttgcgctcaactgtcttgtccagccgtgggggtccctgagactctcctgtgcagtcctctggattccaacttacaaaaattgtgggatgacacgtcgggtccnccaggcctccgaggcgaagggctgggaggtggggtgactaactatacgtctaatagtgtaagtaggttaaacgttttaaaacggacttagtcggtaccggtaaccgtaccggttaagggaaccggggtaccttacgttaccgacccttaacgttaccgtaccctaagggaactaaccgtaaactttaccggaaaagtcgtaacccaaacgtacctttaacggtttactttacgaacgtaaaacgttcgaaaacccgacggtcgtaaggggacccgtacgttaccgggaaacggaccgtacgggtcttaccgttaacgtttaacgttaccggttacggtaacggaaaccggttaaaaccggacccgtaccgttaccggtaacgggttcggggtaacggggttagtttacggttacgggttaggtacccggggactaacccggggttaccgacgtacccgtacgtcccgtaccctacgtacacccgtaacccgaccgtaccgggtccctaacggttccccggttaccctccccggtcggtccccggcccttaccggccctaacggtacggacccgtacctacccggtcgaaccggg

SEQ ID NO: 232758 - DNA, 838 bp, Homo sapiens
  misc_feature: GYAE6OF01BCGJ2.38.35.D02.1.454.CMB.1.raw
  modified_base (314)..(314): a, c, t, g, unknown or other
  misc_feature (314)..(314): n is a, c, g, or t
  modified_base (353)..(353): a, c, t, g, unknown or other
  misc_feature (353)..(353): n is a, c, g, or t
tcagtcgatcacgtcacgaccggtgctcgatttagcacacgatagttgggtttgggagctcgtgggagaggagcccagcactagaagtcggcggagtttccattcggtgatcagcacttgaaccacgagtacggactcaccagtggtagtttggctgaacgttcgggtttttccgtcgtagtccttacgtttttaacggaggttgtcccgtaggttgtcagagtggccgtacgtcgttgggtcggacggttcggtgggggtacgttccggtcggtccaggcccggtcgggggtcccctaggcgtactctcgtgngcagcctcgtagtactactaactactaaaattgtaggtncgactacggtcggtcccgccgaggtccgtcggacggtacgggtaaggggtcgtagggtacgggtcgggtacgtacgtaacgttagttaactaccgagttagtaacgtaagtttagggtttaaaacgtttaacgtaacgtacgtacgggtaacccggtacgtcccggtaagggtaccggtaccgtaaccgttaccccgtaacgttaaccgttacccgtaacccgaacggtaacgaaacccgtttaaccgtaacccgtaaagggaaccacccggtttaactacccgtttatttaacgttacctaacgtaaacgttaccgaaaccggttaacgggtcggttaccgggttaagtccggttaaggtacggaccgttaccgggcgtttaccgttaactttaaccgtttcgtacgggtaccggttaaaccgaacccgggttacccccgtagttcccgggtaggtttacccggggtaggtttaaccgttcggg

SEQ ID NO: 232759 - DNA, 234 bp, Homo sapiens; identical to SEQ ID NO: 232625
  misc_feature: GYAE6OF02GX9E4.38.35.D02.1.454.CMB.1.raw
  modified_base (233)..(234): a, c, t, g, unknown or other
  misc_feature (233)..(234): n is a, c, g, or t

SEQ ID NO: 232760 - DNA, 236 bp, Homo sapiens; identical to SEQ ID NO: 232635
  misc_feature: GYAE6OF02HZ7BS.38.35.D02.1.454.CMB.1.raw
  modified_base (234)..(236): a, c, t, g, unknown or other
  misc_feature (234)..(236): n is a, c, g, or t

SEQ ID NO: 232761 - DNA, 195 bp, Homo sapiens
  misc_feature: GYAE6OF02IFZQ8.38.35.D02.1.454.CMB.1.raw
  modified_base (195)..(195): a, c, t, g, unknown or other
  misc_feature (195)..(195): n is a, c, g, or t
tcagtcgatcacgtcacgaccggtgctcgatttagcacacgatagttgggtttggggaagaggaagactgacggcccatcggtcttcccctggcgccctgctccaggagcacctccgagagcacagcggccctgggctgcctggtcaaggactacttccacgtgatcgactgagcgggctggcaaggcgcatagn

SEQ ID NO: 232762 - DNA, 237 bp, Homo sapiens
  misc_feature: GYAE6OF02F1VWZ.38.35.D02.1.454.CMB.1.raw
  modified_base (236)..(237): a, c, t, g, unknown or other
  misc_feature (236)..(237): n is a, c, g, or t
tcagtcgatcacgtcacgaccggtgctcgatttagcacacgatagttgggtttgggggagttatgtctggggccagggaaccctggccaccgtctcctcagcctccaccaagggcccatcggtcttccccctggcgccctgctccaggagcacctccgagagcacagcggccctgggctgcctggtcaaggactacttccacgtgatcgactgagcgggctggcaaggcgcatagnn

SEQ ID NO: 232763 - DNA, 243 bp, Homo sapiens
  misc_feature: GYAE6OF02JY3B5.38.35.D02.1.454.CMB.1.raw
  modified_base (235)..(243): a, c, t, g, unknown or other
  misc_feature (235)..(243): n is a, c, g, or t
tcagtcgatcacgtcacgaccggtgctcgatttagcacacgatagttgggtttgggggagttatgtctggggccagggaaccctggccaccgtctcctcagcctccaccaagggcccatcggtcttcccctggcgccctgctccaggagcacctccgagagcacagcggccctgggctgcctggtcaaggactacttccacgtgatcgactgagcgggctggcaaggcgcatagnnnnnnnnn

SEQ ID NO: 232764 - DNA, 248 bp, Homo sapiens
  misc_feature: GYAE6OF02IJQ69.38.35.D02.1.454.CMB.1.raw
  modified_base (237)..(248): a, c, t, g, unknown or other
  misc_feature (237)..(248): n is a, c, g, or t
tcagtcgatcacgtcacgaccggtgctcgatttagcacacgatagttggggtttgggggagttatgtctggggccagggaaccctggccaccgtctcctcagcctccaccaagggcccatcggtcttccccctggcgccctgctccaggagcacctccgagagcacagcggccctgggctgcctggtcaaggactacttccacgtgatcgactgagcgggctggcaaggcgcatagnnnnnnnnnnnn

SEQ ID NO: 232765 - DNA, 206 bp, Homo sapiens
  misc_feature: GYAE6OF02G9O3V.38.35.D02.1.454.CMB.1.raw
  modified_base (200)..(206): a, c, t, g, unknown or other
  misc_feature (200)..(206): n is a, c, g, or t
tcagtcgatcacgtcacgaccggtgctcgatttagcacacgatagttgggtttgggtgccgaagttgctggaggtcacggtcaccacgctgctgagggagtagagtcctgaggactgtaggacagccgggaaggtgtgcacgccgctggtcaaggactacttccacgtgatcgactgagcgggctggcaaggcgcatagnnnnnnn

SEQ ID NO: 232766 - DNA, 198 bp, Homo sapiens
  misc_feature: GYAE6OF02F1LBN.38.35.D02.1.454.CMB.1.raw
  modified_base (198)..(198): a, c, t, g, unknown or other
  misc_feature (198)..(198): n is a, c, g, or t
tcagtcgatcacgtcacgaccggtgctcgatttagcacacgatagttgggttttgggggaagaggaagactgacggcccatcggtcttccccctggcgccctgctccaggagcacctccgagagcacagcggccctgggctgcctggtcaaggactacttccacgtgatcgactgagcgggctggcaaggcgcatagn

SEQ ID NO: 232767 - DNA, 236 bp, Homo sapiens
  misc_feature: GYAE6OF02GF1F9.38.35.D02.1.454.CMB.1.raw
  modified_base (236)..(236): a, c, t, g, unknown or other
  misc_feature (236)..(236): n is a, c, g, or t
tcagtcgatcacgtcacgaccggtgctcgatttagcacacgatagttgggtttgggggagttatgtctggggccagggaaccctggccaccgtctcctcagcctccaccaagggcccatcggtcttccccctggcgccctgctccaggagcacctccgagagcacagcggccctgggctgcctggtcaaggactacttccacgtgatcgactgagcgggctggcaaggcgcatagn

SEQ ID NO: 232768 - DNA, 256 bp, Homo sapiens
  misc_feature: GYAE6OF02IVZPZ.38.35.D02.1.454.CMB.1.raw
  modified_base (238)..(256): a, c, t, g, unknown or other
  misc_feature (238)..(256): n is a, c, g, or t
tcagtcgatcacgtcacgaccggtgctcgatttagcacacgataggttggggtttggggggagttatgtctggggccagggaaccctggccaccgtctcctcagcctccaccaagggcccatcggtcttccccctggcgccctgctccaggagcacctccgagagcacagcggccctgggctgcctggtcaaggctacttccacgtgatcgactgagcgggctggcaaggcgcatagnnnnnnnnnnnnnnnnnnn

SEQ ID NO: 232769 - DNA, 529 bp, Homo sapiens
  misc_feature: GYAE6OF02G4XH6.38.35.D02.1.454.CMB.1.raw
  modified_base (288)..(288): a, c, t, g, unknown or other
  misc_feature (288)..(288): n is a, c, g, or t
  modified_base (458)..(458): a, c, t, g, unknown or other
  misc_feature (458)..(458): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtctgggggagtcgtggtccagcctggggggtccctgagactctcctgtgcagcctctggattcaacttcaaaaattntgggatgcactgggtccgccaggctccaggcaaggggctgggagtgggtggcaactatatcatatgatggtaagttttaaagactatgcggactccgtgagggccgatcacatctcagagacaattccaagacgcacactctatttgactaaatgaacagccgtagggancgtagaaggacacggctgtacttattactgtgacgaaagacccggcctacgtagtcgggtcgggagttacg

SEQ ID NO: 232770 - DNA, 546 bp, Homo sapiens
  misc_feature: GYAE6OF02I265Z.38.35.D02.1.454.CMB.1.raw
  modified_base (401)..(401): a, c, t, g, unknown or other
  misc_feature (401)..(401): n is a, c, g, or t
  modified_base (419)..(419): a, c, t, g, unknown or other
  misc_feature (419)..(419): n is a, c, g, or t
  modified_base (455)..(455): a, c, t, g, unknown or other
  misc_feature (455)..(455): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggtttcctcgtagctcttttaagaggtgtccagtgtcagatgcagctggtggagtctgggggagtcgtggtccagcctggggggtccctgagactctcctgtgcagcctctggattcaacttcaaaaattatgggatgcactgggtccgcaggctccaggcaaggggctggagtgggtggcaactatatcatatgatggaagttttaaagactatgcggactcgtgaagggccgattcaccatcnccagagacaatccaagancacactctatttcactaaatgaacagccgtgggacncgtaggaggacaccgggactgttaccgtaatttaccgtgtcgtacgaaaggtaacccggcccttacgtagtcggggttcggggagtttacg

SEQ ID NO: 232771 - DNA, 526 bp, Homo sapiens
  misc_feature: GYAE6OF02HTO6B.38.35.D02.1.454.CMB.1.raw
  modified_base (288)..(288): a, c, t, g, unknown or other
  misc_feature (288)..(288): n is a, c, g, or t
  modified_base (453)..(453): a, c, t, g, unknown or other
  misc_feature (453)..(453): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtctgggggagtcgtggtccagcctggggggtccctgagactctcctgtgcagcctctggattcaacttcaaaaattntgggatgcactgggtccgccaggctccaggcaaggggctggaggtgggtggcaactatatcatatgatggaagttttaaagactatgcggactccgtagaagggcattcacatctccagagacaatccaagagcacactctatttgcaaatgaacagcctgggancgtgaaggacacggctgtctaattacctggtgacgaaagacccggtcctctaggtcgggtcggggtattacgg

SEQ ID NO: 232772 - DNA, 526 bp, Homo sapiens
  misc_feature: GYAE6OF02F5KU2.38.35.D02.1.454.CMB.1.raw
  modified_base (288)..(288): a, c, t, g, unknown or other
  misc_feature (288)..(288): n is a, c, g, or t
  modified_base (412)..(412): a, c, t, g, unknown or other
  misc_feature (412)..(412): n is a, c, g, or t
  modified_base (448)..(448): a, c, t, g, unknown or other
  misc_feature (448)..(448): n is a, c, g, or t
  modified_base (458)..(458): a, c, t, g, unknown or other
  misc_feature (458)..(458): n is a, c, g, or t
  modified_base (470)..(470): a, c, t, g, unknown or other
  misc_feature (470)..(470): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtctgggggagtcgtggtccagcctggggggtccctgagactctcctgtgcagcctctggattcaacttcaaaaattntgggatgcactgggtccgcaggctcaggcaaggggctggagtgggtgcaactatatcatatgatggtaagttttaaagactatggcggtactccgtagaacgggccgattcaccatctccaganacaatccaagagcacactctattgactaaatgaacngccgtggganctgagacacggntgtctattactgtagacgaaacgaccggtcctagtagtcggggtacgggtattacg

SEQ ID NO: 232773 - DNA, 242 bp, Homo sapiens
  misc_feature: GYAE6OF02GX443.38.35.D02.1.454.CMB.1.raw
  modified_base (235)..(242): a, c, t, g, unknown or other
  misc_feature (235)..(242): n is a, c, g, or t
tcagtcgatcacgtcacgaccggtgctcgatttagcacacgatagttgggtttgggggagttatgtctggggccagggaaccctggccaccgtctcctcagcctccaccaagggcccatcggtcttcccctggcgccctgctccaggagcacctccgagagcacagcggccctgggctgactggtcaaggactacttccacgtgatcgactgagcgggctggcaaggcgcatagnnnnnnnn

SEQ ID NO: 232774 - DNA, 247 bp, Homo sapiens
  misc_feature: GYAE6OF02HIRTE.38.35.D02.1.454.CMB.1.raw
  modified_base (148)..(148): a, c, t, g, unknown or other
  misc_feature (148)..(148): n is a, c, g, or t
  modified_base (230)..(230): a, c, t, g, unknown or other
  misc_feature (230)..(230): n is a, c, g, or t
  modified_base (235)..(247): a, c, t, g, unknown or other
  misc_feature (235)..(247): n is a, c, g, or t
tcagtcgatcacgtcacgaccggtgctcgatttagcacacgatagttgggtttgggggagttatgtctggggccagggaaccctggccaccgtctcctcagcctccaccaagggcccatcggtcttcccctggcgcctgctccaggancacctccgagagcacagcggccctgggctgcctggtcaaggactacttccacgtgatcgactggagcgggctggcaaggcgnatagnnnnnnnnnnnnn

SEQ ID NO: 232775 - DNA, 550 bp, Homo sapiens
  misc_feature: GYAE6OF02IPQ24.38.35.D02.1.454.CMB.1.raw
  modified_base (469)..(469): a, c, t, g, unknown or other
  misc_feature (469)..(469): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtctgggggagtcgtggtccagcctggggggtccctgagactctcctgtgcagcctctggattcaacttcaaaaattatgggatgcactgggtccgcaggctccaggcaaggggctggagtgggtggcaactatatcatatgatggaattttaaagactatgcggtactccggtagaacgggccgattacaccatctccagagacaacttccaaagacgacaacactcttatttgacaaatgaaacagacctagggacncgtagagacacggctggtactattacgtgtacgacggaaacgacccggtcccttcgtaggtcggggtacggggagttacgg

SEQ ID NO: 232776 - DNA, 239 bp, Homo sapiens
  misc_feature: GYAE6OF02FUPE3.38.35.D02.1.454.CMB.1.raw
  modified_base (235)..(239): a, c, t, g, unknown or other
  misc_feature (235)..(239): n is a, c, g, or t
tcagtcgatcacgtcacgaccggtgctcgatttagcacacgatagttgggtttgggggagttatgtctggggccagggaaccctggccaccgtctcctcagcctccaccaagggcccatcggtcttcccctggcgccctgctccaggagcacctccgagagcacagcggccctgggctgcctggtcaaggactacttccacgtgatcgactgagcgggctggcaaggcgcatagnnnnn

SEQ ID NO: 232777 - DNA, 241 bp, Homo sapiens
  misc_feature: GYAE6OF02I15I5.38.35.D02.1.454.CMB.1.raw
  modified_base (236)..(241): a, c, t, g, unknown or other
  misc_feature (236)..(241): n is a, c, g, or t
tcagtcgatcacgtcacgaccggtgctcgatttagcacacgatagttgggtttgggggaggttatgtctggggccagggaaccctggccaccgtctcctcagcctccaccaagggcccatcggtcttcccctggcgccctgctccaggagcacctccgagagcacagcggccctgggctgcctggtcaaggactacttccacgtgatcgactgagcgggctggcaaggcgcatagnnnnnn

SEQ ID NO: 232778 - DNA, 634 bp, Homo sapiens
  misc_feature: GYAE6OF02FVFXP.38.35.D02.1.454.CMB.1.raw
  modified_base (427)..(427): a, c, t, g, unknown or other
  misc_feature (427)..(427): n is a, c, g, or t
tcagtcgatcacgtcacgaccggtgctcgatttagcacacgatagttgggtttggggggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtctgggggagtcgtggtccagcctggggggtccctgagactctcctgtgcagtctctggattaaccttagtgactatgccatgatctgggtccgccaggctccgaggggaacgggctgggagtgggtctcagctaaattaagtgggtaggggtgattcaccatattacgcagacgtccgggtgggggccgttcaccatccaccagacacaactcccgaggacncacactatactcctaactaaatcgaccaacagtaccctagaacggaggtccgaagggaccgacccggggccgttaggttaatttaagtttgggtacgacggaacggtacgtaaccgttacccccggtaaacgggttaccgaaccccgttacccggtttggggtttaccggttacgtttttttacgggacgttttttcccgtacgggg

SEQ ID NO: 232779 - DNA, 240 bp, Homo sapiens
  misc_feature: GYAE6OF02GTHHS.38.35.D02.1.454.CMB.1.raw
  modified_base (235)..(240): a, c, t, g, unknown or other
  misc_feature (235)..(240): n is a, c, g, or t
tcagtcgatcacgtcacgaccggtgctcgatttagcacacgatagttgggtttgggggaggttatgtctgggccagggaaccctggccaccgtctcctcagcctccaccaagggcccatcggtcttcccctggcgccctgctccaggagcacctccgagagcacagcggccctgggctgcctggtcaaggactacttccacgtgatcgactgagcgggctggcaaggcgcatagnnnnnn

SEQ ID NO: 232780 - DNA, 571 bp, Homo sapiens
  misc_feature: GYAE6OF02I6G29.38.35.D02.1.454.CMB.1.raw
  modified_base (288)..(288): a, c, t, g, unknown or other
  misc_feature (288)..(288): n is a, c, g, or t
  modified_base (306)..(306): a, c, t, g, unknown or other
  misc_feature (306)..(306): n is a, c, g, or t
  modified_base (348)..(348): a, c, t, g, unknown or other
  misc_feature (348)..(348): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggtttcctcgtagctcttttaagaggtgtccagtgtcagatgcagctggtggagtcgtgggggagtcgtggtccagcctggggggtccctgagactctcctgtgcagcctctggattcaacttcaaaaattntgggatgcactgggtccncaggctccaggcaagggctggagtgggtgcaatatatcatangagtggtaaagttttaacgacttagtgaccggactccggtagaacgggcctattcaacctatcctacgagagacaattccaaagtcgacactactacttattagactaaatgaaaccagtacccgtagggaactcgtaggaacggaccgacggtctagtaccgttaattacgtgtacgacgaaacgacccggtcctagtaggtcggggtacgggtattaacgg

SEQ ID NO: 232781 - DNA, 243 bp, Homo sapiens
  misc_feature: GYAE6OF02I11CJ.38.35.D02.1.454.CMB.1.raw
  modified_base (236)..(243): a, c, t, g, unknown or other
  misc_feature (236)..(243): n is a, c, g, or t
tcagtcgatcacgtcacgaccggtgctcgatttagcacacgatagttgggtttgggggagttatgtctggggccagggaaccctggccaccgtctcctcagcctccaccaagggcccatcggtcttccccctggcgccctgctccaggagcacctccgagagcacagcggccctgggctgcctggtcaaggactacttccacgtgatcgactgagcgggctggcaaggcgcatagnnnnnnnn

SEQ ID NO: 232782 - DNA, 596 bp, Homo sapiens
  misc_feature: GYAE6OF02HCXT1.38.35.D02.1.454.CMB.1.raw
  modified_base (437)..(437): a, c, t, g, unknown or other
  misc_feature (437)..(437): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccagccgtggggggtccctgagactctcctgtgcagcctctggattcaacttacaaaaattatgggatgcacgtggggtcccgccaggcctccgaggcgaaggggctgggagtgggtggcaactatatcatatgataggtaaagtttaaagactatgacggactccgtgaacgggcgatcaccatctaccagacgacaacttccaagngacaactactactatttcgactaaatacgaaacagacccgtagggacgtcgtaggaacgggacaccgggtcttaggtaccgttaatttacgttaggtacggaacggaaacggaccccggtcccttcgttaacggtcgggggttacggggtagtttacgg

SEQ ID NO: 232783 - DNA, 591 bp, Homo sapiens
  misc_feature: GYAE6OF02HNYZK.38.35.D02.1.454.CMB.1.raw
  modified_base (487)..(487): a, c, t, g, unknown or other
  misc_feature (487)..(487): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccagccgtgggggtccctgagactctcctgtgcagcctctggattcaacttcaaaaattatgggatgcacgtggggtccgccgaggcctccgaggcgaaggggctgggagtgggtggcaactatatcatatgataggtaagttttaaagactatggacggactccggtaggaacgggccgtattccaccatcctaccagacacaacttaccaagacgcaacactacttattgacaaatacgaacagaccgtagggacncgtaggaacggaccgacgggcttaggtacttaacttacgtaggtacggaacgaaacggtacccggtccctacggttacggtcgggggttacggggtagttacgg

SEQ ID NO: 232784 - DNA, 242 bp, Homo sapiens
  misc_feature: GYAE6OF02JG7AE.38.35.D02.1.454.CMB.1.raw
  modified_base (236)..(242): a, c, t, g, unknown or other
  misc_feature (236)..(242): n is a, c, g, or t
tcagtcgatcacgtcacgaccggtgctcgatttagcacacgatagttgggtttgggggtaggttagtgtctgggccagggaaccctggccaccgtctcctcagcctccaccaagggcccatcggtcttcccctggcgccctgctccaggagcacctccgagagcacagcggccctgggctgcctggtcaaggctacttccacgtgatcgactgagcgggctggcaaggcgcatagnnnnnnn

SEQ ID NO: 232785 - DNA, 245 bp, Homo sapiens
  misc_feature: GYAE6OF02HNKG0.38.35.D02.1.454.CMB.1.raw
  modified_base (235)..(245): a, c, t, g, unknown or other
  misc_feature (235)..(245): n is a, c, g, or t
tcagtcgatcacgtcacgaccggtgctcgatttagcacacgatagttgggtttggggggagttatgtctggggccagggaaccctggccaccgtctcctcagcctccaccaagggcccatcggtcttcccctggcgccctgctccaggagcacctccgagagcacagcggccctgggctgcctggtcaaggctacttccacgtgatcgactgagcgggctggcaaggcgcatagnnnnnnnnnnn

SEQ ID NO: 232786 - DNA, 705 bp, Homo sapiens
  misc_feature: GYAE6OF02IM8PD.38.35.D02.1.454.CMB.1.raw
  modified_base (272)..(272): a, c, t, g, unknown or other
  misc_feature (272)..(272): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtctgggggagtcgtggtccaggccgtggggggtccctgagactctccgtgtgcagcctcgnggattcaacttacaaaaattgtgggaatggtcacgtcgggtccgcgaggcctccgaggcgaaggggctaggaggtgggtaggcaaacgtacatcgaatagtgagtagggtaaaagttttaaacgacgttagtacggaccgggtacttaccgggtaggaaacgggtccgtaacgtttaccaaccgtaacttccgtacccgaaggacgtaaacgtaaacgtttacccgaaaggtacgacctaaccaaccttaccgttaagtttacgaacctaaaagtacgaaacctaacgtaccgttacgggaaacgttcccgaagggtaaacggaaccgaaccgggtcgttaacggttacgttaaacgttacgtacggttaacggaccgaaaacgggtaacccgcccgttacgtaacggtacggggttaccgggtagttaccgg

SEQ ID NO: 232787 - DNA, 522 bp, Homo sapiens
  misc_feature: GYAE6OF02FMVH3.38.35.D02.1.454.CMB.1.raw
  modified_base (418)..(418): a, c, t, g, unknown or other
  misc_feature (418)..(418): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtctgggggagtcgtggtccagcctggggggtccctgagactctcctgtgcagcctctggattcaacttcaaaaattatgggatgcactgggtccgcaggctccaggcaaggggctggagtgggtgacaactatatcatatgatggaattttaaagactatgcggactccgtgagggccattcacatctccagagacaattccaagancacactctattgacaaatgaacagcctgggacgctagacgacacggctgtcttattactgtgacgaaagacccggtccctagtagtcggggttcgggagttacg

SEQ ID NO: 232788 - DNA, 239 bp, Homo sapiens
  misc_feature: GYAE6OF02IA3P8.38.35.D02.1.454.CMB.1.raw
  modified_base (236)..(239): a, c, t, g, unknown or other
  misc_feature (236)..(239): n is a, c, g, or t
tcagtcgatcacgtcacgaccggtgctcgatttagcacacgatagttgggtttgggggagttatgtctggggccagggaaccctggccaccgtctcctcagcctccaccaagggcccatcggtcttccccctggcgccctgctccaggagcacctccgagagcacagcggccctgggctgcctggtcaaggactacttccacgtgatcgactgagcgggctggcaaggcgcatagnnnn

SEQ ID NO: 232789 - DNA, 595 bp, Homo sapiens
  misc_feature: GYAE6OF02FU9M3.38.35.D02.1.454.CMB.1.raw
  modified_base (290)..(290): a, c, t, g, unknown or other
  misc_feature (290)..(290): n is a, c, g, or t
  modified_base (507)..(507): a, c, t, g, unknown or other
  misc_feature (507)..(507): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccagccgtgggggtccctgagactctcctgtgcagcctctggattcaacttacaaaaattntgggatgcacgtcgggtccgccgaggcctccgaggcgaaggggctgggaggtgggtggcaactatatcatatgagtaggtaaagttttaaagacttagtggacggtacgtccgtaggaacgggccgtaattccaacctattcctaccagacgaactaacttaccgaaagacgaccactacctcttatttacactaaatgaacacgtccgtagggacncgtagacggacgacggcgtgtacttaattacgtggtacgacgaaacggacccgtccgttacgtacggtcggggtacgggtagttacgg

SEQ ID NO: 232790 - DNA, 566 bp, Homo sapiens
  misc_feature: GYAE6OF02GA1YG.38.35.D02.1.454.CMB.1.raw
  modified_base (219)..(219): a, c, t, g, unknown or other
  misc_feature (219)..(219): n is a, c, g, or t
tcagtcgatcacgtcacgaccggtgctcgatttagcacacgatagttgggtttgggggggaagaggaagactgacggtcctgccacaggtggtgctgggcacggtgggcactcgacacaacatttgcgctcaactgtcttgtccagcctgggggtccctgagactctcctgtgcagcctctggattcaacttcaaaaattatgggatgcactgggtccnccaggctccaggcaaggggctggagtgggtggcaactatatcatatgataggtaagttttaaagacttagtgcggactccggtgaacgggccgattcaccatctccagagacaattccaagagcacactactattgacaaatgaacagccgtgggagctgacggacacggtctgtactaattacgtgtacgacgaaacgaccgccctacgtagtgggtcgggtagttatgtcgtgggccagggacctggacctaccgtctccgtcacgtcctaccaccgaacggccctacgtccggtcctccccgtggcccgtcccgtcgcctccgagacgccgtaccgtaccgacg

SEQ ID NO: 232791 - DNA, 612 bp, Homo sapiens
  misc_feature: GYAE6OF02IQHIU.38.35.D02.1.454.CMB.1.raw
  modified_base (367)..(367): a, c, t, g, unknown or other
  misc_feature (367)..(367): n is a, c, g, or t
tcagtcgatcacgtcacgaccggtgctcgatttagcacacgatagttgggtttggggggaagaggaagactgacggtcctgccacaggtggtgctgggcacggtgggcactcgacacaacatttgcgctcaactgtcttgtccagcctgggggtccctgagactctcctgtgcagcctctggattcaacttcaaaaattatgggatgcactgggtccgccaggctccaggcaaggggctggagtgggtggcaactatatcatatgatggaattttaaagactatgcggactccgtgaaggccgattcaccatctccagagacaattccaagagcaacactctatttgcaaatgaaacagcctggganctgaggacacggctgtctattaactgtgacgaaaagaaccggccctactaagtgggtacggggtagtttagtggttcgtggggacccaaggggtaaacccctgggacccgaacccgtccttacccgttcaacgtccctacccgaaccgaaacgggcccctaaggttcccggttaccctttccccccgtagggcccgtccccgtgcccgttacccgaacggtacggccctacccgtcccggaacgg

SEQ ID NO: 232792 - DNA, 240 bp, Homo sapiens; identical to SEQ ID NO: 232638
  misc_feature: GYAE6OF02HO5W5.38.35.D02.1.454.CMB.1.raw
  modified_base (235)..(240): a, c, t, g, unknown or other
  misc_feature (235)..(240): n is a, c, g, or t

SEQ ID NO: 232793 - DNA, 245 bp, Homo sapiens
  misc_feature: GYAE6OF02IJ44O.38.35.D02.1.454.CMB.1.raw
  modified_base (236)..(245): a, c, t, g, unknown or other
  misc_feature (236)..(245): n is a, c, g, or t
tcagtcgatcacgtcacgaccggtgctcgatttagcacacgatagttgggtttgggggagttatgtctggggccagggaaccctggtcaccgtctcctcagcctccaccaagggcccatcggtcttccccctggcaccctcctccaagagcacctctgggggcacagcggccctgggctgcctggtcaaggactacttccacgtgatcgactgagcgggctggcaaggcgcatagnnnnnnnnnn

SEQ ID NO: 232794 - DNA, 214 bp, Homo sapiens
  misc_feature: GYAE6OF02GRVAW.38.35.D02.1.454.CMB.1.raw
  modified_base (198)..(214): a, c, t, g, unknown or other
  misc_feature (198)..(214): n is a, c, g, or t
tcagtcgatcacgtcacgaccggtgctcgatttagcacacgatagttgggtttgggggaagaggaagactgacggcccatcggtcttccccctggcgccctgctccaggagcacctccgagagcacagcggccctgggctgcctggtcaaggactacttccacgtgatcgactgagcgggctggcaaggcgcataggnnnnnnnnnnnnnnnnn

SEQ ID NO: 232795 - DNA, 244 bp, Homo sapiens
  misc_feature: GYAE6OF02JZMFY.38.35.D02.1.454.CMB.1.raw
  modified_base (234)..(244): a, c, t, g, unknown or other
  misc_feature (234)..(244): n is a, c, g, or t
tcagtcgatcacgtcacgaccggtgctcgatttagcacacgatagttgggtttgggggagttatgtctgggccagggaaccctggccaccgtctcctcagcctccaccaagggcccatcggtcttcccctggcgccctgctccaggagcacctccgagagcacagcggccctgggctgcctggtcaaggactacttccacgtgatcgactgagcgggctggcaaggcgcatagnnnnnnnnnnn

SEQ ID NO: 232796 - DNA, 640 bp, Homo sapiens
  misc_feature: GYAE6OF02IPYKD.38.35.D02.1.454.CMB.1.raw
  modified_base (299)..(299): a, c, t, g, unknown or other
  misc_feature (299)..(299): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagcttcttttaagaggtgtccagtgtcagatgcagctggtggagtcgtggggagtcgtggtccgaggccgtggggggtccctggacgactctccgtgtgcaggcctcgtggattcgaacttacaaaaattntgggaatcgcacgtcggtccgcgaggcctcgaggcgaaggggctgggagtgggtgacaacgtatactcaagtatgaagtaggtaaagttttaaagacttaagtcggacggtactcggtaggaacgggccgtacttccaaccgtatcctcgaagacgaactaacttacaaagacgtacgaactacttactatttacgaactaaacgtacgaaacgacgtaccgtagggacacgtagaacggacgaccggtctacgttacgtaacttacgtacgggtacgtaaccggaaaacggaccccggtccgttaacgtacgggttacggggtacgggtaagtttacggg

SEQ ID NO: 232797 - DNA, 674 bp, Homo sapiens
  misc_feature: GYAE6OF02IN6EI.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaacttgggttttcctcgtagctcttttaagaggtgtccagtgtcagatgcagctggtggagtcgtgggggagtcgtggtccagccgtggggggtccctggacgactctcctgtgcagcctctggacttcaacttacaaaattgtggatgcacgtcgggtccgcgacggctccgaggcgaaggggctagggagtgggtggacaactatactcatatgagttaggtaaagttttaaagacttagtacggacggtaccgttccgggtaggaacgggccgtacgttaccaacctacttcctaccaacgacgtaactaacgttacccgaaagtaccgaccaaccgtaaccttactttaacgtttacgtaactaaaagtacgtaaaccgtagtacccgttagggaacgtaccgtaggtaaccggacgtaccggtaccgttaggttaccttaagttaacgttcggtacgtaaccggaaacggtacccggtacccgttacgttacgggtacggggttacgggtagttacgg

SEQ ID NO: 232798 - DNA, 569 bp, Homo sapiens
  misc_feature: GYAE6OF02IXYWO.38.35.D02.1.454.CMB.1.raw
  modified_base (289)..(289): a, c, t, g, unknown or other
  misc_feature (289)..(289): n is a, c, g, or t
  modified_base (342)..(342): a, c, t, g, unknown or other
  misc_feature (342)..(342): n is a, c, g, or t
  modified_base (350)..(350): a, c, t, g, unknown or other
  misc_feature (350)..(350): n is a, c, g, or t
  modified_base (358)..(358): a, c, t, g, unknown or other
  misc_feature (358)..(358): n is a, c, g, or t
  modified_base (454)..(454): a, c, t, g, unknown or other
  misc_feature (454)..(454): n is a, c, g, or t
  modified_base (459)..(459): a, c, t, g, unknown or other
  misc_feature (459)..(459): n is a, c, g, or t
  modified_base (463)..(463): a, c, t, g, unknown or other
  misc_feature (463)..(463): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtctgggggagtcgtggtccagccgtggggggtccctgagactctcctgtgcagcctctggattcaacttcaaaaattntgggatgcacgtgggtccgccaggctccgaggcgaaggggctgggaggtgggnggcaatanatcaatangatggtaatttaaagactagtgcggactccgtgaaggtccgtattcaccatcctccagacgactaagttaccaagacgcaacacttactattcganaaatnaacngaccgtgggactcgtagacggacacggtctaggttacctaagttacgtaggtacgacggaaacggtacccggcccttacgtagggtcggggttacgggatttacgg

SEQ ID NO: 232799 - DNA, 237 bp, Homo sapiens; identical to SEQ ID NO: 232632
  misc_feature: GYAE6OF02G438D.38.35.D02.1.454.CMB.1.raw
  modified_base (235)..(237): a, c, t, g, unknown or other
  misc_feature (235)..(237): n is a, c, g, or t

SEQ ID NO: 232800 - DNA, 591 bp, Homo sapiens
  misc_feature: GYAE6OF02G9MJ5.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccagccgtggggggtccctgagactctcctgtgcagcctcgtggattcaacttcaaaaattatgggatgcacgtgggtccgccgaggctccgaggccgaaggggctgggagtgggtggacaactatatcatatgataggtaaagttttaaagacttagtggcggactccgtaggacggggccgtattccaaccatcctaccgagacgaactaacttaccaaggacgaccaacacctactatttgactaaagtacgaacagccgtagggacgcgtaggacggacacggtctgtacttacttacgttgtacgacgtaaacggacccggtcctacgttacggtcggggttacggggtagttacgg

SEQ ID NO: 232801 - DNA, 791 bp, Homo sapiens
  misc_feature: GYAE6OF02H5HTL.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaacttggtttcctcgtagcttctttaagaggtgtccagtgtcagatgcagctggtggagtcgtggggagtcggtggtccagccgtgggggtccctgagactctcctgtcgcacgcctctggtacttacaacttaacaaaaattgtgggatgctacgtcgggtcccgccgaggcctccgaggaccgaaggggctagggacggttggggtcggactaaacgtattacgtactaagttagtaggtagttaagggtttaaaagttttaaaacgacgttaagttacgggaccggtaccgttaccgggtttagggaaaccggggtcccggttaaactttcccgaaccttaacgttccctacccgtaagaaacgtaaaccctaacgtttaacccaaaggaacgtaccaaccttaaccttcttaaacgttttacggaacctaaaaagttaccggaaacctacggtaacccggtaggggtaccgaccggttaggaaccgggtaccgtaaccgggtcgtttacggttaaccgtttaacgtttaccggttggtaaccgggtaaaccggtaaaaaccgggtacccccgggttaaccgttacccggtttaaggggttcgggggtttacccgggggttaagttttaacccgggg

SEQ ID NO: 232802 - DNA, 571 bp, Homo sapiens
  misc_feature: GYAE6OF02GKOIZ.38.35.D02.1.454.CMB.1.raw
  modified_base (289)..(289): a, c, t, g, unknown or other
  misc_feature (289)..(289): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtctgggggagtcgtggtccagccgtggggggtccctgagactctcctgtgcagcctctggattcaacttcaaaaattntggggatgcacgtgggtccgccaggcctccgaggcaaggggctgggagtgggtgcaactatatcatatgatggtaaagttttaagactatgccggactccggtaggaacgggccattccacctattctccgagacgaactaactcccaagacgacacactcttattagactaaatcggaacacgccgtagggactcgtagaggacacgggcttcgtacttattacgtgtacgaccggaaagtaccccggtcctacggttagtcgggggtacggtagttacgg

SEQ ID NO: 232803 - DNA, 653 bp, Homo sapiens
  misc_feature: GYAE6OF02F3LQN.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccagccgtggggggtccctggagactctcctatgcagcctctggattccaacttacaaaaattatagggatgcacgtgggtccgccgaggcctccgaggccgaaggggcctgggaggtgggtaggcaacgtatactcattatgataggtaaagttttaaagatagtgcggtactcgtaggaacgggtccgtaattccaacctactaccctacccgaagtaaccgaactaaacttaccccgaaaggtacgacccaacgtaccttacgttaatttacgaactaaacgtacgtaaactacggtccgtagggacacgtacggtacgggacacgggtctcggttacgtaacttaccgtaggtacgtaaccgggtaaaccgtacccggtcccgttacgtacgggtacgggggttacgggtacgttacggg

SEQ ID NO: 232804 - DNA, 549 bp, Homo sapiens
  misc_feature: GYAE6OF02I9K8M.38.35.D02.1.454.CMB.1.raw
  modified_base (408)..(408): a, c, t, g, unknown or other
  misc_feature (408)..(408): n is a, c, g, or t
  modified_base (411)..(411): a, c, t, g, unknown or other
  misc_feature (411)..(411): n is a, c, g, or t
  modified_base (416)..(416): a, c, t, g, unknown or other
  misc_feature (416)..(416): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggtttcctcgtagctctttaagaggtgtccagtgtcagatgcagctggtggagtctgggggagtcgtggtccagccgtggggggtccctgagactctcctgtgcagcctctggattcaacttacaaaaattatgggatgcacgtcggggtccgccaggcctccgaggcgaaggggctgggagtgggtggcaactatatcatatgataggtaaagttttaaagactatgcggactccgtagaggccgatcacntcncaganacaatccaagagacacactctatttagactaaatcgaaacacgccgtagggagcgtaggaggacacggctagtactattactgtcgacgaaacgacccggccttacgtacggtcggggtacgggtagttacgg

SEQ ID NO: 232805 - DNA, 599 bp, Homo sapiens
  misc_feature: GYAE6OF02G66RZ.38.35.D02.1.454.CMB.1.raw
  modified_base (317)..(317): a, c, t, g, unknown or other
  misc_feature (317)..(317): n is a, c, g, or t
  modified_base (329)..(329): a, c, t, g, unknown or other
  misc_feature (329)..(329): n is a, c, g, or t
tcagtcgatcacgtcacgaccggtgctcgatttagcacacgatagttgggtttggggggaagaggaagactgacggtcctgccacaggtggtgctgggcacggtgggcactcgacacaacatttgcgctcaactgtcttgtccagcctggggggtccctgagactctcctgtgcagcctctggattcaacttacaaaaattatgggatgcactgggtccgccaggctccaggcaaggggctggagtgggtggcaactatatcatatgatggtaagttttaagactatgcgactcgtgaaggcgatcacatctcaganacaattcaagancacactctattgacaaatgaacagccgtagggagctagacggacacggctgtactattactgtgacgaaacgaccggccctactacgtggggtacgggtagttagtggtcgtcgggaccgtaacgggacccgtcggtacccgtaccgttccgtcccgtacgtaccgtccctacccgaaccgtaccgggccctacgttcccggtcccgttcccccgtcggtcccgtccccgtcgcccgtaccgaccggtaccgccgtacccgtccgaacgg

SEQ ID NO: 232806 - DNA, 604 bp, Homo sapiens
  misc_feature: GYAE6OF02GR76T.38.35.D02.1.454.CMB.1.raw
  modified_base (337)..(337): a, c, t, g, unknown or other
  misc_feature (337)..(337): n is a, c, g, or t
  modified_base (373)..(373): a, c, t, g, unknown or other
  misc_feature (373)..(373): n is a, c, g, or t
tcagtcgatcacgtcacgaccggtgctcgatttagcacacgatagttgggtttgggggggaagaggaagactgacggtcctgccacaggtggtgctgggcacggtgggcactcgacacaacatttgcgctcaactgtcttgtccagcctggggggtccctgagactctcctgtgcagcctctggattcaacttcaaaaattatgggatgcactgggtccgccaggctccaggcaaaggggctggagtgggtggcaactatatcatatgatggtaaagttttaaagactatgcggactccgtgaagggccattcacatctccagagacaattccaagngacacactctattgacaaatgaaacagcctgggganctaggaggacacggctgtctattactgtgacgaaacgaaccgccctactagtgggtcgggagttagtggtcgtcggggaccgacggggaacccgtcgggacccacccggttcctccgtcaaccgccctaccaacccgaacgggcccaacgtcccggttcccttacccccgttcgggcccgtcccccgttggcccttacccgacgggtaccgcccgtaccctcccggaacgg

SEQ ID NO: 232807 - DNA, 262 bp, Homo sapiens
  misc_feature: GYAE6OF02I23AP.38.35.D02.1.454.CMB.1.raw
  modified_base (232)..(232): a, c, t, g, unknown or other
  misc_feature (232)..(232): n is a, c, g, or t
  modified_base (238)..(241): a, c, t, g, unknown or other
  misc_feature (238)..(241): n is a, c, g, or t
  modified_base (243)..(262): a, c, t, g, unknown or other
  misc_feature (243)..(262): n is a, c, g, or t
tcagtcgatcacgtcacgaccggtgctcgatttagcacacgatagttgggtttgggggagttatggtctggggccaggggaaccctggccaccgtctcctcagcctccaccaagggcccatcggtcttccccctggcgccctgctccaggacgcacctccgagagcacagcggccctgggctgcctggtcaaggctacttccagtgatcgactggagcgggctggcaaggcncatagnnnnannnnnnnnnnnnnnnnnnnn

SEQ ID NO: 232808 - DNA, 805 bp, Homo sapiens
  misc_feature: GYAE6OF02JFU0O.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagcttcttttaagaggtgtccagtgtcagatgcagctggtggagtcgtgggggatcgtggtccgaggccgtgggggtccctggacgtactcgtcctggtcgcaggccctcgtggtacttacaaccttaactaaaaattacgtgggaattcgactaacgttcgggtcccgaccgtacggcctccgaggaccggtaaggggtccgtagggaagggttcgggtacggaccgtaaacgttatacgtacgaagttacgtagtaagtaggttaaagttttaaacgacttaagtcggtaccggtaacttccgggtaacgggtaacgggtacccgtacgttacccgaaccgtaacgttacccgtacccgtaaaggtaacgtaaccgttaaaccgtttacccgaaaaggttaccggaacctaaacctaaccgtttaccttaaagtttaccgaaaccttaaaacgtaccgtaaaaccgtaccggtaccggtaacgggtaccgtaccgtaaggaaaccggtaccgaaccggtccgttaagttaccgttaacggttaaaccgttcgggttaaacgaacccggtaaaccggtaaccccggttcccgttaccgttaagggttacgggggtacccggttagtttaacccggg

SEQ ID NO: 232809 - DNA, 613 bp, Homo sapiens
  misc_feature: GYAE6OF02JI8DG.38.35.D02.1.454.CMB.1.raw
  modified_base (270)..(270): a, c, t, g, unknown or other
  misc_feature (270)..(270): n is a, c, g, or t
  modified_base (314)..(314): a, c, t, g, unknown or other
  misc_feature (314)..(314): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccagccgtggggggtccctggagactctcctgtgcagcctntggattcaacttacaaaaattgtgggatgactacgtgggtcccncgaggcctccgaggcgaaggggctgggaggtgggtgctaactatatcatagtgagtaggtaaagttttaagacttagtcgacggtactccggtaggaacgggccgtattaccacctatccgtaccagtacgaactaacttaccgaagtacgaccactaacctacttagttacgacaaactacgaacgacgtaccgtagggactcgtaggaacggtacgacggtcttgtacttattaccgtggtacgaaccggtaacgacccgtcccgttacgtacgggtcggggtacgggtagttacgg

SEQ ID NO: 232810 - DNA, 804 bp, Homo sapiens
  misc_feature: GYAE6OF02JT8IT.38.35.D02.1.454.CMB.1.raw
  modified_base (626)..(626): a, c, t, g, unknown or other
  misc_feature (626)..(626): n is a, c, g, or t
  modified_base (676)..(676): a, c, t, g, unknown or other
  misc_feature (676)..(676): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggtttcctcgtagctcttttaagaggtgtccagtgtcagatgcagctggtcggagtcgtgggggagtcgtggtcccagccgtggggggtcccctggagacgtcctcctggtcgcaggtccctctagggactttcaacctttacaaaaatttgtaggggacttgaccgtacggttcggggtacccgccgaggtccgtccgaacgggccggtaaagggggtccgttaggggaacgggtttggggacggggtacctaaaacgtttaacgtaacgttccaaaagtttagttggtaagtttaaggggtttaaaaacgttttttaaaaggaaccgtttaaagttcgggaacccgggttaaccttacccggggttaaggaaacgggggtccccggtaattccgtaaaccccgtgttaccttacccgaagtaacgaaaccgtaacttacccgaaaggaccgaccgaactaacccgttnttaacgtttacgaacaaacgtacgtaaaccgacgtaccggtaagggtacncgttagggaaccgaccgtaccggtacttcggttactaacgttttaccgtaggttacggaacccggtaaacgtaaccccggtccgttacccgttaagggttaccgggggttccggggtattttaccggg

SEQ ID NO: 232811 - DNA, 656 bp, Homo sapiens
  misc_feature: GYAE6OF02IX8LN.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggtttcctcgtagctcttttaagaggtgtccagtgtcagatgcagctggtggagtcgtgggggagtcgtggtccagccgtggggggtccctgagctctcctgtgcagcctctggattcaacttcaaaaattatgggatgactacgtggggtcccgccgaggcctccgaggcgaagggggcctgggagtggggtggacaacgtatatcgatatgattggaaagttttaaagactagtgcggtactccgtaggaagggccgtatcgacctatctccaagacgaactaattaccaagacgcactactacttatttacgactaaatacgaaacgtacggtcccgtaggggtaactcggtaggaacgggtaccgtaccgggtcgttaacggttccgttaaacgttttaccggtggtttaccggaaccgggtaaaccggtaacccccgggtcccctttaacggttaaccgggttcgggggttaaccgggggttagttttaaccggg

SEQ ID NO: 232812 - DNA, 574 bp, Homo sapiens
  misc_feature: GYAE6OF02GSML0.38.35.D02.1.454.CMB.1.raw
  modified_base (268)..(268): a, c, t, g, unknown or other
  misc_feature (268)..(268): n is a, c, g, or t
  modified_base (425)..(425): a, c, t, g, unknown or other
  misc_feature (425)..(425): n is a, c, g, or t
  modified_base (430)..(430): a, c, t, g, unknown or other
  misc_feature (430)..(430): n is a, c, g, or t
  modified_base (468)..(468): a, c, t, g, unknown or other
  misc_feature (468)..(468): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtctgggggagtcgtggtccagccgtggggggtccctgagactctcctgtgcagcctntggattcaacttacaaaaattgtgggatgcacgtgggtcccgccgaggcctccgaggcgaaggggctgggaggtgggtggacaactatatcatatgataggtaaagttttaaagattagtggacggtactccggtaggacgggccgatcaccatccncaganactaactacaagagacacactactattagactaaatanaacgacgccgtagggacgacgtaggaacggacgacggtcgtgttacgttattacgtggtacgacgaacgacccggtcctacgtaggtcgggtacgggtagttacgg

SEQ ID NO: 232813 - DNA, 671 bp, Homo sapiens
  misc_feature: GYAE6OF02GJ3JA.38.35.D02.1.454.CMB.1.raw
  modified_base (311)..(311): a, c, t, g, unknown or other
  misc_feature (311)..(311): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcggtggtccagccgtggggggtccctggagactctcctgtgcagcctctggattcaacttacaaaaattgtgggatgcacgtgggccnccgaggctccgaggcgaaggggcgtgggagtggggtgacaactatatcatatgaagtaggtaaagttttaaagactagtgacggtacttccggtaggaacgggtccgtaattaccgaacctactcccgtaccaacggaacgtaacctaacgttacccgaaaggtacgacctaacctaccttactttaagtttacgaactaaaacgttacggaaacctaacggtcccggtaggggaagtaccgtagggaacggaaccgaccgggtacttacggttacttaacgttaacgtcggtaacggaaccggtaaacggaccccggtcccttaccggtaggttacgggggttacggggtagtttacgg

SEQ ID NO: 232814 - DNA, 738 bp, Homo sapiens
  misc_feature: GYAE6OF02HOPU7.38.35.D02.1.454.CMB.1.raw
  modified_base (292)..(292): a, c, t, g, unknown or other
  misc_feature (292)..(292): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccagccgtggggggtcccctgagactctcctgtgcagcctctggattcaacttacaaaaattntggggatgactacgtcggggtccgccgaggcctccgaggccgaaaggggctgggaggtcgggtcggacaaacgtatacgtacagttatgaagttagggtaaaagttttaaaacgacttaagtacggaccggtaacgtccggtagggaacgggtaccgtaactttcccgaaacctacgttccctaccgtaaggaaacgtaacctaaacgttacccaaaggtaccgaaccaaccgtacctactttaaacgtttacgaacttaaaataccggtaaacacggtacccgtaggggtaacgtccggtaggaaacgggtacgtaaccggggtctttacggttaccgtttaagttaaccgttggtaaccgggtaaccggaaaaccgggttaaccccgggtaccccttagggtttaaccgggttacggggggttaccggggtagttttaaccggg

SEQ ID NO: 232815 - DNA, 634 bp, Homo sapiens
  misc_feature: GYAE6OF02JXKEI.38.35.D02.1.454.CMB.1.raw
  modified_base (296)..(296): a, c, t, g, unknown or other
  misc_feature (296)..(296): n is a, c, g, or t
  modified_base (353)..(353): a, c, t, g, unknown or other
  misc_feature (353)..(353): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccagccgtggggggtccctgacgactctcctgtgcagcctctggattcacctttagtaactattaangagctgggtccgccagcctcgagggaagggctggagtggtggccagcattaaccagntggacgtagaaaaatcgtatgtaggactgtggtaggaacgggtcctaagttccgacctagtcctccagacgacaaccggacaaacggaacctcctaacgtacggtcggactcgacaaccgagttacggaacccgggcccgttaggaacgacggggaccgaaccggaaccgtaacgggtctcggttaggttaacctttcgtacgggttacggccggaaacggtccccggaccccccaaggttacgggacggggtaccctaacggtagggttacgggaaccgg

SEQ ID NO: 232816 - DNA, 779 bp, Homo sapiens
  misc_feature: GYAE6OF02I7VRY.38.35.D02.1.454.CMB.1.raw
tcagtcgatcacgtcacgaccggtgctcgatttagcacacgatagttgggtttggggaggctctgggagaggagcccagcactagaagtcggcggagtttccattcggtgatcagcactgaacacagaggactcaccatggagtttgggctgaactgggtttcctcgtagctctttaagaggtgtccagtgtcagatgcagctggtggagtcgtgggggagtcgtggtccaggccgtggggggtccctggacgactctccgtgtcgcagcctcgtggattcaaccttactaaaaattgtgggatcgactacgttcgggtccgccgagggcctccgaggaccggaagggggccgtagggagggttggggtcggacctaacgtatatcgattagtgtagttaggtaaagttttaaagacgttagtaggccggtaacgttaccggtaggtaacgggggtccctaacgtttaccgaacccgtaacgttcccgttacccggaaggtaacggtaaacctaaaccgtttacccgaaacgggtacgtaaccgtaacccgtaacccttcccgtttaaagttttaccgaaccgtaaaaagttaccggaaaccgtaaccgggtacccgggttagggaaccggtacgttacgggaacgggtaaccgtacccgggtcttacggttacccgtttaagtttaccggtacggttacggaaacccggttaaaccggtaacccccgggtccttaaccggttaagggttccggggggttacggggtacttttaacggg

SEQ ID NO: 232817 - DNA, 623 bp, Homo sapiens
  misc_feature: GYAE6OF02IIITY.38.35.D02.1.454.CMB.1.raw
  modified_base (296)..(296): a, c, t, g, unknown or other
  misc_feature (296)..(296): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccagccgtggggggtcccctggagacctctccgtgtcgcagcctctggattcaacttacaaaaattntaggatgcacgtggtccgccaggcctccgaggcgaaggggctggaggtgggtggcaacgtatatcatgtagataggtaaagttttaaagacttaagtgcggtacttccggtaggaagggtccgtagttaccaccgtaagtccctacctaaggagaaacctaattacccgaaagtacgaccacgtaaccttacttaactttgacaaaagttcgaaaccacggtaccgtagggacacgttaggacgtaccgacggctacggttcctaagtttacctggtaacgtacgaaacgacccggtccttagtacggtggggtacgggtattacgg

SEQ ID NO: 232818 - DNA, 730 bp, Homo sapiens
  misc_feature: GYAE6OF02JVHWC.38.35.D02.1.454.CMB.1.raw
  modified_base (294)..(294): a, c, t, g, unknown or other
  misc_feature (294)..(294): n is a, c, g, or t
  modified_base (313)..(313): a, c, t, g, unknown or other
  misc_feature (313)..(313): n is a, c, g, or t
  modified_base (368)..(368): a, c, t, g, unknown or other
  misc_feature (368)..(368): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagcttcttttaagaggtgtccagtgtcagatgcagctggtggagtcgtggggagtcgtggtccgagccgtgggggtccctggacgactctcctgtgcagcctcgtggattcaacttacaaaaattntgggatgcacgtgggtccnccgaggcctccgaggaccgaaggggctgggagtgggtggacaacgtatatcatangtagtaggtaaagttttaaagactagtaggaccggtaaccgtcggtaggaacgggtccgtaagtttacccaaccgtacttaccgtaccaaggaaacgtaacctaaccgttaaccaaaacggacgtaaaccaactaacccgttacttaagttttaacgaacctaaaaggttacgaaaacccgtaggtaacccgttaggggaaccgtcgttaaggaaaccggttaccgaccgggtacctttacggtaccgtttaacgtttaacggtcggttaaccggaaaccggttaaaacccgggaaccccgggttaccccgttacggttaacgggttacggggggttaccgggggttaagttttaaccgggg

SEQ ID NO: 232819 - DNA, 694 bp, Homo sapiens
  misc_feature: GYAE6OF02IUEVA.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccgagccgtggggggtccctgacgctctcctgtgcagcctctggacttcctaaacttacaaaattgtagggatgcacgtcgggtccgccgaggccgtccgacggacgaaggggctgggagtgggtcgctaactatatacatataggtaagttaggttaaaagttttaaacgaacgttagtacgggtaccgtacgttccggtaagggaacgggtcccgtaactttacgaacctacgttcctacccgaagtaacgtaactaaaccgttacccgaaacgacgaccctaactaaccctttcttaagtttacgaacttaaaagtaccggaacgtacgtaccggtaacgggacgtaccgaggtaacgggaccgacggtcttacggtactttaagttaccgtacggtaaccgaccgtaaaaccgggaccccgttcccgttagtacgggtcgggggttagggtagttaccggg

SEQ ID NO: 232820 - DNA, 243 bp, Homo sapiens
  misc_feature: GYAE6OF02HW3AD.38.35.D02.1.454.CMB.1.raw
  modified_base (236)..(243): a, c, t, g, unknown or other
  misc_feature (236)..(243): n is a, c, g, or t
tcagtcgatcacgtcacgaccggtgctcgatttagcacacgatagttgggtttgggggagttatgtctggggccagggaaccctggccaccgtctcctcagcctccaccaagggcccatcggtcttcccctggcgccctgctccagggagcacctccgagagcacagcggccctgggctgcctggtcaaggactacttccacgtgatcgactgagcgggctggcaaggcgcatagnnnnnnnn

SEQ ID NO: 232821 - DNA, 779 bp, Homo sapiens
  misc_feature: GYAE6OF02IC8J5.38.35.D02.1.454.CMB.1.raw
  modified_base (173)..(173): a, c, t, g, unknown or other
  misc_feature (173)..(173): n is a, c, g, or t
  modified_base (205)..(205): a, c, t, g, unknown or other
  misc_feature (205)..(205): n is a, c, g, or t
  modified_base (258)..(258): a, c, t, g, unknown or other
  misc_feature (258)..(258): n is a, c, g, or t
  modified_base (322)..(322): a, c, t, g, unknown or other
  misc_feature (322)..(322): n is a, c, g, or t
  modified_base (401)..(401): a, c, t, g, unknown or other
  misc_feature (401)..(401): n is a, c, g, or t
  modified_base (423)..(423): a, c, t, g, unknown or other
  misc_feature (423)..(423): n is a, c, g, or t
tcagtcgatcacgtcacgaccggtgctcgatttagcacacgatagttgggtttggggtaggcgtcgtgggagaggaggcccgagcactagaagtcggcggagtttccattcggtgatcagcactgaacaccagaggacgtacaccatggagtttggcgtgaactggttttccngttagctcttttaagaggtgtccagtgtcagntgcagctggtggagtcgtggggatcggtggtccgagtccggtgggggtacccnggagaccgtcgtcctgtcggacagcctcgtggtcttcgaccttaacgtaaaattacgtagggtntacggtactacgttcggggttcccgccgtaaggcccgttccaggcgaacgggggtcgtagggagggttcgggtacggtnaaaccgtttagcgtaccgttanacgttaggacgttaggttaaacggtttaaacgtgtaacgtttgacccgggtttaactaccgggtttggaaaccgggtacgggtactttaacgtacccccaagttcccgtaccgtaaacggaagtaaacccggtatttaaccccgaaaggtaacccggtacaacccggttaacccttaacgggttacacggtttaacgaaaccgttaaggtaaacccacggtaacccgttagggacctacgggttaacgacgtaccggaagtcggtacttaccgtaagtttaccgtacggttacggaaccgtaaaccgtcccggtaacccgttcgttaccgggtacggtcggggtttaagtaacggg

SEQ ID NO: 232822 - DNA, 649 bp, Homo sapiens
  misc_feature: GYAE6OF02GYXIC.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccaggccgtggggggtccctgagctctcctgtgcagcctcgtggattcaacttacaaaaattgtgggatgctacgtcgggtccgccgaggcctccgaggacgaaggggctagggaggtgggtggacaactatatcagtatgaagtaggtaaagttttaaagactagtgcggtacgtcggtaggaacgggccgtattccaaccgtactccgtaccgaagaacgaacctaagtaccgaaagacaccaactacttacttaagtttcgaactaaacgtagtaaccgtacggtaccgtagggacgtacgtacgggaaacggacgtaccggacgtttcggtaccttacgttaaccgtggtacgtaaccggaaaccggtacccggtacccttaggtaacgggttacggggtaccgggtatttacggg

SEQ ID NO: 232823 - DNA, 630 bp, Homo sapiens
  misc_feature: GYAE6OF02IAL1K.38.35.D02.1.454.CMB.1.raw
  modified_base (316)..(316): a, c, t, g, unknown or other
  misc_feature (316)..(316): n is a, c, g, or t
tcagtcgatcacgtcacgaccggtgctcgatttagcacacgatagttgggtttgggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccagccgtgggggtccctgagcctctcctgtgcacgcctcgtggattcaacttacaaaaattgtagggatgctacgtcgggtcccnccgaggctccgaggacgaacggggctgggaggtgggtgactaatatatctatatgataggtaaagtttaaagcttaagtcgacggtactcggtaggaacgggctactcacctatccacgaagacgaactaacgtacaagacacgtaacacttactattacgaactaaatacgaacgacgtccgtagggtacgcgtaggaacggtaaccgtccggtacgttacgtacgttaacgttaccgtggtaaccggtaaccggaaaccggtacccggtacccgtacggtttacgggtacggggtacgggttaggtttacgg

SEQ ID NO: 232824 - DNA, 626 bp, Homo sapiens
  misc_feature: GYAE6OF02G7KA0.38.35.D02.1.454.CMB.1.raw
  modified_base (574)..(574): a, c, t, g, unknown or other
  misc_feature (574)..(574): n is a, c, g, or t
tcagtcgatcacgtcacgaccggtgctcgatttagcacacgatagttgggtttgggggggaagaggaagactgacggtcctgccacaggtggtgctgggcacggtgggcactcgacacaacatttgcgctcaactgtcttgtccagcctggggggtccctgagactctcctgtgcagcctctggattcaacttcaaaaattatgggatgcactgggtccgccaggctccgaggcaaggggctggagtgggtggcaactatatcatatgataggtaagttttaaagactatggcggactccggtagaacggggccgtattccaaccatcctccaagagaactaattccaagacgccacacttcttattcgacaaatcgaaacagtccgtaggggactcgtaggacggaccacggctgtacttattacgtgtacgaacgaaacgacccggtccctagtaggtcggggtacgggtattagtcggtcgtcggggaccgtacgggacccgtggccctaccgtcctccgtccgaccgccctaccgaccgaacggccctacgtcccggtcccttccccggnggccccgtcccgtcgccctaccggacggacccgccgtacccgtaccgaacgg

SEQ ID NO: 232825 - DNA, 703 bp, Homo sapiens
  misc_feature: GYAE6OF02IK5YS.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagcttcttttaagaggtgtccagtgtcagatgcagctggtggagtcgtggggagtcggtggtccaggccgtggggggtcccctggagactctccgtgtgcacgccttcgtcggtacttaccgaactttaacaaaaatttagtagggtaatgtaccacgtcgggtcccgccgtaggcctccgaggcgaagggcgtgggagtgggcgacaactatacgtcaatatgagttaggtaagttttaaagacttaagtgtacggtacgtcggtaggaacgggcctagttaccacctactcaccgagacgaactaacgtaccgaagactaccaacgtacttacttagtttagaactaaacgttagaaacctacggaccgtaagggaccgtacggtaacggacggaaccgtaccggtacgttacggtttaccgttaaacgtttaaccggtcggttaaaccggaaacccggtaaaacgggtaaccccggttacccgtttaaccgttaacggggttcgggggtttaccggggtacgtttaacgggg

SEQ ID NO: 232826 - DNA, 604 bp, Homo sapiens
  misc_feature: GYAE6OF02JJIG9.38.35.D02.1.454.CMB.1.raw
  modified_base (290)..(290): a, c, t, g, unknown or other
  misc_feature (290)..(290): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccagccgtggggggtccctgagactctcctgtgcagcctctggattcaacttcaaaaattntgggatgcacgtgggtccgccaggctccgaggcgaaggggctgggagtgggtggcaactatatcagtatgatggtaaagttttaaagacttaagtgacggactccggtaggaacggggccgtattccgacctatcctacccgaagacgaactaaacttacccgaaagacgaccaacgtaccttacttaatttcgacaaattgaaactagtcccgtagggactcgtaggaacggacgacgggtcttggtaccttaagttactggtcgaccgtaaagacccggtccgttacgtaggtcggggtcgggtagtttacg

SEQ ID NO: 232827 - DNA, 242 bp, Homo sapiens
  misc_feature: GYAE6OF02GWJTR.38.35.D02.1.454.CMB.1.raw
  modified_base (236)..(242): a, c, t, g, unknown or other
  misc_feature (236)..(242): n is a, c, g, or t
tcagtcgatcacgtcacgaccggtgctcgatttagcacacgatagttgggtttgggggagttatgtctggggccagggaaccctggccaccgtctcctcagcctccaccaagggcccatcggtcttccccctggcgccctgctccaggagcacctccgagagcacagcggccctgggctgcctggtcaaggactacttccacgtgatcgactgagcgggctggcaaggcgcatagnnnnnnn

SEQ ID NO: 232828 - DNA, 688 bp, Homo sapiens
  misc_feature: GYAE6OF02JG8EY.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggtttcctcgtagctcttttaagaggtgtccagtgtcagatgcagctggtggagtcgtggggagtcgtggtccaggtccgtcggggggtccctggacgactcctccgtgtgacacgtcctcgtggtattaccaacttacaaaaattgtagggatgacgcgtacgggtaccgcaggtcctaccgaggaccggaaggggcctagggaggttcggggaggactaaactataacgtacaattagtgaagttacggtaaaagttttaaagaacgtttaataggtacggtaaccgttcggtaaggtaacgggtaccggtaacgtttaccaaccctacgtaccttaacgaacgtaaacgaaccttaacgttaacccgaggaactacctaacctaccttacgttaacttcgaacgtaaatacgaaacgacgtacgtacggtacgtgtacggaacgtacgacgggtatacggtacttaacgtagttaaggtcgaacgaaacggtacccgtccctagtaccggtggggtacggttagtacgg

SEQ ID NO: 232829 - DNA, 676 bp, Homo sapiens
  misc_feature: GYAE6OF02GCX5U.38.35.D02.1.454.CMB.1.raw
  modified_base (271)..(271): a, c, t, g, unknown or other
  misc_feature (271)..(271): n is a, c, g, or t
  modified_base (293)..(293): a, c, t, g, unknown or other
  misc_feature (293)..(293): n is a, c, g, or t
tcagtcgatcacgtcacgaccggtgctcgatttagcacacgatagttgggtttgggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccagccgtcggggggtccctggagactctctgtgcagcctntggattcaacttacaaaaattntgggatgctacgtcgggtccgcgaggctccgaggcgaagggggctagggaggtggggtcggactaacgtatatcatatgtaagtaggtaaagttttaaaagacttaagtcggaccggtactaccgggtagggaaccgggccgtacttaccaaccgtactccctacgacggtaacgaactaaacgttacccaaaggaccgtaccaacctaccttacgttactttagaactaaaagtacgaaacgacgtccggtgggtaagccgtaggaacggtacgaccgggtcttacgtaccttaagttaccgtgggttaaccggaaccggtaaaacggtacccggtccccgttaacggttagggtacgggggtttacggggagtttaacggg

SEQ ID NO: 232830 - DNA, 801 bp, Homo sapiens
  misc_feature: GYAE6OF02H4PZB.38.35.D02.1.454.CMB.1.raw
tcagtcgatcacgtcacgaccggtgctcgatttagcacacgatagttgggtttgggggggaagaggaagactgacggtcctgccacaggtggtgctgggcacggtgggcactcgacacaacatttgcgctcaactgtcttgtccagcctggggggtccctgagactctcctgtgcagcctctggattcaaacttcaaaaaattagtgggaatgcacgtgggtccgccaggcctccgaggcaaggggctgggagtgggtaggacaaacgttatactcaattatagagtagggtaaagttttaaaaggactatacggcggaacgttacccggtaggaaccgggccgtaatttccaaacctagttctaccgaagtacggaactaattaccaaaggagaccaactactaccttagttttagaacctaaaagtagaaaacgtacgacccgttgggggaataccgtttagggaacggaacgtaaccggggtacttacggttactttaacttaaccgtttagggtaacggaaaccggtaaaacggaaaccccggtcccgttaagtttaacggttcgggggtaacgggggtaaccgtttaaggttacggtttacgggacggggtaaccgaacggggtaaaccccgttcgggacccgaaccgttaccctccgttaccgccgtaccgtaccccgaacggaaccggtacccgtaacgttccccggttccgttaccccccgtgggtacccgccccgtaccggtaccgttacccggtacggtaacccggaccctacccccggtacgtaacccgg

SEQ ID NO: 232831 - DNA, 583 bp, Homo sapiens
  misc_feature: GYAE6OF02FFQQB.38.35.D02.1.454.CMB.1.raw
  modified_base (311)..(311): a, c, t, g, unknown or other
  misc_feature (311)..(311): n is a, c, g, or t
  modified_base (346)..(346): a, c, t, g, unknown or other
  misc_feature (346)..(346): n is a, c, g, or t
  modified_base (353)..(353): a, c, t, g, unknown or other
  misc_feature (353)..(353): n is a, c, g, or t
  modified_base (361)..(361): a, c, t, g, unknown or other
  misc_feature (361)..(361): n is a, c, g, or t
  modified_base (455)..(455): a, c, t, g, unknown or other
  misc_feature (455)..(455): n is a, c, g, or t
  modified_base (467)..(467): a, c, t, g, unknown or other
  misc_feature (467)..(467): n is a, c, g, or t
  modified_base (473)..(473): a, c, t, g, unknown or other
  misc_feature (473)..(473): n is a, c, g, or t
  modified_base (508)..(508): a, c, t, g, unknown or other
  misc_feature (508)..(508): n is a, c, g, or t
  modified_base (514)..(514): a, c, t, g, unknown or other
  misc_feature (514)..(514): n is a, c, g, or t
tcagtcgatcacgtcacgaccggtgctcgatttagcacacgatagttgggtttgggggggagaggagcccagcactagaagtcggcggagtttccattcggtgatcagcactgaacacagaggactcaccatggagtttgggctgaactgggttttcctcgtagctcttttaagaggtgtccagtgtcagatgcagctgggtggagtcgtgggggagtcgtggtccaggccgtggggggtccctggagactctcctgtgcagcctgtggattacaacttacaaaaattcgtgggatgctacgtcgggtccnccgaggcctccgaggcgaagggctgggaggtgggngcaactntatcatangtagtggtaaatttaagactagtcggcgtactccggtaggacgggcctatccacctatcacagacactaactcgaagtcacactacttctattnacaatacgaacngtccgnggactcgtaggacgaccacggtctagtctagttcncggtanaaccggaaacgcccgtccttacggacgggttcggggtacggtagttcgtcggtcgggtcgggtacccgg

SEQ ID NO: 232832 - DNA, 664 bp, Homo sapiens
  misc_feature: GYAE6OF02F0NMC.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccagccgtggggggtccctgagactctcctgtgcagcctctggattcaacttacaaaaattgtagggatgctacgtgggtcccgccgaggcctccgaggcgaaggggctgggaggtgggtggcaactatatcatatgataggtaaagttttaaagactagtggaccggtactccggtaggaacggggtccgtacttaccgacctactccgtacccgaaggaacgaactaacgttacccgaaaggtacgaccaactacctacttatttacgactaaaagtacgaaaccgacggtaccgtaggggacgtacgtaggaacggaaccgtaccgggtcgtacggttacttaacgttacgttacggttacggaccggtaaaaccggaccccggtacccgttacggttacgggttacgggggttaccggggtaggtttacgg

SEQ ID NO: 232833 - DNA, 244 bp, Homo sapiens
  misc_feature: GYAE6OF02H06QB.38.35.D02.1.454.CMB.1.raw
  modified_base (235)..(244): a, c, t, g, unknown or other
  misc_feature (235)..(244): n is a, c, g, or t
tcagtcgatcacgtcacgaccggtgctcgatttagcacacgatagttgggtttgggggagttatgtctggggccagggaaccctggccaccgtctcctcagcctccaccaagggcccatcggtcttccccctggcgccctgctccaggagcacctccgagagcacagcggccctgggctgcctggtcaaggactacttccagtgatcgactgagcgggctggcaaggcgcatagnnnnnnnnnn

SEQ ID NO: 232834 - DNA, 878 bp, Homo sapiens
  misc_feature: GYAE6OF02G2T1O.38.35.D02.1.454.CMB.1.raw
tcagtcgatcacgtcacgaccggtgctcgatttagcacacgatagttgggtttggggagctctgggagaggagcccagcgacttagaagtcggcggagtttccattcggtgatcagcacgtgaacacagaggacttcgaccagtggtaggtttttcgggcttgaacgtttgggttttttaccctcggttagtccttcgtttttaaggaggttgtccaggtgtcgaggtagtgcgtaggcgtggtggaggtcgtggggagtcgtggtccgaggtccgtcggggtccctgacgctcgtccgtgtcgtcgacgtccgtcgtaggtacttacgaacttacgaaaagttgtacggtactcgaccgtaaccgtcgggtacccgaccgtaacgggtcctaccggaagggtaccggaaggggtccttaggggtaggttcggggtacggtacgtaacgttacgttaacgtacgtaaagttagtaggtaacgtttagggtaaacgtttttaaacgacgttaggtacggtaccggtaacgttccggtaggtaaccggtccgtaagttcccgaaccgtacgtacccgtaccgaagtaaccgaacttaacgtacccgaaagtaccgtaaccgtaaccgtaacttaaccgttacgttttacggaaccgttaaaacgttacggtaaaccggtaacggtaccccggtttaaggggacctttaaccggtacggtaaaccggtaaccggtaaccggttaccggttaaccggtttaaccggttaacccggtttaaacggtcgggttaaaccggtaaaccggttaaaccggtaaccccgggttaccgtttaccggttaaccggggtttccggggtaaccgggttaggtttaacccggg

SEQ ID NO: 232835 - DNA, 683 bp, Homo sapiens
  misc_feature: GYAE6OF02HCAK7.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtctgggggagtcgtggtccagccgtggggggtccctgagactctcctgtgcagcctcgtggattcaacttacaaaaattgtagggatggcacgtgggtccgccgaggcctccgaggcgaaggggctagggagtgggtgacaacgtatatcatatagattaggtaaacgttttaaagcttaagtcgacggtactccggtaggaaacgggccgtaagtttaccaaccgtatacccgtaccgaaggtaacgtaacctaacttacccgaaagtacgaccaacctaaccttaccttaatttacgaacctaaagtacgaaaaccgtacggacccgttaggggactaccggtaggaacggtacgaaccgggccgtttaggtaccgttaacgtttaacgttaggttaggaacccggtaaaccggaacccggttcccttaacggtaccgggtttacgggggtccggggttaagtttacggg

SEQ ID NO: 232836 - DNA, 781 bp, Homo sapiens
  misc_feature: GYAE6OF02JTOUV.38.35.D02.1.454.CMB.1.raw
  modified_base (291)..(291): a, c, t, g, unknown or other
  misc_feature (291)..(291): n is a, c, g, or t
  modified_base (711)..(711): a, c, t, g, unknown or other
  misc_feature (711)..(711): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctggaacttgggttttcctcggtacgcttcttttaagaggtgtccagtgtcagatgcagcgtggtggagtcgtggggagtcgtgtccgagtcgtcgggggtcctgagtctcgtctgtgcagcctcgtggtattcgaaacttanaaaacttgtaggatacgcgtacgtcggcccgcgaggtcctaccggacggcgtaacggggcgtcggagggtcggggtagacctaacgttaacgtactacgaacgttaagtagtacgtttagggttaaaaacggtttttaaacgacgttaacgtacccggtacccggtaaaccggtttaccgggtaggttaaacccgggggtacccggttaacccttaaccggtaacccgtaaacccgttacccgttacggaaacggtaacgtaaaccgtaaaccgttacccgaaacgtaaccgtacccgaaccttaacgttacttacgtttacggtaaactaaacggttacgaaaccgtacgtcccggtaagggtacgtacggtaacggaacggtaccgtaacgggttctacggttacgttaacgttacgngttaaccggaacggtaaaccgacccggttacctaacgggttgtaccgggggttacggtagtttaaccggg

SEQ ID NO: 232837 - DNA, 697 bp, Homo sapiens
  misc_feature: GYAE6OF02GPOPV.38.35.D02.1.454.CMB.1.raw
  modified_base (270)..(270): a, c, t, g, unknown or other
  misc_feature (270)..(270): n is a, c, g, or t
  modified_base (361)..(361): a, c, t, g, unknown or other
  misc_feature (361)..(361): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcggtggtccagccgtggggggtccctgagactctcctgtgcagcctntggattcaacttacaaaaattagtgggatgctacgtgggtccgccaggcctccgaggccgaagggggctagggaggtgggtggacaaactntatcaatatagataggtaaagttttaaagactaagtgacggactcggtaggacgggaccgtagtacaaccagttccaccgaaggaacgtaacctaaacttaccgaaagtaacgacctaaccgtaaccttacttaacgttttacgaacgttaaaacgtacgtaaaccgacggtaccggtaggggtaacgaccggtagggtaaacggacccggtacgggtccgtttaggtaccgtttaaactttaaccggttggtaaccggtaaccggtaaaaccggtaaccccggtacccgttaacggtacgggtttacggggggtaccgggggttatttaacgggg

SEQ ID NO: 232838 - DNA, 677 bp, Homo sapiens
  misc_feature: GYAE6OF02JP7VZ.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagcttacttttaagaggtgtccagtgtcagatgcagctggtggagtcgtggggagtcgtggtccaggcccgtgggggtccctggagtacctctccgtgtcgcgagcctcgtggattccgaacttacaaaattgtggatcgctacgtggtcccgccgaggcctaccgaggacgaagggtctgggagtgggtacggctaactagtatacaattatgaagttacggtaaaagttttaagacgttagtacgacggtaccttcgtaggacgggtactagttaccacctatcctaccgaagtacgtaactaacttaaccaacgttaacgactaactacgttacttattacgaactaaaagtcgtaaacgacggtaccgttaacgggacaccgtaaggaagtacccgggtaaccgtgttaccggttaacgttcttaaacctgggtacgaaaccggtaaaccgaacccggttacccgttaggtacggggttcggggttaacgggtacgtttaacggg

SEQ ID NO: 232839 - DNA, 732 bp, Homo sapiens
  misc_feature: GYAE6OF02JWO0J.38.35.D02.1.454.CMB.1.raw
  modified_base (200)..(200): a, c, t, g, unknown or other
  misc_feature (200)..(200): n is a, c, g, or t
tcagtcgatcacgtcacgaccggtgctcgatttagcacacgatagttgggtttggggggaagaggaagactgacggtcctgccacaggtggtgctgggcacggtgggcactcgacacaacatttgcgctcaactgtcttgtccagcctgggggtccctgagctctcctgtgcagcctctggattcaacttacaaaaattntgggatgcacgtgggtccgccaggcctccaggctaaggggctgggaagtgggtcggacacgtatactctaatagtcgaagttcggtaaagttttaaacgacgttagtcggaccggtaacgttccgttagggaaacgggtcccgtaattccgaggctaactccgtaccgaagacgaacaaccgtccaaagaactttccctagtactactaacaaatgaactagttcagacgcgctgaagcctaacggtccttagtattaccgttgtacgtaacgtaaagttacttttaggtaaggtttaagtacggtaaggttaaggtcttaacgtacgttaaaccggtgtacggtacgttcggtacgggtaccgtaacggggtaccgtaccgggttaccgaccgttcctacccggggttacaccggtccctaacccgtaccgtaaccggggtaccctaccggttaccccgtttaaccccggtcccccggtttacggccccggtccccgttccggtacccggttacccgtacgggtaacccgg

SEQ ID NO: 232840 - DNA, 618 bp, Homo sapiens
  misc_feature: GYAE6OF02J2MHV.38.35.D02.1.454.CMB.1.raw
  modified_base (296)..(296): a, c, t, g, unknown or other
  misc_feature (296)..(296): n is a, c, g, or t
  modified_base (361)..(361): a, c, t, g, unknown or other
  misc_feature (361)..(361): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccagccgtgggggtccctgagactctcctgtgcacgcctcgtggtattcaacttacaaaaatttagngggtatgcgacgtcgggtccgccacggctccgaggcgaaggggcgtggagtgggtgacacgttanatcagtatgagtagtaagtttaagcttagtgcggtacgtccggtagaacgggtcgtatcgaccatccgtacgaagacgtactaacgttaccaaaggactaccgactaactacttagtttacaacaaagtacgaacctcggtaccgtcgggaatccgtaggaacggaccgtacggtctacgtttacgtaagtttacgagtaacggtaaccgaaccggtaccccggtctacggttagggtcggggtaccgggtattcgg

SEQ ID NO: 232841 - DNA, 705 bp, Homo sapiens
  misc_feature: GYAE6OF02IVH36.38.35.D02.1.454.CMB.1.raw
  modified_base (648)..(648): a, c, t, g, unknown or other
  misc_feature (648)..(648): n is a, c, g, or t
tcagtcgatcacgtcacgaccggtgctcgatttagcacacgatagttgggtttgggggtaggctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctgggtggagtcgtgggggagtcggtggtccgagccgtggggggtccctggacgtactctccgtgtgcacgcctcgtggtattaccaacttaactaaaaaacgttagtaggggaattcggtaccgtacggttcgggtcccgaccgacgggtcctaccgagggtaccgaagggggtccgtagggacggttggggtggaccgtaactaagtatccaaagtctaggtaagttaggtaaaaggttttaaacgaagttagtcggtaccggtaccgtccggttacgggaaacgggtcccgttaacgtttaccaacccgtacttacccgttacctaacggtaaggtacctaaacgttaccgaaagaacgtaccaactacgtcttattcggaactaaatagtaacacgccgttaggacgtctggaacggacgtacggacttcggttaactntttacgtgtagaccgaacggtaccgtcctaccggtaggtacgggtcggtagttacgg

SEQ ID NO: 232842 - DNA, 690 bp, Homo sapiens
  misc_feature: GYAE6OF02JEQ8K.38.35.D02.1.454.CMB.1.raw
  modified_base (520)..(520): a, c, t, g, unknown or other
  misc_feature (520)..(520): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccaggccgtggggggtccctggagactctcctgtgcacgcctcgtggattcaacttacaaaaattgtgggatgacacgtcgggtccgccgacggcctccgaggcgaagggggctgggaggtggggtggactaaacgtatacgtacaattatgtaagttagggtaaaagtttttaaagacttaagtgggacccggtacgttaccggtaggaacggggtcccgtagttaccaacccgtaatcctaccgaaggacgtaactaaacttcccgaaaggacgtaccaacctaccgtntttaaacgtttacggaactaaaacgttcgaaaaccacggtaccggtaggggactacggtaggaaacgggtaccgacggtcttacgtacgttaacgttacgttaggtacgtaaccggtaaacggaccccggtccttacggtacggtacgggggttacggggtagtttacgg

SEQ ID NO: 232843 - DNA, 642 bp, Homo sapiens
  misc_feature: GYAE6OF02GJSLA.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccagccgtggggggtccctgagactctcctgtcgcagcctctggattcaacttcaaaaatttgtgggatgcacgtcggggtccgccgaggctccgaggcgaagggggccgtagggacggtggggtaggcgtaacgtatactcgtataagtgaatgggtaaaagttttaaagacttaatggtacggacttccgtaggacggggccgtagttccactatcctaccacggagaactaactacgaagcgaccactacttctaatttacgactaaacgtagaacgagtacccggtagggacgtcgtacgggaaggaaccgacgggtcctcgtcttaattacgttaggtacggtaacggaaaccggacccggcccgttaccggttaacgggttcggggttacgggggtagttttacggg

SEQ ID NO: 232844 - DNA, 785 bp, Homo sapiens
  misc_feature: GYAE6OF02IZFC9.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtgagtcgtgggggagtcgtggtccaggtccgtcggggggtccctagacgaccgtcctccgtggtgcagccctcgtgggtacttccaaactttacaaaaactttagagggtatacggacctacgtggggtcccgccgacggccttaccgaggaccggaaggggtccgtagggtaggtcggggtcggactaaacgtatactacgtagtaacgtgtaagtttaggttaaaacgttttaaacgaacgtttagtacggaaccgggttaccttacccggggtagggtaacggggtacccgttaacgtttacccaaaccgtactacccgtaccgtaaagtaaccgtaaacctaaaccgttaacccgaaaggttaaccgaaccgtaacccgtaaccttaccgtttaacgtttacgaacctaaaacgttagtaaaccgtaacggttacccggtaggggaacgaccggttagggaaaccggtaccggtaccggtacgttacgttacgttaacgttacgtacgtaacgtaaccggaaacggtacccccggtacgttaccgtacgggtaggggttacggtaggtttaacgg

SEQ ID NO: 232845 - DNA, 867 bp, Homo sapiens
  misc_feature: GYAE6OF02H6GBO.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttggctgaactgggttttcctcgtagctcttttaagaggtgtccagtgtcagatgcagctggtggagtcgtgggggagtcggtaggtccagccgtgggggtccctggagactcgtcctggtcgctacggtccttcgtggtaatttcctaaaactttacgaaaaaaagttttgtaggggtaattcgacgtaaccggttcgggggtcccgacccggtaacgggtccctccggaacgggaccgaaacggggggtccgttaggggaacgggttggggttaacgggaccgtaaaaaccgttagttaacgtaccgtaaagttagtacggtagtttaaaggggtttaaaaacgttttttaaaaggaactttaaggtacggtacccggggtaaccgttaccgggtaagggaaccggggtacccggtaactttaccgaaaccgtacttacccgtacccgtaacggaaacgtaaaccaaccgtttaaccgaaacgaaccggtacccaaccttaccttacctttaagtttaacggttaactaaaagttacgtaaaccgagtaaccggttcggggtaacgtccggttagggaaaccgggttaccaaccgggttcgttaccggttacctttaaggtttaccttagggtaaccggtaaacccgtaaaccgggtaaccccggtacccggttacccgttacggggtaacgggggttacccggggttagttttaaccgggg

SEQ ID NO: 232846 - DNA, 615 bp, Homo sapiens
  misc_feature: GYAE6OF02I89VK.38.35.D02.1.454.CMB.1.raw
  modified_base (269)..(269): a, c, t, g, unknown or other
  misc_feature (269)..(269): n is a, c, g, or t
  modified_base (308)..(308): a, c, t, g, unknown or other
  misc_feature (308)..(308): n is a, c, g, or t
  modified_base (473)..(473): a, c, t, g, unknown or other
  misc_feature (473)..(473): n is a, c, g, or t
tcagtcgatcacgtcacgaccggtgctcgatttagcacacgatagttggggtttgggggagctctgggagaggagcccagcactagaagtcggcggagtttccattcggtgatcagcactgaacacagaggactcaccatggagtttgggctgaactggtttcctcgtagctctttaagaggtgtcagtgtcagatgcagcgtggtggagtcgtgggggagtcgtggtccagccgtggggggtccctgacgctctccgtgtgcagcctntaggattcaacttacaaaattgaggatgcacgtggtccncgaggcctccgaggaccgaaggggcctagggaggttggggtcggactaaacgtagtagtcgaatgtagtaagttagggtaaattttaaagacttagtacgacggtactcggtaggacggtacgatcacactcacgagacaactaacgtccaagcgacactacgtnttacgtcgaaaaacttcgaaactacgccggtggacgtctagggaacgtaccggacgtaccttggtaccttaacggtacgtgtaacggaacgtaaacgggtccccacgttacgtagggtacggggttaccgggtaagttacgg

SEQ ID NO: 232847 - DNA, 693 bp, Homo sapiens
  misc_feature: GYAE6OF02HRC9G.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctagaacgttgggttttcctcgtagcttcgttttaagaggtgtccagtgtcagatgcagtctggtggacgtggtgggggtagtcggttcggtccaggtccggtcgggggggtccctggacgtcctcgtccgtgtgccaggtcctcgtagtacttactaacttaaactaaaagttgtaggtagtcgaccgtacggtccggtaccgaccggtacgtccgtacgacggaccgggagggtcggtaggtagggttcgggacgaacgtaaacgttatactacgtaagtagtagtaaggttaaggtttaaaagttaaagctaagtcgtacggtaccgtcgggaaggtaccggtactacgtacaaccgtactcctacgaagtaacgtaactaactaccgaaggaaccactactacttattacgtacaacgtaaatacgaacgtacgtacggtagggacgtaggtacggaacgtaccgcggtacctgttactaagttcgagtacggaaaccgtaaccgtacccgtcgtacgtagggtcggtagggtattacggg

SEQ ID NO: 232848 - DNA, 632 bp, Homo sapiens
  misc_feature: GYAE6OF02G8OYL.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccagccgtggggggtccctggacgactctccgtgtgcagcctcgtggattcaacttacaaaaattgtgggtatgcacgtcggggtccgccgacggcctccgaggcgaaggggctgggaggtgggtggcctaacgtatactcaattatagattaggtaaagtttaaagactagtcgacggtactcggtaggacggccgattacacctatcctacgagtacgaactactacaagacgaccatactcttaattcgaactaaagtagaaccgtacgcgtaggggaacgtcgttaggaacgggacgtaaccgggcttaggttacgttaacttacggtcggtaaggtaacccgaaacggtaaccccggtcccttaaggtaccgggtaggggtccgggttaaggttccgg

SEQ ID NO: 232849 - DNA, 779 bp, Homo sapiens
  misc_feature: GYAE6OF02G3OP7.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcggtggtccgagccgtcggggggtccctggacgacctctccgtgtcgcacgccttcgtggtattaccaaactttaactaaaaatttagtaggggtatggaccgtacggttccggggtccccgaccgtacgggtacccgtacccggaacgggaccggaaacggggggtccgtagggggtaggggttcggggggtacgggaccgtaaacgttagttaacttaccgaatttagtaggtaagtttaagggttaaaaggtttttaaaacgacttaaggtcggtaccggtaccgttccggtaagggaaccgggtccgtaacgtttcccgaacctacgtaccgtaccgtaagaacgtaacctaaaccgttaccgaaaggtacgacctaactacttacttatttacgactaaagtacgtaaccacggtccgtaagggactacggtagggaaccgtacgtaccggtcgttacgttacgttacttacgttacgggtacgaaccggtaaacggaccccggttccgttacggttaacgggtacgggggttacggggttatttaccggg

SEQ ID NO: 232850 - DNA, 654 bp, Homo sapiens
  misc_feature: GYAE6OF02H4HKF.38.35.D02.1.454.CMB.1.raw
  modified_base (313)..(313): a, c, t, g, unknown or other
  misc_feature (313)..(313): n is a, c, g, or t
  modified_base (334)..(334): a, c, t, g, unknown or other
  misc_feature (334)..(334): n is a, c, g, or t
  modified_base (347)..(347): a, c, t, g, unknown or other
  misc_feature (347)..(347): n is a, c, g, or t
  modified_base (413)..(413): a, c, t, g, unknown or other
  misc_feature (413)..(413): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaacttgggttttcctcgtagtcttcttttaagaggtgtccagtgtcagatgcagctggtggagtcgtgggggtagtcggtggtccaggccggtcggggggtccctggagacctctcctgtcgcacgtcctgtggtattacctaacttacaaaaagtttacgngggtatagctacgtgggtccncgacggcctacgnggacgaggggctgggaggtgggtcgcaatatactacatatgagtttaggtaaatttaaagattagngtacggtactcgggtaggtacgggctacgttccacctatcctacgagacactaactacgaagtcactacctacttactagttcaactaaacgtacgaacgtcggtacccgtagggactccgaggaaccggactaccggtcttaacgtctttaacgttacgttcggtaacggtaaaccggaaaccggtccccggtaaccgttcgttaacggggtgggggttacccggggttaatttccgggg

SEQ ID NO: 232851 - DNA, 737 bp, Homo sapiens
  misc_feature: GYAE6OF02INQML.38.35.D02.1.454.CMB.1.raw
tcagtcgatcacgtcacgaccggtgctcgatttagcacacgatagttgggtttgggggggaagaggaagactgacggtcctgccacaggtggtgctgggcacggtgggcactcgacacaacattttgcgctcaactgtcttgtccagcctggggggtccctgagactctcctgtgcagccttctggattcaacttacaaaaattatgggatgcactcgggtccgccaggctccaggcgaaggggctggagtgggtggcaactatatcatatgagtaggtaagttttaaagacttatggcggtactccggtagaacggggccgattcacctatcctccagacgactaacttccaagagacacacttacttattgactaaatcgaaacacgtccgtagggagcgtaggaacggaccgacgggtctttaggttacctttaagtttacgtggtacggaaccggaaaacggtaccccggtcccttacggttagggttcggggttaccggggtagttttacgtggttccggtacgggggacccgtaacgggtaaccccgtcgggaccccgttaccggtccctacccgtaccgtacccggtaccccttaaccccgaacccgggtaacccgggtaccccgtacgtttccccgggttcccctttaccccccgggtcggtaccccggttcccccgttcggtacccgttacccggaggacccgtacccggtaccccgtaccggaaccg

SEQ ID NO: 232852 - DNA, 696 bp, Homo sapiens
  misc_feature: GYAE6OF02IHXWU.38.35.D02.1.454.CMB.1.raw
tcagtcgatcacgtcacgaccggtgctcgatttagcacacgatagttgggtttgggggggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccagccgtgggggtccctgagactctcctgtgcacgcctcgtggacttcaaactttacaaaaaaatttgtaggggtatgccacgtcggggtcccgccgacgggcctcccgagggcgaaagggggtcgtgggaggtggggtggaccaacgtataatcaatatgaagttaggtaaagttttaaagacttaagtacggacggtacttccgtaggaacgggtcccgtaatttcccgaccgtaatccgtacccgaaggaacgaactaacttaccaaaggacgactaacctaaccttcttaacgtttcgaactaaaacgttcgaaaaccgtacgtacccggttaggggactacggttacggaacggaaccgtacggtccgttagtacttacgttacgtgtaacggacgtaaaccgtacccggtccttacgttaggtcggggtacgggtaagttacgtggttaccggtacgggtacccgg

SEQ ID NO: 232853 - DNA, 260 bp, Homo sapiens
  misc_feature: GYAE6OF02GVFS0.38.35.D02.1.454.CMB.1.raw
  modified_base (206)..(206): a, c, t, g, unknown or other
  misc_feature (206)..(206): n is a, c, g, or t
  modified_base (230)..(230): a, c, t, g, unknown or other
  misc_feature (230)..(230): n is a, c, g, or t
  modified_base (235)..(236): a, c, t, g, unknown or other
  misc_feature (235)..(236): n is a, c, g, or t
  modified_base (238)..(260): a, c, t, g, unknown or other
  misc_feature (238)..(260): n is a, c, g, or t
tcagtcgatcacgtcacgaccggtgctcgatttagcacacgatagttggggtttggggggagttatgtctggggccagggaaccctggccaccgtctcctcagcctccaccaagggcccatcggtcttccccctggcgccctgctccaggagcacctccgagagcacgagcggccctgggctgcctggtcaaggactactccagtnatcgactgagcggctggcaaggcnatagnncnnnnnnnnnnnnnnnnnnnnnnn

SEQ ID NO: 232854 - DNA, 566 bp, Homo sapiens
  misc_feature: GYAE6OF02I61PN.38.35.D02.1.454.CMB.1.raw
  modified_base (350)..(350): a, c, t, g, unknown or other
  misc_feature (350)..(350): n is a, c, g, or t
  modified_base (357)..(357): a, c, t, g, unknown or other
  misc_feature (357)..(357): n is a, c, g, or t
  modified_base (416)..(416): a, c, t, g, unknown or other
  misc_feature (416)..(416): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggtttcctcgtagctcttttaagaggtgtccagtgtcagatgcagctggtggagtcgtgggggagtcgtggtccagccgtgggggtccctggacgactctcctgtcgcagcctcgtggattcacctttagccagctatcgcagtgagtcgtgggtccgccacggctccgagggacgggtctggaggtgggtccnctcttanctaagtaatagtggtagtaccatattcgacgcagactcgaggaacggccggttacactntctccagacactacttaccaagaacaactactaactacctagacaaagtcgaaacacctagacgacgtaccgaaggaccacggaccatattataacgtgtagttaggaacgggtgaccgggtgaccgtcggacgggacgacgggtacccg

SEQ ID NO: 232855 - DNA, 725 bp, Homo sapiens
  misc_feature: GYAE6OF02JDZ6N.38.35.D02.1.454.CMB.1.raw
  modified_base (126)..(126): a, c, t, g, unknown or other
  misc_feature (126)..(126): n is a, c, g, or t
  modified_base (166)..(166): a, c, t, g, unknown or other
  misc_feature (166)..(166): n is a, c, g, or t
  modified_base (305)..(305): a, c, t, g, unknown or other
  misc_feature (305)..(305): n is a, c, g, or t
  modified_base (363)..(363): a, c, t, g, unknown or other
  misc_feature (363)..(363): n is a, c, g, or t
  modified_base (399)..(399): a, c, t, g, unknown or other
  misc_feature (399)..(399): n is a, c, g, or t
tcagtcgatcacgtcacgaccggtgctcgatttagcacacgataggtgggtttggggagcgtctgggagaggagcccagcactagaagtcggcggagtttccattcggtcgagtcagcactgaacncagaggactcaccatggagttggctgaactgggttttccncgtacgctcttttaagacggttgtccagtgtccagtactgcagctcggtggagttcgtggggagtcgtggtcccagtccgttggggggccctggacgactctccgtggtgacacggtcctgtggtacttcgaaccttanaaaaacttgtcgggaatcgcgtaggtcccggcctagcgtctacgacacgggagtcggngtaggtcgggtacgacggacttacgtatcgttaaancggttagtacggtaagggttttaaacgtttaaccgaaggttacgtaccggggtaaccctttcggtaacgggttaccgggaaccggtacccgtttaacgaccttaccgtaaacggtttcccgaacgacgtaaccgtaaacgttacgtaacccgtaggtaccgtaaccgaccgttactttacgttaactacgaacgtaagttaacgaccgttacgtccggtacgtacggtcgtacggaacgtacgaggttccttaggtacttaggtaccctagtcggtaaccgaaccgtcgtcccgaaggtttccggaacggggttctaggttaccgg

SEQ ID NO: 232856 - DNA, 858 bp, Homo sapiens
  misc_feature: GYAE6OF02JUO1U.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcggtggtccacggtccggtcggggggtccctggacgaccgttcctccgtgtcgcacgtcctcgtggattaccaacttactaaaaattgtagggatcgacgacgtcgggcccgcgacggccgtccgacgggacggaacgggggtcgtaggggtagggtcggggtacggaccgtaacgttaacgtacgtactaagttagttaggaagtttagggttaaaacggttttaaaagacgtttaacgtcgggtaacccggttaccgtaaccgggtagggtaaccggggtaccgtttaacgtcccgtaaacccgtacgttaccccgaccgtaaaccgtaacggtaaaccgttaaaccgttaaacccggaaacggtaccggaaccctaacccgttaaccttacccgtttaatttaccgggtaaacttaaaaccggttaaccgtaaccgtaccgggtaaccccgggttagggtaacgtaccgggttaacgggaaccgggacccggttaccgggttacgttaccggtttaacggtttaacccgttttacggtacggttaacgggtaacccggtaaacggtcccccgggttaaccgttacgggttacggggtttaccgggggtacggggtttaacgtttaccggggg

SEQ ID NO: 232857 - DNA, 678 bp, Homo sapiens
  misc_feature: GYAE6OF02H26BD.38.35.D02.1.454.CMB.1.raw
  modified_base (182)..(182): a, c, t, g, unknown or other
  misc_feature (182)..(182): n is a, c, g, or t
  modified_base (300)..(300): a, c, t, g, unknown or other
  misc_feature (300)..(300): n is a, c, g, or t
  modified_base (374)..(374): a, c, t, g, unknown or other
  misc_feature (374)..(374): n is a, c, g, or t
  modified_base (562)..(562): a, c, t, g, unknown or other
  misc_feature (562)..(562): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagcttcttttaagnggtgtccagtgtcagatgcagcgtggtggagtcggtgggggagtcggtggtccaggccggtcgggggggtccctggacgtaccttcctccgtggtgcagcctctggacttcaacttanaaaaattgtggatgacacgtggtccgcgaggcctccgagcgaaggggctgggaggttcgggtgccgtaatatancgtatatagtagttaaggtaaagttttaaagacttaagtcggtacggtacttaccggtacgggaacgggtaccgtaacgttaccaacctacgttaccttaccgaagtaacgaaacttaacgttaccaaagtacgacaactaacttcttaagttacactaaacgtcgtaaactacgtaccgtgggtacncggtagaacggtaccgtacggtcttacggttacttaaggtttaccgaggttacggaaaccggtaaccggtacccggtcccttacggttacgggtacggggttacgggtagttcggg

SEQ ID NO: 232858 - DNA, 832 bp, Homo sapiens
  misc_feature: GYAE6OF02I0BUV.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttggctgaactgggttttcctcgtagcttctttaagaggtgtccagtgtcagatgcagctggtggagtcgtgggggagtcggtcggtccaggtccggtggggggtccctggacgtacttccgtccgtgtcgcgacggtccttcgtggtacttacgtaacttaacgtaaaaattgtacgggtatcggtacgtacgttcggggtccccgtaccggtaacggtcccttacccggaaggtaccgggtaaaaccgggggtccgttacgggggacgggtttcggggtacgggtaaccctaaacgggttaactaacgttaccgaaaggtttacgtaaggttaacgggttaaacgggtttaaaacggtttttaaaacgaacgtttaacggtacgggtacccggggttaaacctttacccggggaagggttaaccggggtaccgtttaaccggttttacccaaaccgtttaccgttaccgttaccgaaacgtaacgtaactaaacgttaccgaagtacgaccgtaactaccgttattacgtacgaactaaacgtacgaacgtacgtccggtaggacgtacgtaggaacgtaccgacggttctaacgttaccgttacgttaacgtcggtaaccggaacgtaaccggttacccgtccgtttaacggttggggttaccggggtacgggttagtttaccggg

SEQ ID NO: 232859 - DNA, 720 bp, Homo sapiens
  misc_feature: GYAE6OF02JFZ08.38.35.D02.1.454.CMB.1.raw
  modified_base (373)..(373): a, c, t, g, unknown or other
  misc_feature (373)..(373): n is a, c, g, or t
  modified_base (589)..(589): a, c, t, g, unknown or other
  misc_feature (589)..(589): n is a, c, g, or t
  modified_base (639)..(639): a, c, t, g, unknown or other
  misc_feature (639)..(639): n is a, c, g, or t
tcagtcgatcacgtcacgaccggtgctcgatttagcacacgatagttggggtttggggagctctgggagaggagcccagcactagaagtcggcgagtttccattcggtgatcagcactgaacacagaggactcaaccatcggagtttgggctgaacttgggttttcctcgtagctcttttaagaggtgtccagtgtcagatgcagctgggtcggagtcgtggggatcgtggtccagccggtgggggtccctgagacttcctcctagtgcagcctgtaggattacaacttacgaaaaattgtggatgctaacgtcgggcctcgagtctccgaggccgaaggggtctagggagggttcggaggacctaaaacgtnttacgtcgtaaagtatggaagtttaaggtaaaacgtttttaaagaacttaagtacgggtaaccggaccgtttacgggaacggtaaacgggtccgttaaaccttacgaacccttaacgtacctaaccggtaagtaaaccgtaacttaaacgttaccccgaaagtaaccgtacctaaccgttacttaacttaagttactaactaaaactcggaaaccncgtacggtaacggagtaaccgtaggaaccgggacgtacggttactacgtntttaacggtaactgggtaaacgtacggtaaacccggtacccgttaccgtaaccgtgggttaccgggtacggtagttaccgg

SEQ ID NO: 232860 - DNA, 883 bp, Homo sapiens
  misc_feature: GYAE6OF02HKENJ.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaacttgggtttttcctcgtagcttcttttaaggaggtcgtccaggtgtcagatgcagcgtggtggagtcggtagggggagtcggtcggtccgaggcccggttcgggggggtccctaggacgtaccgttccgtcccgttggtacgccgtacggtcccgttcgttcgggtaacttttaccaaaacctttaaaccgtaaaaaaggtttaggtacggggtaacttacggtaccgtaaccgggttccgggggtacccccgtacccgaaccggggtcccgttacccggacggggtaccgggaagggggtccgtgggggtaaccggggttggggtacggaacctaaaccgtttagtaacctacgtaagtttagtacggtaaaggtttaacggtttaaaaacggtttttaaagaacgttaggttacgggtaccgggttaacccgttacgggttacgggaaccgggtaccttacgttacccaaaccgtacgtacccaccgaagtaaccgtaactaaacgttaccgaaaggaaccgtaccaacccgtaacttacgtttaacttacggaaccttaaagtacgaacgtaccggtcggttacgggacttacgggacggaaccggtacgccgggttacttacgtttaacgttacggtttacggtacggtaaccggtaaaccggtaaccggtacccccggtacgttaaggtaccggggttacgggggttaccggttaggtttacggg

SEQ ID NO: 232861 - DNA, 690 bp, Homo sapiens
  misc_feature: GYAE6OF02HYFTD.38.35.D02.1.454.CMB.1.raw
  modified_base (271)..(271): a, c, t, g, unknown or other
  misc_feature (271)..(271): n is a, c, g, or t
  modified_base (290)..(290): a, c, t, g, unknown or other
  misc_feature (290)..(290): n is a, c, g, or t
  modified_base (500)..(500): a, c, t, g, unknown or other
  misc_feature (500)..(500): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtcagtgtcagatgcagctggtggagtcgtgggggagtcgtggtccagccgtgggggtccctgagactctcctgtgcagcctctggnttacaacttacaaaaattntgggatgacacgtgggtcccgcgaggcctccgaggccggaaggggctagggaggttgggtggctaaactagttatcgattagtgtattagggtaaaagttttaaagacgttaagtcggaccggtaccgttccgggtaggtaaaccgggtcctagttaccgaaccctattaccgtaccgaagtacgaactacgttaccaaagacgacaacnccgttaacttagtttcgaactaaatacggaacgtacgtccgggtagggtacgtacgtaggaaccgggtacgaccggtcgttacgtaccgttaagttttaccggaggttaaccggtaaaccggtaaacccggtaaccccggtccgttaaccgttacggggtacggggttaccggggttaagtttaccgggg

SEQ ID NO: 232862 - DNA, 726 bp, Homo sapiens
  misc_feature: GYAE6OF02GBUJH.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaacttgggttttcctcgtagcttcttttaagaggtgtccagtgtcagatgcagctggtggagtcgtggggagtcgtggtccagccggtgggggtccctgacgtacctctctgcgccagcctcgtggacttacgtaacttaactaaaaattgtagggatgaccacggttcgggtacccgaccgacggtcctccggaagggaccggaacggggtccgtaagggtagggtggggtacggaactaacgttagtacttacattaacgtagtaacgtttaggttaaaacgttttaaagtactaaggtcgtaccgggtacgttaccgtaacgggaacggtacctaacgttaccactactaccgtacgtaagaactaaccgtaacttaacccgaaggaacctactaaacccgtactttacgttacttagaactaaaatacggaaactccgaccggttgggactacgtaaggacgtacccgacggttcgtacgttagttaaccgttagtacgtaaccggaacgtaaacggtacccccggtacttacgggtaacgggtttcggggtaacggttacggttaccggg

SEQ ID NO: 232863 - DNA, 696 bp, Homo sapiens
  misc_feature: GYAE6OF02HP2WE.38.35.D02.1.454.CMB.1.raw
  modified_base (271)..(271): a, c, t, g, unknown or other
  misc_feature (271)..(271): n is a, c, g, or t
  modified_base (385)..(385): a, c, t, g, unknown or other
  misc_feature (385)..(385): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaacgttgggttttcctcgtagcttcttttaagaggtgtccagtgtcagatgcagcgtggtggagtcgtggggatcggtcggtccgagccggtcgggggtccctgacgtacctctccgtgngcacgtcctcgtggtattacctaaacttaactaaaaagtttagtgggaattcgacgtacgttcggggtcccgaccgacggtcctaccggaggaccggaaggggtccgtaggggnggttacggggtcggacctaaagttaactaacgtcgattaagtagtaagttaaggttaaagttaaacgtacttagtcggaccggtcgtcgggtacggtacgaccgtactaccgacctacgtctaccgagtaacactaacgtacgaagtccgaccacgttactacgttatacgaataaacgtacgtaacgacgtacggtagggaacttccggtagaacggtccacgggtacttacgtacgttacgtaccgttggaacgtaaccggtaaccggtacccgtcgtacggttagggtcgggttacggtattaccggg

SEQ ID NO: 232864 - DNA, 765 bp, Homo sapiens
  misc_feature: GYAE6OF02JU3G3.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagcttcttttaagaggtgtccagtgtcagatgcagctgggtggagtcgtgggggagtcggtggtccgaggtcccggtggggggtccctggacggtaccttccgtccgttggtcgccacggtcccgttcgtgggtacttacctaaaacctttacgtaaaaaatttggtaggggtaactggacctaaccggttcggggtccccgtaccgacggtcccgttacccggaacgggtccggaaacggggggtcgtacggggtaacgggttcgggggtacggtacctaaacgttagttaactacgtaattaagtgaacggtttaaggttaaaacgttttaaagacgttagtacggccgttaaccgtccggtaggaacgggtacctactccgtaacctctaccgacgtagacgtaacctactacgaagtacactactactgttacttacgaataacgtacgaaacgtcgtacgtagggtacacggtacggaacgacgtcggtacttacggttacctaaggttaccgtagggtaaccgtaaaccggtaacccggtaacccggtccttaaacggttacggtacgggggttacgggttaggttacggg

SEQ ID NO: 232865 - DNA, 795 bp, Homo sapiens
  misc_feature: GYAE6OF02GMI8U.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcacatggagtttggctgaacgttgggttttcctgtagtcttcttttaagaggtgtccagtgtcagatgcagtcgtgggtggtagtcggtgggggtagtcggtcggtccgacggtccggtcggggggtccctaggacgtaccttccgtccgtggtcgacctaccgtccgttacgtaggtaccttacctaaactttaacctaaaagttggtaggtactcgtacgtaccggtcgggtacccgcgtacggccgtaccgagggacggaggggtcgtaggggtggtgggacgtactaatatacgtatagtaacgtggtaagtttaacggttaaagtttaaacgtacgtaaggtacggtaccggtaccgtaccgggtaacgggaaccggtaccttaaccgtacctaaccgtacctaccgaacgttaaagaaccgttaaaccgtaacgtaaccggaaactaccggtaaccttcgtaaccttacgttaagtaaccaaacgttaacgacgtaaccggtcggtacggtacggacgtaacggacggtacggaacgtccggttaccgttagttaccgtttaaggaccggttaacggaaacccgggttaaccggaaccggttacccggtaggttaaccgggttagggggtaaccggttggtaaaccggtttccgggg

SEQ ID NO: 232866 - DNA, 809 bp, Homo sapiens
  misc_feature: GYAE6OF02F02K9.38.35.D02.1.454.CMB.1.raw
  modified_base (407)..(407): a, c, t, g, unknown or other
  misc_feature (407)..(407): n is a, c, g, or t
tcagtcgatcacgtcacgaccggtgctcgatttagcacacgatagttgggtttgggggggaagaggaagactgacggtcctgccacaggtggtgctgggcacggtgggcactcgacacaacatttgcgctcaactgtcttgtccagccgtgggggtccctgagactcctcctgtgcagcctcgtggtattctaacttacaaaaattagtgggatgccacgtcgggtcccgcgacggtcctccgaggcgaaacgggggcgtggaggtggggtggacctaaactatagtccaatagtagtagtagggtaaagtttttaaaagacttaagtggcggtaccgttccggtagggaaccgggtaccgtaattccgaacctagtcctaccgaagtacgaactaacttaccgaanacgtaccacctacgtctttagttacgaaactaaagtacgaaacgtacggtccgtaggggaacgtcgtacgggaacggaacgtcggtcttcggttaacttagttacgtaggacggtaaaccggtaaaccggtacccgtcccgtacgttacggggttggggtacggggtaatttacggttggtaccgggtccgggaccggtaacccgggtacccggtacggtcccgtaccgttcccgtaccgacctacccggtaccccaacccggtaaccgggtacccggtcccgtaacgggtttcccccggttaccccgttcccccggaggttccccccgtacccgttcccggtaccccgtccggtaaccccgggtacctacccccggttaccccgggtaccggaaccccggg

SEQ ID NO: 232867 - DNA, 779 bp, Homo sapiens
  misc_feature: GYAE6OF02IPF7R.38.35.D02.1.454.CMB.1.raw
  modified_base (330)..(330): a, c, t, g, unknown or other
  misc_feature (330)..(330): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagttgggctgaacgttggtttcctcgtagcttcgttttaaggaggtgtcctagtgtcagagtgcagtcgtggtggaggtcggtgggggtagtcggtcggtccgacggtccggtcgggggtcctggacgtcctcgtccgtgtgcgtacgtcctcgtgtacgttacctaacttaactaaaagttgtacggtntcgtacgtaccggtcgggtcccgtaccggcggtaccctaccggaacggggacggtaacgggtcgggttaggggtaggggttcggggtaccggtactaaacgttagtaactacgtaacgtggtaagtaggtttaaagggtttaaaactttaaacggtacgttaggtacgggtaccggtaccggttaacgggtacgggtaacggtccgtaacttaacccgaccgtatacccgacgaagtaccgaaacttactaaccgaaacgtcgaccttacctactttacgtattacgaacgtaaagtcgaaccgtcgtccgggtaacgtacgacggtaagtaccggaccgtacgttcgtagttaccgtttaagttccggtacggtaaaccgggtagtaaaccccggtccccgttacggttaccgggtagggttacccggggtagggttacttaccgggg

SEQ ID NO: 232868 - DNA, 850 bp, Homo sapiens
  misc_feature: GYAE6OF02FU82I.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaacttgggttttcctcgtagctcttttaagaggtgtccagtgtcagatgcagcgtggtggagtcgtggggagtcgtggtccagccgtcgggggtcctggacgactctcctgtcgcacgccttcgtcggtattacctaaacctttaactaaaaattaggtaggggtactcgaccgtacggttccggggtacccgccgtaacggtcccgtcccggaagggaccggaacgggggtcggtacggggtacgggtggggttacggtaccgtaaacgttaacgttaacgttactaagttaacgtaggtaacgtttaagggtttaaaaggtttttaaaacgacgtttaagtacgggtacccgggtaaccggttacccgggtaaggggtaaccggggtcccgttaaacgtttacccgtaaacccgtcgttaccccgtaaccgaacgggtaaaccgtaaccgttaaacgttaacccgaaagggtactaaccctaacgtaccttaactttacgttacgaactaaaacgtaccggtaaacgtacggtcccggtaagggaccgtacggtacgggaaccgtacggtacccgtacgttaccgttacggtttaacttacggttacggtaacggaaacccggtaaacccgggtaccccggtacccgtttacgggtaccggggtttacgggggttacccggggttagttttaccggg

SEQ ID NO: 232869 - DNA, 1023 bp, Homo sapiens
  misc_feature: GYAE6OF02I5MJ4.38.35.D02.1.454.CMB.1.raw
  modified_base (191)..(191): a, c, t, g, unknown or other
  misc_feature (191)..(191): n is a, c, g, or t
tcagtcgatcacgtcacgaccggtgctcgatttagcacacgatagttgggtttggggagctctgggagaggacgcccagcactagaagtcggcggagtttccattcggtgatcagcactgaacacagaggactcacagtggtagtttggctagtaacgttcgggtttcctcgtagctttacgttttaaggnggttcgtccgagttttttcgacgtagtatcgcgtacggtcggttgggtacggtacggtcggggtagggggtacgttccgggtcggtacccgacgggtccgggttaccgggggtccctggaccgtaccgtccgttccgtcgtggacctcgtcccgttagttacggtactttaacctaaacgtttaactaaaaaggttggtaggtaactcgtaccgtacggttcccgggaccctccggacgtcccggtacggacgggacgggaacgggtcggtaggggtagggtacggggtaccgtaaacgtaaacgttacgtaaacgttacggaaatttaacgggtaaggttaaccgggttttaaaagggttttaaaaacggttttaaacgttaccggtttaaggggttacccgggtaaccgggtttaaccccggttaacgggggtaaaccgggtacccggggtttaccccgttaacgttaacccggtaaccctttaaccgtttaaccgtaaaccggtaaacccgtaaacgggttaaacctaaccggttaaaccggaaacggtaaccttacccggtaaccgtttacctttaacggtttaaacgttaaccgtaaaaccgtttaacgggtaaccgtttaaaccgggaaccgggtttaccgggaacgggtttaacccgaggggttaaacccggtaaccgggtttaaccgttccgggttaacgttcgttttaaaccgtcggtttaaaccggtacgtaacccgggaaacccggtttaaccggttacccccggtaggtttacccggggttagggtacggggggttttaccgtacggttttaaccggggg

SEQ ID NO: 232870 - DNA, 949 bp, Homo sapiens
  misc_feature: GYAE6OF02HR6D9.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaacgttggttttcctcgtagtcttcgttttaagaggttgtcctaggtgttccagtatcgtcagtcgtggtcgggacgtacggttcgggggtacgttcggtcggttacccgtaggtcccggttaggggggtacccctggtaacgtaccgttcgttccgtagttcgccgacgtcccgttcgtggttaacttaccttaaacttaacctaaaaagttttacggtaaggggtacttacggtaacctaaccgggttaccgggggttacccacccgggtaacgggtaccccgttaacccgggacgggtaacccgggtaacggggtcgggtttacgggggacgggtttacgggggtaccggtaccgtaaaccgtttaagtaccgttagttaacgttaaggttacggtaagtttaacgggttaaaaggttttaaacgacggtttaacgacggtaaccgggttaccgtaacgggtaaccgggtaacggtcgtaaaccggttacctaacgtccctagtaccgaaaggttaccaaacgttaccgtaacgaaaggtacccgtacgtaaccttaccgttaagtttagtaaccgtaaccgtaaacgttacggaaaaccgtcggggttaccgtaacgggttaccgggtacctaaaccggggtaaccgttacgggtaacccgttcggtttacgtttaacccgttaaccggttaacccgtagggtttaacccggaaacccgggtaaaacccggtccccggtttacccgttaaccgggtaggggttaccggggttaacccggttaggttttaccggg

SEQ ID NO: 232871 - DNA, 677 bp, Homo sapiens
  misc_feature: GYAE6OF02FUQDZ.38.35.D02.1.454.CMB.1.raw
  modified_base (172)..(172): a, c, t, g, unknown or other
  misc_feature (172)..(172): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctgtagctnttttaagaggtgtccagtgtcagatgcagctgggtggagtcgtgggggagtcgtggtccaggccgtgggggtccctgacgactcctctgtgcagcctctggattactaacttactaaaaattagtagggatgcgtacgtcggggtcccgccgacggcctaccggaggaccggaaggggcgtgggtaggtcggggtggacaaacgtatagtacaatactagtaagtaggtaaagttttaaacgaacttagtcggacggtacgtaccggtaggaacgggaccgtagttacaccactccaccgaacgtaacactaacgtaccgaagacgaccaaccgtacctacttacttacgaactaaacgtagaaccgacggtaccgtagggacgtacgtaggaaggaccgtacggtccttaggtacccgtaagttaccgttaggtaccggtaacgaaaccgggtaccccgtacccgttacggtacggttacggggtaccggggtacgtttacggg

SEQ ID NO: 232872 - DNA, 242 bp, Homo sapiens
  misc_feature: GYAE6OF02F1PHH.38.35.D02.1.454.CMB.1.raw
  modified_base (236)..(242): a, c, t, g, unknown or other
  misc_feature (236)..(242): n is a, c, g, or t
tcagtcgatcacgtcacgaccggtgctcgatttagcacacgatagttgggtttgggggagttatgtctggggccagggaaccctggccaccgtctcctcagcctccaccaagggcccatcggtcttccccctggcgccctgctccaggagcacctccgagagcacagcggccctgggctgcctggtcaaggctacttccacgtgatcgactgagcgggctaggcaaggcgcatagnnnnnnn

SEQ ID NO: 232873 - DNA, 747 bp, Homo sapiens
  misc_feature: GYAE6OF02FJIUR.38.35.D02.1.454.CMB.1.raw
  modified_base (313)..(313): a, c, t, g, unknown or other
  misc_feature (313)..(313): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgcagatgcagctggtggagtcgtgggggagtcgtggtccagccgtggggggtccctggagactctcctgtgcagcctctggacttcaactttcaaaaattgtgggatgctacgtgggtcccnccaggcctccaggcgaaggggctgggaggtggggtggacaactatatcgtatatgaattaggtaaagttttaaagacttaagtcggaccggtacgttaccggtaggaacggggtcctattaccgaaccgtattacccgtaccgaagaaacggtaacctaaacgttacccgaaacggtaacgtaccaaacccgttaaccttacctttaacgttttacggaaacccttaaaaagttaccgaaaccgtaaccgggtacccggttacgggggtaactaccggttaagggaaccggtaacccgaacgggtacccgtttaacggttaaccgtttaacgtttaacccgttagggttaaccggaacccggtaaaaacgggtacccccggtacccctttaggtaaccggtttcggggggttacccgggttagttttaaccggg

SEQ ID NO: 232874 - DNA, 745 bp, Homo sapiens
  misc_feature: GYAE6OF02HZ5Y1.38.35.D02.1.454.CMB.1.raw
  modified_base (221)..(221): a, c, t, g, unknown or other
  misc_feature (221)..(221): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttggctgaacttgggttttcctcgtagcttcgttttaagaggtgtccagtgtcagtatgcagcgtggtcggagttcgngggggtagcggttggtccgaggtccggtggggggtccctggacgtacttcgtccgttaggtcgcacgtcctacgtggtacttcaacttactaaaaattgtagggtatgtaccgtacgtcgggttcccgaccgaaggtccgttaccgaaccggcggaaacggggtccgtaggggtaacggtggggttacgaaccgttaacgtaggtaacctacgtagttaagtcgtaagttaacggtttaaaacgtttaaaccgtaatacggtacggtacggttaaccgtccgggtaaggtaaccgggaccgttacgttacccgaaacccgttacgtacccgtacccgaaagtaacgtaaccgtaaacgtttaacgaacggttacgactaacaacgttacttagttacgactaaagtacgtaacgcgtacggtacgtgtaccgagaacgacgtcgacgttcgtagttaacgtacgtggtacgtaacgtacggaaccctacgttcccgtaagggtccggtacggttacgttacggg

SEQ ID NO: 232875 - DNA, 773 bp, Homo sapiens
  misc_feature: GYAE6OF02HNPMD.38.35.D02.1.454.CMB.1.raw
  modified_base (362)..(362): a, c, t, g, unknown or other
  misc_feature (362)..(362): n is a, c, g, or t
tcagtcgatcacgtcacgaccggtgctcgatttagcacacgatagttgggtttgggggggaagaggaagactgacggtcctgccacaggtggtgctgggcacggtgggcactcgacacaacatttgcgctcaactgtcttgtccagcctggggggtccctgagactctcctgtgcagcctctggattcaacctttcaaaaaatttagtgggatgaccacgttcgggtccgccgaggcctcccgaggcgaaggggctggggagtggggtggcaactagtactcaatatgaattgggtaaagttttaaaagctagtggccggtacgtccggtaggaacgggccgtacttaccgacctagtcccnccgaagaacggacctaaagttacccaagacgcactactacttatttcgaacaatcgaaacacggtaccggtaggtaacgcgtacgggacgtaaccggaccggtacgtagtacttaagtttccgtagggtacggaaccggaaaacggtaaccccggtcccttaggtaacggttgggggtaccgggttaggttacgtcggtcgggttacggggaccggtaaccgggacccgtcccggaccctaccccggttcgttaccccgcgaccgtccccctaaccgtaacccgaccgggtaccctaccgggtttacccggtcccccggttcccccggttacgggtaccccgtccccgggttacgtccccggttacccgggacggttaaccccgaccggtaaccccgtacccggtaacggg

SEQ ID NO: 232876 - DNA, 646 bp, Homo sapiens
  misc_feature: GYAE6OF02G3LPX.38.35.D02.1.454.CMB.1.raw
  modified_base (319)..(319): a, c, t, g, unknown or other
  misc_feature (319)..(319): n is a, c, g, or t
  modified_base (537)..(537): a, c, t, g, unknown or other
  misc_feature (537)..(537): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccagccgtggggggtccctgacgactctcctgtgcagcctctggtacttacaacttactaaaaattgtagggatcgacacgtcgggtccnccgaggtcctccgaggcgaacggggctagggtaggtgggtcggacgtaactagtatactatactagagttaggtaaagtttaaagacttagtacggcgtacgtcgtaggtacgggccgtacttccgaacctactcctaccgaagacgaactaacttaccgaagacgactaaccacttactaacttgaactaaagtacgaaactcggaccgtgggaacnccgtaggacggacgaccggtctacgttacgttaactttcgtacggtacgaaccggtaaaccgtaccccggtaccgtacggttaggtacgggggtacggttagttacggg

SEQ ID NO: 232877 - DNA, 835 bp, Homo sapiens
  misc_feature: GYAE6OF02JW0PM.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaacgtcgggttttcctcggtagctcttttaacgaggtgtccagtgtcagatgcagctggtggagtccgtgggggagtcggtggtccaggtccgtcgggggggtccctaggtacggacgttcgtaccgtcggtacgtccggaggtcccttcggttcggtaacgtttcctaaaaccgtttaccggtaaaaaatttaacgtgggggtaactacggtaccgacgttaccgggtccgtacccgaaggtcccgtaccgagggcccgaaacggggccgtagggaggtacggggtgggacctaacggttaactagtcgaacttaagtagtacgtttagggttaaaggtttaaagaccggttaaagtcggtaaccgggtaccgtacgggtttacgggtaaaaccgggtcccggttaactttaacccgaccgttaaacttccccggttacgaaaccgttaaaggaaccctaacgttacccaaaggtaccgaacacccgtaaacggttcttaaaggtttccaaaacctaaggtacccgtaacgtaagtacccgggtagaccgttaccggaagttacgggaacccttacggagttcgttaactaacgggttcctaagggttcggaaaccttaaaacggcccccggttaaccttacgggtttaaacgggccggggttacggggtacttttaacgggg

SEQ ID NO: 232878 - DNA, 640 bp, Homo sapiens
  misc_feature: GYAE6OF02FM64J.38.35.D02.1.454.CMB.1.raw
  modified_base (256)..(256): a, c, t, g, unknown or other
  misc_feature (256)..(256): n is a, c, g, or t
  modified_base (259)..(259): a, c, t, g, unknown or other
  misc_feature (259)..(259): n is a, c, g, or t
  modified_base (263)..(263): a, c, t, g, unknown or other
  misc_feature (263)..(263): n is a, c, g, or t
  modified_base (307)..(307): a, c, t, g, unknown or other
  misc_feature (307)..(307): n is a, c, g, or t
  modified_base (350)..(350): a, c, t, g, unknown or other
  misc_feature (350)..(350): n is a, c, g, or t
  modified_base (371)..(371): a, c, t, g, unknown or other
  misc_feature (371)..(371): n is a, c, g, or t
  modified_base (445)..(445): a, c, t, g, unknown or other
  misc_feature (445)..(445): n is a, c, g, or t
tcagtcgatcacgtcacgaccggtgctcgatttagcacacgatagttgggtttgggggggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcggtggtccaggccgtggggggtcctgagctctcctgtncancctntggattacaacttactaaaattgtggtatgctacgtcgggtccncgagcctcgaggcgaagggctgggaggtgggcgacaacgtatntcatgtgagtagtaaagttanatagcgacgtactcgtaggacggcgtactcacctatctccaagacgaactaactccgaacgcgaccactacttntacttagaactaaactgaaccgaggtaccggtaggacgtacgtaggacgtacgaaccggtctttacgactttaacggttacgtcggtaacggaaccgggtaaaccggttaacccgtcccggttaacggttacggggttacggggttacgggttaacggtttacgtcgggtttaccggtacccgggtaacccgggg

SEQ ID NO: 232879 - DNA, 1019 bp, Homo sapiens
  misc_feature: GYAE6OF02I8SNK.38.35.D02.1.454.CMB.1.raw
tcagtcgatcacgtcacgaccggtgctcgatttagcacacgatagttgggtttggggagctctgggagaggagcccagcactagaagtcggcggagtttccgattcggtgatcagcactgaacacagaggactacaccatgggtagtttgggctagaacgttggtttcctcgtagcttactttaagtaggtgtaccgagttcgtcagagtgcagtacgttcggtggaaggtcggtaggggtagtccggttggtaccgacggtacccggttcggggggttaccctacgggtacgtaaccgtccggttaccgttcgtacggacgttacgcctttacgtacgggttaactttaaccgttaaactttaaaaccgtaaaaaagtttacggtaacggggtacttacggtaccggtaaccggttacggggttacccgccgggtaacggtacccgtaaccggtacggggtaacccgggaacgggggttacgttaacggggacggggtttacgggtaacgggaacgtttaaaaccgtaacgtttaaacgttaaccgtttaaaggttaacgttacgttaaaacgggttaaccgggttaaaagggtttttaaaccgaaaccgtttaaacgtttccgggaaccgggttaaccggttaaccgggttacggggtaaaacccgggtaacccgtttaaccgggtttcccctaaaaccgttaaccgggtttcccgtaaaccggtaacggtaaaacggtacccgtttaaaaaacggttaccgtaaaaccgggtaaaccgttaaccgttaaacccgtaaccgttttaaccgtttaaaacttgtaaaacccgtaacgttaaaccggaccgtttaaacgacccgggttaggaaccggtttaaccggaaggtaaccgggtaaccgtaggttacccggtagttaacccgttagggtttaccgacgggttaaacggaaccggttaacggtaacccgtaacgttcccggtaagggttaaccgggttacgggttacgttaccggg

SEQ ID NO: 232880 - DNA, 763 bp, Homo sapiens
  misc_feature: GYAE6OF02GBIGZ.38.35.D02.1.454.CMB.1.raw
  modified_base (626)..(626): a, c, t, g, unknown or other
  misc_feature (626)..(626): n is a, c, g, or t
tcagtcgatcacgtcacgaccggtgctcgatttagcacacgatagttgggtttgggggggagaggagcccagcactagaagtcggcggagtttccattcggtgatcagcactgaacacagaggactcaccatggagtttgggctgaacgtgggttttcctcgtagcttcttttaagaggtgtccagtgtcagatgcagctggtgagtcgtggggagtcgtggtccgaggtccggtgggggtccctggacgtacctccgtcgtgtcgcagcctcgtaggtattaccgtaactttaactaaaaagtttagtagggtatcgaccgtacgtcggggacccgtccgaacgggtccgtaccggaaggtaccgggaacggggttccgtagggggtaggttcggggttacgggaactaaccggttaattacacgttaagtagtacggtaagttaggttaaaacggtttaaagtaactttaagtcggtaaccggtacggttacccgtaaggggacggtacccgtacttccgaccgtactacccgtacaaggactacctaaactacgaaagtacgccaagtaccttaactttacgttacggaaccttaaacggacgtaaacgacgggttaacccgnggggagtaccggtaggaccggaccgtacggtacttcggtacttagtacgtcggtacggtaaccgaaaccgtcccggttctaacggttacgttacgggggtcggtaaacgttcgtacgggtccggtacggaccccggg

SEQ ID NO: 232881 - DNA, 817 bp, Homo sapiens
  misc_feature: GYAE6OF02GQTCF.38.35.D02.1.454.CMB.1.raw
  modified_base (245)..(245): a, c, t, g, unknown or other
  misc_feature (245)..(245): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtggggagtcgtggtccagccgtgggggtccngagctctcctgtgcgagcctgtcggtattccgtaacttacaaaattagtgggatcgctaacggtccgggtccgccgtacggccgtccgaaggccggaagggggtccgtaggggtaacggtggggtacggacctaaacgtacgttacgtcgtaatagttgtaaggttaacggttaaagtttttaaacggtacttagtacggacgggtaacgtccggtaagggtaacggggtacctaagttacccgtaaccctagttacccgtaaccgtaacggaacgtaaaccttaaacgttaacccgaaacggtaacgtacccaaaccgttaccgtaacttttaacgttttaacggaaacctaaaacggttaccgggttaaaccgccgggttaacccgggtaggggtaaccgggtaccaacgggggttaacgacccgtaacggggttcctttaccggttaccggtttaacgtttaccgggttaacggtacggtaaacccgggtaaacccgggttacccccggtacccgtttaccgggttaccgggggtttacgggggtttacccgggggtatttaacccggg

SEQ ID NO: 232882 - DNA, 818 bp, Homo sapiens
  misc_feature: GYAE6OF02GR50F.38.35.D02.1.454.CMB.1.raw
  modified_base (179)..(179): a, c, t, g, unknown or other
  misc_feature (179)..(179): n is a, c, g, or t
  modified_base (197)..(197): a, c, t, g, unknown or other
  misc_feature (197)..(197): n is a, c, g, or t
  modified_base (363)..(363): a, c, t, g, unknown or other
  misc_feature (363)..(363): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttggctgaactgggtttcctgtagcttcttttaagnggtgtccagttgtcaagntgcagctggtgggagtcgtgggggactggtcggtccaggtcccggtggggggtaccctggaacggtccttccgtcgtcggtagccgtacgcccgtcgtaggtactttaccgaaaccttttaacaaaaagtttcgtaggggaatcgcgtaacgtcgggggttacccnccgtaagggcccttaaccggacggtacggtaaacggggggccttaagggggcgggtttacgggggtcggaccgttaaaacgttaattaaggtacctaaactttaagaccgggttaaggtttaacgggttaaaaagggttttaaaaacctagtaacggttacgggtacccgggtaacttacccggggtagggaaacggggttccgtaaacgtttccaaccgttaccgtaaccttacccggaaacgtaacgtaaacctaaccgttaccgaaacgggacctaccaaaccgttaccgttacttaacgttttacgtaaacgaaaagttacgaaaacgtcgccgggtttaacgggatccggtaaagaccgggtaccacggtacgttgtaccgtaagttacgtcggtacgaaacggtaacgacccgtaccgttaggacgttcggggttacggtaagttccgg

SEQ ID NO: 232883 - DNA, 889 bp, Homo sapiens
  misc_feature: GYAE6OF02IC3KE.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccagtggtagttggctagaacgttcgggttttcctcgtagccttacgttttaagaggttcgtccaggtcgtacagagtgctaggtcgtggtggagttcgggtagggggagtcggtcggtccgacggtccgggtcggggggtaccctggacgtacctctccgtgtcgcgaccgtccgtacgtacgtacttactaacgttaaactaaaagttagtagggtacttacggacgttaccggttaccgggtcccgaaccccgtaacggtacccgtaccggtaacgggtaccgggtaacgggggtaccgtagggttacggggtcgggttaacggtaacccgtaaaacgttacgtaaacgttaccaaaggtttaattaaggtaaggttttaaaacgggtaaaagtttaaaaaccggtcgttaaacgttcgggtaaacccggttaacccggtaaccggtaaccggggtaaaccggtaccggtaaaccgttaccgtaacccgtaacgtaccctaacgaaacgtaacggtaaaacccgtaacgttaaaccggaaacgtaacgtacccgtaaccttaaccgttaacttaccgtaacgaacttaaacgaacggtaacgtacgtaaccggcggtaacgtaccgaacggaccgtaaccgtacggtacgttaacgttacgttaacgtaaggtaacgtaaccggtaaaccgtaaacccgtacccgtacccggttaacggtaaccggtttcgggttaccgggtaagtttacgg

SEQ ID NO: 232884 - DNA, 829 bp, Homo sapiens
  misc_feature: GYAE6OF02H9PT4.38.35.D02.1.454.CMB.1.raw
  modified_base (209)..(209): a, c, t, g, unknown or other
  misc_feature (209)..(209): n is a, c, g, or t
  modified_base (366)..(366): a, c, t, g, unknown or other
  misc_feature (366)..(366): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccagtggaggtttgggctgaacgttgggttttcctcgtagcttcgttttaaggaggtgtccagttgtcagatgcncgtcgtggtaggaggttcggtgggggtgtcggtcggtccgacggtccggttcggggggtccctggacgtcgtcgtccgttgcggctacggtctacgtgtaattactaacttaactaaaaagttacgtagggtatgtacacggttcggccacgcgtcncccgtaaggcggtaacgggtcgtgggtaacggtcgggtagacgtaatttaactacgtagaagtttacgaagttaagttaaggtttaaaacgtttaaggaaacctttaggtacgaccgggttaacgtaccgggtaaagggaccgggtaccgtaccgttaacctaaccggttactaccgttaacgaaccgaaacggttaaacctaaaccgttaaccgaaagacggtaaactacccgttaaaccgttagttaaaccgtttaacggaaaaccttaaaggtaaacgaaaccgtccgtaaccggttaaagggtactaacgggtaggaaaccggaaccggttacgtacgtttagttaccggtttaaaggttccgtaacggggtaacggttaaacccggtaaaccggtaaccccgttcggggtttaaccggtcggggtttaaacggggttaccggggtaagtttaccgggg

SEQ ID NO: 232885 - DNA, 883 bp, Homo sapiens
  misc_feature: GYAE6OF02FR2CI.38.35.D02.1.454.CMB.1.raw
tcagtcgatcacgtcacgaccggtgctcgatttagcacacgatagttgggtttggggagctctggagaggagcccagcactagaagtcggcgagtttccattcggtgatcagcactgaacacagaggactcaccatggtagtttgggctagaacgtggttttcctcgtagcgttacttttaagaggttgtaccagtgtcagatgcagcgtggtgagtcgtggggagtcgtcggtccaggtccggtcgggggtccctggacgtaccgttccgtccgtgtcgccacggccttcgtgggtatttccaaacctttaacgtaaaaaatttcgtggggtaattcgactaaccggtcgggtcccggtccgaacggtcccgtaccggaaggtaacccggaagggggtaccgtagggggtacgggttcgggggtacggttaccaaaacggttaacttaacgttacgaacgttaattaggaaaggtttaacggtttaaaaaggttttttaaacgaaacgtttaggtaccggtacgggtaacccgtttcccgggtaaggaacccggggtaccgttaaccgttaccgtaacctaccgttaccgtaacccggagtaaacccgaaccgttaaacggtttaacccaaaggtaccgacgttaaacccaaccgtttacgttagtttaacgaaactaaaacgtacgtaaacggtaccggttaaccccgtagggtaacgtaccgtaaagggaaccggacccgtaacggggttccttaacggtttacgtttaacctttaggtaacgggttaacggtaaaacccggtaaaacccgggaccccgggtttacccgtttaaacgggtccgggggtttaacgggggttaccggggtttattaacgggg

SEQ ID NO: 232886 - DNA, 805 bp, Homo sapiens
  misc_feature: GYAE6OF02FOOX0.38.35.D02.1.454.CMB.1.raw
tcagtcgatcacgtcacgaccggtgctcgatttagcacacgatagttgggtttgggggagctctgggagaggagcccagcactagaagtcggcggagtttccattcggtgatcagcactgaacacagaggactcaccatggagtttgggctgaactgggttttcctcgtagctcttttaagaggtgtccagtgtcagatgccagcgtggtggagtcggtgggggtagtccggtggtccaggtccgtggggggtcccctggacgtacctccgttccgtagtcgcacgccttctgggattacctaacctttaactaaaaagtttatacggggtaattcggccgtaacgttcgggggtaccccgtccggaaccgggtccgttacccgacggggtaccgaaacgggggtcgttaggggtacggggttaggggttcgggaacgttaaaccgtagttaaacttccgtaaagttagtaggtaagttacgggtttaaaagttttaaaacggtaacgttaagtcggtaccggtacgttcccggttaaggaccgggtacgtaactaccgaccgtactacctacgacgtacgaaacgtaacgttaacccggaataccggacctaaccctaccgtactttagtttaaccgaagttaaacgtaccgtaaaccgacgtacccggtagggtaaccgtacgagggtccgggaacgcccggtagtccgttacttaaggttaccttacgggtacgtaacgggaacccgtacccgggttacccaacggtttacgggtacggggttagggttacgtttaaccggg

SEQ ID NO: 232887 - DNA, 794 bp, Homo sapiens
  misc_feature: GYAE6OF02H0WT3.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgacacagaggactcacatggagtttgggctgaactgggttttcctcgtagctctttaagaggtgtccagtgtcagatgcagcgtggtggagtcgtggggagtcgtggtccagccgttcggggggtcccttggagtaccgtcgttccttggtggactacgtccttccgtggacttacaaactttacgtaaaaacttgtagggattcgcgtacgtcgggtaccgccgaggtcctccgacggcggtaaaggggccttgggacgtcgggtacggaccgaacttagtactactagtaagtcggaataagggttaaaaggttttaaacgacgttaagttcgggtaacccggtacggtttaccgtaaggggtaaaccggggtaaccggtacttttacccggaaacccgttaactccccgttaaacccggtaaggtaaacccgtaacggtaaacctttacccggaaaacgttaaccggaaccttaaaccggtacctttaacttaacgtttaggaaaccctaaaagttaacaacccggtaacgttcccggtaagggacctggtaacgacggaaaccgtcccgggtatacgttacgttactttaccggtagggtaacgtaaccggtaaaccgggtacccgttacccgtacggtaacggtcgggggtttaccgggagtttaaccggg

SEQ ID NO: 232888 - DNA, 700 bp, Homo sapiens
  misc_feature: GYAE6OF02FLK82.38.35.D02.1.454.CMB.1.raw
  modified_base (387)..(387): a, c, t, g, unknown or other
  misc_feature (387)..(387): n is a, c, g, or t
  modified_base (410)..(410): a, c, t, g, unknown or other
  misc_feature (410)..(410): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagctctttttaagaggtgtccagtgtcagatgcagctggtggagtcgtgggggagtcgtggtccagccggtcgggggtccctggagactcctcctgtgcacgcctcgtggtacttacctaaacttaactaaaaattagtagggatcgacctacggttcggggtcccgaccgaggcctccggaggacgaaggggctagggaggtgggtgacaatatactnatatgagttaggtaagtttaaanactagtgacggtactccgtagggacggtccgtaatccgaacctactcctacgaagtaacgaactactaaccgaagacgactaacctacgttacttaatttcaaacgtaaagttaacgaactaacggtccggtagggaacgtccggtaagaacggtaacccggacggttactacggtttaacgtttacgttacggttcgggtaaaccggtaaacgggtaaacccggtaacccccggttaccgttaaccgggttacgggtttacccggggggttacgggttaagtttacggg

SEQ ID NO: 232889 - DNA, 681 bp, Homo sapiens
  misc_feature: GYAE6OF02JUY8T.38.35.D02.1.454.CMB.1.raw
  modified_base (573)..(573): a, c, t, g, unknown or other
  misc_feature (573)..(573): n is a, c, g, or t
tcagtcgatcacgtcacgaccggtgctcgatttagcacacgatagttgggtttgggggagctctgggagaggagcccagcactagaagtcggcggagtttccattcggtgatcagcactgaacacagaggactcaccagtggagtttgggctgaactgggttttcctcgtagcttcgtttaagaggtgtccagtgtcagatgcagctggtggagtcgtgggggagtcgtggtccaggccgtgggggtaccctgacggcttcgtcctggtagcgagcctcgtaggtattacctaaacgttactaaaaagtttcgtgggatgtccgtacgtcggggtcccaccggtaacgtccgttcccgaaagggcgtaacgggggtcctggggagggtcggggtacggactaacgtattagtacgtaacgttagtacgttaggtaacgggtttaaagttttaaaacgctaaagtcggtaccgggtaaccttccgggtagggaaacgggtccgtaacttacgacctaacgtcgtacctaagacgtaactaacgtacaagtacgacacgtacctagtattcgaanaacgtacacgacgcgtaggatcgtagaacgagcgtactgtaacgtactcgtacggtcaaccggtaaccgaccggtcccgtagtaacggtcgggtagggttattacggg

SEQ ID NO: 232890 - DNA, 586 bp, Homo sapiens
  misc_feature: GYAE6OF02IYPCH.38.35.D02.1.454.CMB.1.raw
  modified_base (356)..(356): a, c, t, g, unknown or other
  misc_feature (356)..(356): n is a, c, g, or t
  modified_base (437)..(437): a, c, t, g, unknown or other
  misc_feature (437)..(437): n is a, c, g, or t
  modified_base (472)..(472): a, c, t, g, unknown or other
  misc_feature (472)..(472): n is a, c, g, or t
  modified_base (488)..(488): a, c, t, g, unknown or other
  misc_feature (488)..(488): n is a, c, g, or t
  modified_base (534)..(534): a, c, t, g, unknown or other
  misc_feature (534)..(534): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaacttgggttttcctcgtagctcttttaagaggtgtccagtgtcagatgcagctgggtggagtcgtgggggagtcggtggtccagccgtggggggtccctggagactctcctgtcgcacgcctcgtggtacttcaacttacaaaaattgtgggatgctacgtcgggtccgcgaggcctccgaggcgaaggggctgggaggtgggngactaacgtatatcaattatgagtaggttaaagttttaaagactagcgacggtactcggtaggacgggtcctattaccacnctctccagacactaatacaagacgcactactcttnttagactaatagaacncgcgtagggactcgtagacggtacgcgtactggtactagttaccgngtacgaacggaaacgtacccggtcttacgtaggtcgggtacgggtagttacg

SEQ ID NO: 232891 - DNA, 741 bp, Homo sapiens
  misc_feature: GYAE6OF02F9238.38.35.D02.1.454.CMB.1.raw
  modified_base (224)..(224): a, c, t, g, unknown or other
  misc_feature (224)..(224): n is a, c, g, or t
  modified_base (375)..(375): a, c, t, g, unknown or other
  misc_feature (375)..(375): n is a, c, g, or t
tcagtcgatcacgtcacgaccggtgctcgatttagcacacgatagttgggtttgggggggaagaggaagactgacggtcctgccacaggtggtgctgggcacggtgggcactcgacacaacatttgcgctcaactgtcttgtcagccgtgggggtccctgagactctcctgtgcagcctctggattcaacttacaaaaattgtgggatcgctacgtcggtaccnccgaggtcctccgaggcgaaggggtctgggagggtgggtcggactaacgtatacgtcatagtgaagttacggttaaagtttaagacttagcggcggtactccggtaggaacggcctaagtccacatccgagagacacctaataccaggacnctacctacttcgttaagttcgaactaacgtacgaaacgtcggtcgtaacgggacgtcgttaagggaccgtaacgaccggtagttacgttacttaacgttacgtacggttacgaaacggtaaacccggtacccgtacccgttcgtaacggttggggtacggtttacgttacggtacgttcgggtaccgggacggtaacccggtaccggtccggacccgtaccgttaccgtccgtaccgacccgtactacccggaacgtacccgggtcctaaccgttccggtttccccgtaccccgttccgggtccccgttaccgtccggtaaccgtacccggtaaccggtaccgacccggtacccgtaccggaaccg

SEQ ID NO: 232892 - DNA, 692 bp, Homo sapiens
  misc_feature: GYAE6OF02IXOOO.38.35.D02.1.454.CMB.1.raw
  modified_base (298)..(298): a, c, t, g, unknown or other
  misc_feature (298)..(298): n is a, c, g, or t
  modified_base (556)..(556): a, c, t, g, unknown or other
  misc_feature (556)..(556): n is a, c, g, or t
  modified_base (683)..(683): a, c, t, g, unknown or other
  misc_feature (683)..(683): n is a, c, g, or t
tcagtcgatcacgtcacgaccggtgctcgatttagcacacgatagttgggtttggggagctctgggagaggagcccagcactagaagtcggacggagtttccattcggtgatcagcactgaacacagaggactcaccatggagtttgggctgaactgggttttcctcgtagctcttttaagaggtgtccagtgtcagatgcagcgtggtggagtcgtggggagtcgttggtccaggcctggggggtccctgacgtaatccttccgtgtgccagcctcgtggtattaccgaacctttanaaaaagtttagaggggtatcggacctaacgttcggggtacccaccgtaggacccgttcgaacggtcgaaacgggggcttgggaacggttggggcgtactaacgtagtaacgtctaaagttatggtaagtaggtaaaacgttttaaagacaagttcgacggtctaggtaacggacggtacgatacaaccgtataccgtctaagacgtaactaacgttaccaaagacgacgtaacacgttactattacgagtaaacgtanaaccgtactacgtacggtagtacggtacgaaggtacgaccgtacgtacgtaccgtttaacgttaacgtggtaccgtaacggtaacggtaacccggtacccgtacgttacggttacggtacggggttnttaaccggg

SEQ ID NO: 232893 - DNA, 935 bp, Homo sapiens
  misc_feature: GYAE6OF02FY9P5.38.35.D02.1.454.CMB.1.raw
tcagtcgatcacgtcacgaccggtgctcgatttagcacacgatagttgggtttggggagctctgggagaggagcccagcacctagaagtcggcggagtttccattcggtgatcagcactgaacacagaggactcaccatggagtttgggctgaactgggttttcctcgtagctcttttaagaggtgtccagtgtcagatgcagcgtggtggaggtcgtgggggagttcgtcggtccacggtcccggtggggggtccctaggacgacctcctccgtgtcgcacgcctcgtcggattcctaaccttacaaaaaatttagtaggggtatcggactacgttcggggttccgcccgtaaggtcccttaccggaacgggccgaaagggggtccgtaggggtacgggttagggggttcggtaactaaacgttagttacttacgaagttaagtgtaagtgggttaaaaacgtttttaaaacggacctttaagtacggtacccggtaaccgttcccgggttaggaaaccggggtccgtaaacgtttccccggaacctaacgttcccgtaacccgtaacggtaaccgtaaaaccgttaaccgttttaacccgaaaacggttaacccggaaaccgtaacccgtaaaccgtttaccgttaacggttttttaacccggaattaaaaacccggtggttaaaacccgtaaaccggtacccgggtttaaggggtaacccggtttaacggaagggtacccgggtaaacccgggttaccgggaccccggttttaggttacccggttttaaacctttacgggttaaacccggtttgggtaaaacccccgggtaaaaccggttaacccccccgggttaccccgttttaaacccggggttaccggtttacccggggggggtttaaaccgggggggttttacggtttaaaccccggg

SEQ ID NO: 232894 - DNA, 722 bp, Homo sapiens
  misc_feature: GYAE6OF02HHAXN.38.35.D02.1.454.CMB.1.raw
  modified_base (335)..(335): a, c, t, g, unknown or other
  misc_feature (335)..(335): n is a, c, g, or t
  modified_base (342)..(342): a, c, t, g, unknown or other
  misc_feature (342)..(342): n is a, c, g, or t
  modified_base (361)..(361): a, c, t, g, unknown or other
  misc_feature (361)..(361): n is a, c, g, or t
tcagtcgatcacgtcacgaccggtgctcgatttagcacacgatagttgggtttgggggggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtggggagtcgtggtccagccgtgggggtccctgagactctcctgtgcagcctctggattcaacttactaaaattctagggatgactacgtcgggtcccgacaggctccgaggcgaaggggctagggngtcgggngactaatagtatcgatagngtagtagtaaagtttaagacttacgtgacggtactcggtacggacgggtccattacacctagtctaccagtaacgtactaaacgttaccgaaagacgactaacctaaccttacttactttacgacctaaaagttcaaaccgtacggtaccggttaacgggacggtaccgtacgggtaacggtaacgtacccggtagttaccggttacttaaccgttccggtaggttaaccgggaaaccgggttaaaaccccggtacccggggttaccccttaacggttaccggggtttacggggggtaacccggggtttaaggtttaaccgggttacgggttacccggggttacgggggtaacccccgggg

SEQ ID NO: 232895 - DNA, 716 bp, Homo sapiens
  misc_feature: GYAE6OF02IEWFU.38.35.D02.1.454.CMB.1.raw
  modified_base (114)..(114): a, c, t, g, unknown or other
  misc_feature (114)..(114): n is a, c, g, or t
  modified_base (163)..(163): a, c, t, g, unknown or other
  misc_feature (163)..(163): n is a, c, g, or t
  modified_base (208)..(208): a, c, t, g, unknown or other
  misc_feature (208)..(208): n is a, c, g, or t
  modified_base (244)..(244): a, c, t, g, unknown or other
  misc_feature (244)..(244): n is a, c, g, or t
  modified_base (418)..(418): a, c, t, g, unknown or other
  misc_feature (418)..(418): n is a, c, g, or t
  modified_base (431)..(431): a, c, t, g, unknown or other
  misc_feature (431)..(431): n is a, c, g, or t
tcagtcgatcacgtcacgaccggtgctcgatttagcacacgatagttgggtttggggagctctgggagaggagcccagcactagaagtcggcggagttccattcggtgatcagnactgaacacagaggactcaccatggagttgggctgaacttgggttttcncgtagcttcttttaaggaggttgtccgagtgtcgagagtgcgagngtgggtggaggtcggtgggggagtcggtggtaccgnggtccggtggggggtacctggtaagtccgtctccgtgtgaccgtgtccgtcgtcggtattactactaaactaaagttaggtggtaatggacccgtggttccggcccgacgtacgtaccgtcgacggacggaaggggtccgtaggggtacggttagggtccggaagtaacgttanaactgtaaacgtntagtaggttaaggttaaacgttaaacgtataggttacgacggttacgtaacggtcggtaacggtacgtactctaaccgtcgttacacgagtaacgtactaccgtaacgacggtaactaccgtaactacgtattactagtaacctaaggtaaccgtacgaacccgttaggacgtagtaccggaaggacgtacgtaccgtcgtaccgttacgtaacgttgtacggaacgtaaccgaaccggtaccgtaccgtaggttaccgggtcgggttacgggtagtttaccggg

SEQ ID NO: 232896 - DNA, 737 bp, Homo sapiens
  misc_feature: GYAE6OF02JV7E2.38.35.D02.1.454.CMB.1.raw
tcagtcgatcacgtcacgaccggtgctcgatttagcacacgatagttgggtttggggagctctgggagaggagcccagcactagaagtcggcggagtttccattcggtgatcagcactgaacacagaggactcaccatggagttgggctgaacttgggttttcctcgtagctcttttaagaggtgtccagtcgtcagatgcagcgtggtggagtcgtggggagtcggtcggtccgacggtccggtcggggggtccctggacggtcctctccgtggtgccgagtcctcgtggacttacaactttaacaaaaattagtagggactgtaccgtacgttggggtaccccgaccgtagggtcctcccgaagggtaccggtaaacgggggtcgtacggggaagggttcggggtaggtaactaaacggttaatacgttaccaagtttaacggtagtaggtttaaagggttaaaaacgttttaaagaacctttaaggtcgtaaccggggtaaccgttaccgggtaacggtacggggtaaccgtaacctaccgtacccgtaactacccgtacgaaacggtacaaacgttaaacctaacgtaaacgacgtacaacctacgttaccttagttacgaaacattaagaaccgtacgacggtggaccgtggaacgacgacgtcggtatcgtatctagtcgtaagaccgtaacgtcccgtactagttagggtacgggtcggttagttacggg

SEQ ID NO: 232897 - DNA, 775 bp, Homo sapiens
  misc_feature: GYAE6OF02G18VH.38.35.D02.1.454.CMB.1.raw
  modified_base (306)..(306): a, c, t, g, unknown or other
  misc_feature (306)..(306): n is a, c, g, or t
tcagtcgatcacgtcacgaccggtgctcgatttagcacacgatagttgggtttgggggggaagaggaagactgacggtcctgccacaggtggtgctgggcacggtgggcactcgacacaacatttgcgctcaactgtcttgtccagccgtggggggtccctgagactctcctgtgcagcctctggattcaacttacaaaaattacgtgggatgcacgtcgggtcccgccgacggcctccgaggccgaaggggtctgggaggtggggcgtactaacgtatatacatatgacgttaggtaagtttaanactatcggcgtacgtcgtggaacggccgtattccacactctaccagacgtactaacgttaaccgaagactccaacttaccgttactttaacgtttacgaaacctaaataaccgttaaacgacccgtttaccgggtacggggtaaacgttcgtaacgggaaacggtacccgtaacggttacctttaggtttaaccttaacgttttacgtagggtaacccggaaacggttaaaaccggaccccgttctttaccggaacgggttcggggttagggtaacgtttaggtcggttaccggcggggtaacccgaccgggtacccgtaccgggtaccctacggtcccttaccgtaccgccccgtaccgtaacccaccgggtacccgtcccgttaacggtccccggtttcccctacccggcccggttaccacccggtcttacccggtacgcccggacctccgtacccggacgaaccgg

SEQ ID NO: 232898 - DNA, 602 bp, Homo sapiens
  misc_feature: GYAE6OF02GJIIT.38.35.D02.1.454.CMB.1.raw
  modified_base (286)..(286): a, c, t, g, unknown or other
  misc_feature (286)..(286): n is a, c, g, or t
  modified_base (437)..(437): a, c, t, g, unknown or other
  misc_feature (437)..(437): n is a, c, g, or t
tcagtcgatcacgtcacgaccggtgctcgatttagcacacgatagttgggtttgggggggagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcggtggtccagccgtggggggtccctgagactctcctgtgcagcctgtggattcaacttacaaaaattntggatgacacgtgggtccgccaggcctccgaggacgaaggggctgggaggtgggtggactaactatatcatatgataggtaaatttaaagatatgacgtacgtcgtaggaacggcctatcgaccatcctacagacgacaataccgaagacnccactaccgtcttaagttcgaactaaatcgtaaacacgtaccgtagggacgtacgtagacgggaacctacgggccttagtacttattacgtagtacggaacgaaacggacccggtccgtacgtaggttcgggtcgggtaagttagtcggtacggtcgggacccgg

SEQ ID NO: 232899 - DNA, 743 bp, Homo sapiens
  misc_feature: GYAE6OF02H6ASO.38.35.D02.1.454.CMB.1.raw
  modified_base (667)..(667): a, c, t, g, unknown or other
  misc_feature (667)..(667): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaactgggttttcctcgtagcttcttttaagaggtgtccagtgtcagatgcagctggtggagtcgtgggggagtcggtggtccaggccggtggggggtccctggagtccgtctccgtgtcgcgacgtcctcgtggtattaccaacttactaaaaattgtgggtattgactacgtcgggtccgaccgaggtcctccgacggacgaacgggggtctgggtaggtcggggtgaccgtaaactagtacgctaaagtgtagtaacgttaggttaaaagttttaaaacgggtactttaagtcggtaccgggtaaccgttccggggtaaggtaaccgggggtaccgtaacgtttacccgaaacccgttagttaccctaccgaaaggaaccgtaactaaacgttaccgaaagaacgtaccctaactaccttacgttaataccgtaactaaaacgttacgaaccgtacgccgtagggaacgtcgtacggaacgaccgtacggtacgtacgttactaacgtttacgnggtaaccggaaacccgtaaaggtaccccggtaccgttacggttacggggtacgggttaccgggtagtttaaccggg

SEQ ID NO: 232900 - DNA, 740 bp, Homo sapiens
  misc_feature: GYAE6OF02FH5ZK.38.35.D02.1.454.CMB.1.raw
  modified_base (705)..(705): a, c, t, g, unknown or other
  misc_feature (705)..(705): n is a, c, g, or t
tcagtcgatcacgtcacgaccggtgctcgatttagcacacgatagttgggtttgggggggaagaggaagactgacggtcctgccacaggtggtgctgggcacggtgggcactcgacacaacatttgcgctcaactgtcttgtccagccgtggggggtccctgacgactctcctgtgcagcctctggattcaacttacaaaaattgtgggatgactacgtgggtcccgcacggctaccgaggacgaagggggcctggggaggtgggtgggacctaactagtactacatagtgtagtaggtaaagtttttaaacgacttagtggaccgggtacctaccggtaggaacggggtccgtattccgacctatacccgacgagtaaccgaactaattaccgaagacgacctacgtacttcttaagttcgaactaaatacgaacgacgcgtaacgggagtacgttaggacggaaccgtccgggacttacggtacttacgttacgtaaggtcgaaaccgaaaccggtaacccggtcctacgtacgggttacggggttaccgggtagttacgttccgggcgttaccggggaccgtaaccgggtacccgaggtacccccgtacgtccctccgtaccgaccgtacccgtaccgaacccggacccgtccgacggtcccgttccccgttaccccggcggtaccccgttccacggtaccncccggaacggtccacccggtacgtcccggtaacgg

SEQ ID NO: 232901 - DNA, 741 bp, Homo sapiens
  misc_feature: GYAE6OF02I5A9E.38.35.D02.1.454.CMB.1.raw
  modified_base (168)..(168): a, c, t, g, unknown or other
  misc_feature (168)..(168): n is a, c, g, or t
  modified_base (545)..(545): a, c, t, g, unknown or other
  misc_feature (545)..(545): n is a, c, g, or t
  modified_base (715)..(715): a, c, t, g, unknown or other
  misc_feature (715)..(715): n is a, c, g, or t
tcagtcgatcacgtcacgaccggtgctcgatttagcacacgatagttgggtttggggatcacataacaaccacattcctcctctaaagaagcccctgggagcacagctcatcaccatggactggacctggaggttcctctttgtggtggcagcagctacaggtgtccngtccccaggtgcaggttggtgcagttcgtgggggtctggaggtaggaagaaggccgtggggtccgtcggtggtaacggtccccctagccgaaggtccttcgtcggggaggtccctaccgttccaggccgaaccttaacttacctttccgaacgggtccgttacggggttcgaccgacggaaccggcccccggttagggaaccgtaaggggtcttcggacggtgggtaggtacggggacgggtagttccccctcgtattccggtttaggaacccgaaaccgacaccgtacccggacgaacccaacgtaacggtttaccgaaacggtaccaacgtactcccgaacgttccgtaccggcgggaaccgtactcccgacganaccgaactacggtaccacgtagtaccggagtataggtacgttacgacctacggagtaactcgtacgacgaccggtacccggtccggtttagttaacgttcggtagttacggacgtggacggggtccgggtaccggacggggttgtacgggtagttaacgggtggtacgtntttacggtagttcggaccggtacggg

SEQ ID NO: 232902 - DNA, 715 bp, Homo sapiens
  misc_feature: GYAE6OF02IS27V.38.35.D02.1.454.CMB.1.raw
  modified_base (416)..(416): a, c, t, g, unknown or other
  misc_feature (416)..(416): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcaccatggagtttgggctgaacttgggttttcctcgtagcttcttttaagaggtgtccagtgtcagatgcagcgtggtggagtcgtggggagtcggtggtccaggtcccgtggggggtccctggacgactctcctgtcgcagcctctggattccaacttacaaaaagttatgggatgctacggtcgggtccgccgtaggcctccgacggacgaaggggctgggtaggtggggtgaccgaaactagtataccaattatgagtagggtaaagttttaaagattaangtacggactcggtaggaacgggaccgtattccgaaccactaccctccgtaacgacgtaactaaacttaccgaaagacgtaccctaacctaccgttacttaacgtttacgaactaaagttacgaaaccgaacgtaacccggtagggaacgttacgttacggaaacgggtaccgtacgggtccgttacggttacgttaaccggttttacgtaggtaacggtaaccggtaaaaccggaaccccgggttacccgttaccggttaccgggtttaccggggggttacgggttacggtttaacggg

SEQ ID NO: 232903 - DNA, 818 bp, Homo sapiens
  misc_feature: GYAE6OF02G213H.38.35.D02.1.454.CMB.1.raw
  modified_base (179)..(179): a, c, t, g, unknown or other
  misc_feature (179)..(179): n is a, c, g, or t
  modified_base (687)..(687): a, c, t, g, unknown or other
  misc_feature (687)..(687): n is a, c, g, or t
tcagtcgatcacgtcacgaccggtgctcgatttagcacacgatagttgggtttggggagctctgggagaggagcccagcactagaacgtcggcggagtttccattcggtgatcagcactgaacacagagactcacatggagttggctgaacttggtttcctgtagcttcgttttaaggnggtcgtaccgaggttagtcagtatgcgagtcgtgggtggagtcggtgggggtacgtcggtcggtaccgacggtccgggtcggggggttccctaggacgtaccgttcctcgtggtcgacgtacgtccgtcgtgtactttacgtaaactttaactaaaaaagttggtacggatacgtaccgtaacggttcgggtaccgtaccgaacgtccgtaccggaacgggtacggtaaggggtaccgttaggggtacgggttacggggaggtaaccgtaaacgttagtaccgtaataagtagttacgtaagggtttaacggttaaacgttttaaaggacttaagtacgggttaccggaacggttccgggaaagggtaacccggtcggtaaacttacccggtaacgtaccgttcgtacgtaaaggaacgttaaccgttaaacgtaccggaagtaaccgaaccaacgtaacttcgttaatacggaaactaaccgtaagaacgtagtaccgtagggaccncggttaagaacccggtagtaccggatttaccgtacgtttaagtaccggttacgtaccggtaaaacggtaacccggttacccggttacgttaaccggtaaggggtttccggggaacggtttacgttaccggg

SEQ ID NO: 232904 - DNA, 830 bp, Homo sapiens
  misc_feature: GYAE6OF02JQ37Q.38.35.D02.1.454.CMB.1.raw
  modified_base (122)..(122): a, c, t, g, unknown or other
  misc_feature (122)..(122): n is a, c, g, or t
  modified_base (312)..(312): a, c, t, g, unknown or other
  misc_feature (312)..(312): n is a, c, g, or t
tcagtcgatcacgtcacgaccggtgctcgatttagcacacgatagttgggtttgggggggaagaggaagactgacggtcctgccacaggtggtgctgggcacggtgggcactcgacacaacntttgcgctcaactgtcttgtccagccgtggggggtccctgagtactctcctgtgctagcctctggattcctaacttctaaaagttgtgggtatgcacgttcggtcccgctacggcttccgagggaccgaagggggcctaggggtacggtcggggtttcggaccctaattacgtaacgttactagttacgnggtagtaacggttaagttttaaacgacctagtacgaccggtaacgtcgttaggaaccggggtcctagttacccacctagttccctacgaaggtactaacggtacttaccgaaggactaccgactacttcgtacttgacaaacgttcgacacggcgttaggggcctacgacggtacgggaactccggactttacgtaccgtatttaccggagttaccggaaccggaacgtaacccggccttagtaccgggtagggttaccggtagttacggtacgtcgggtcccgggtacgggtaaccggttcccgggtaacccgttaccccgtaccggggttcccttaacggtccgggtacccgtacccggtttaccccggaaaccgggtaacccggttcccgtaccgtttaccccgggttaaccccgggttccccgtaacggggttcccccgaccccggttaccgggtcctttaaccccggggacccggtaccggtacccccgttacccgggtaccccgtaaccggg

SEQ ID NO: 232905 - DNA, 668 bp, Homo sapiens
  misc_feature: GYAE6OF02JVFJ5.38.35.D02.1.454.CMB.1.raw
  modified_base (293)..(293): a, c, t, g, unknown or other
  misc_feature (293)..(293): n is a, c, g, or t
  modified_base (359)..(359): a, c, t, g, unknown or other
  misc_feature (359)..(359): n is a, c, g, or t
  modified_base (374)..(374): a, c, t, g, unknown or other
  misc_feature (374)..(374): n is a, c, g, or t
  modified_base (482)..(482): a, c, t, g, unknown or other
  misc_feature (482)..(482): n is a, c, g, or t
tcagtcgatcacgtcacgaccggtgctcgatttagcacacgatagttgggtttggggaggctctgggagaggagcccagcactagaagtcggcggagtttccattcggtgatcagcactgacacagaggactcaccatggagtttgggctgaatgggttttcctcgtagctctttagagtgtccagtgtcagatgcagcgtggtggagtcgtggggatcggtggtccgagtccgtggggggtcccctggacgactcctcctggcgactcgcctcgtaggacttacaaccttanaaaaatttcgtgggatgcctaacgtcggtccgcgtaggccttccgaggtcgacggggcaggtaggngggtcgacgacgtanacgtcagtatcggattacggtaattaagacttagtagacggtcgtaacgtgggtacggacgtatccggtaactcgtacgtccgtagataaccgtattacgaagtaacnccgaactacgtacctagttacgaactaacgttagaacgtcgttacgtagggacgttccgaggtaaacggacctacggtacgtctttaaccgtacgttacgtttggaaccggtaaccggtaacggtaaacccccgggttccttaaccgggttaacggcggggtttacccggggtatttaacccgggg

SEQ ID NO: 232906 - DNA, 766 bp, Homo sapiens
  misc_feature: GYAE6OF02IWZCY.38.35.D02.1.454.CMB.1.raw
  modified_base (167)..(167): a, c, t, g, unknown or other
  misc_feature (167)..(167): n is a, c, g, or t
  modified_base (189)..(189): a, c, t, g, unknown or other
  misc_feature (189)..(189): n is a, c, g, or t
  modified_base (323)..(323): a, c, t, g, unknown or other
  misc_feature (323)..(323): n is a, c, g, or t
tcagtcgatcacgtcacgaccggtgctcgatttagcacacgatagttgggtttggggagctctgggagaggagcccagcactagaagtcggcggagtttccattcggtgatcagcactgaacacagaggactcacatggagtttggctagaacgttcgggttttccncgtagtctttacgttttaaggnggttcgtaccaggttcgtcaagtgtgaccgtagtcgttgggtagggaggttcgggtagggggtagtcgggttgggtaccgcggtccgggtcggggggtaccctggtaccggtacttccgtccgttggtcggacncggtccctgtaggtactttacgtaaccttaaagtaaaaacgttgtacggtagtcgaccgtacggttcggacccgtcctaacggccgtaccggaaggaccggtaaggggtccgaggggtacggttggggaccgagtaaaccgttgtaaccgtagtaagttagtaagtaggtttaaacgttaaaggtttaaacgagttagtcggacggtaccgttaccggtagggtaaccggtccgtaactcccggtaaactacgtcccgtaacgtaagaccgtaactaccgtaacgagacgtaaccaccgtattacgtatacgaacgtaaactaccgacgtaccgtaccggtagcgtaccggagtaccgagtacccgtgtaccgtagttacgtacgacggtacaaccggtaacgtacccgtacgttcggtaagggtaccggtggtacttacggg

SEQ ID NO: 232907 - DNA, 221 bp, Homo sapiens
  misc_feature: GYAE6OF01EGPXU.48.73.G07.1.454.CMB.1.raw
  modified_base (220)..(221): a, c, t, g, unknown or other
  misc_feature (220)..(221): n is a, c, g, or t
tcagagtatacatacacgaccggtgctcgatttagctctacgctcagggcgacgaccggtgctcgattagctctacgctcagggcacgaccggtgctcgatttacgctcgatatagttggttggaccaaggtggaagtcaacgactgtggctgcaccatctgtcttcatcttcccgccatctgatatgtatactctgagcgggctggcaaggcgcatagnn

SEQ ID NO: 232908 - DNA, 129 bp, Homo sapiens
  misc_feature: GYAE6OF01B6IM0.48.73.G07.1.454.CMB.1.raw
  modified_base (129)..(129): a, c, t, g, unknown or other
  misc_feature (129)..(129): n is a, c, g, or t
tcagagtatacatacacgaccggtgctcgatttagctctacgctcagggcacgaccagtgctcgatttagagctcacgtattgggtttggggtttttaggtatctgagcgggctggcaaggcgcatagn

SEQ ID NO: 232909 - DNA, 108 bp, Homo sapiens
  misc_feature: GYAE6OF01BJ4KQ.48.73.G07.1.454.CMB.1.raw
  modified_base (108)..(108): a, c, t, g, unknown or other
  misc_feature (108)..(108): n is a, c, g, or t
tcagagtatacatacacgaccggtgctcgatttagctctacgctcagggcacgaccggtgctcgatttagatagctctcgttgggagcgggctggcaaggcgcatagn

SEQ ID NO: 232910 - DNA, 148 bp, Homo sapiens
  misc_feature: GYAE6OF01DMXFQ.48.73.G07.1.454.CMB.1.raw
  modified_base (130)..(130): a, c, t, g, unknown or other
  misc_feature (130)..(130): n is a, c, g, or t
  modified_base (132)..(148): a, c, t, g, unknown or other
  misc_feature (132)..(148): n is a, c, g, or t
tcagagtatacatacacgaccggtgctcgatttagctctacgctcagggcacgaccggtgcttcgatttagagctacacgtattgggtttggggtttttaggatctgagcgggctggcaaggcgcatagngnnnnnnnnnnnnnnnnn

SEQ ID NO: 232911 - DNA, 313 bp, Homo sapiens
  misc_feature: GYAE6OF01CTOPU.48.73.G07.1.454.CMB.1.raw
  modified_base (280)..(280): a, c, t, g, unknown or other
  misc_feature (280)..(280): n is a, c, g, or t
  modified_base (286)..(313): a, c, t, g, unknown or other
  misc_feature (286)..(313): n is a, c, g, or t
tcagagtatacatacacgaccggtgctcgatttagctctacgctcagggcgacgaccggtgctcgatttagatcgtctggtgttgggtttgggggtgtggtggtctcaactcccgccttgacgaggctgattactactgtcagtcttttgataacaacaatcacgtggtcttcggcggagggaccagccctgaccgtcctaggtcagcccaaggcctgccccctggtcactctgttcccacccgtcctctatgtatactctgagcgggctgggcaaggcncatagnnnnnnnnnnnnnnnnnnnnnnnnnnnn

SEQ ID NO: 232912 - DNA, 279 bp, Homo sapiens
  misc_feature: GYAE6OF01EA3NC.48.73.G07.1.454.CMB.1.raw
tcagagtatacatacacgaccggtgctcgatttagctctacgctcagggcacgaccggtgctcgatttagatcgtctgtgttgggtttggggtgtggtggtctccactcccgccttgacgaggctgattactactgtcagtcttttgataacaacaatcacgtggtcttcggcggagggaccagcctgaccgtcctaggtcagcccaaggctgccccctcggtcactctgttcccaccctcctctatgtatactctgagcgggctggcaaggcgcatag

SEQ ID NO: 232913 - DNA, 198 bp, Homo sapiens
  misc_feature: GYAE6OF01C9LJN.48.73.G07.1.454.CMB.1.raw
  modified_base (194)..(198): a, c, t, g, unknown or other
  misc_feature (194)..(198): n is a, c, g, or t
tcagagtatacatacacgaccggtgctcgatttagctctacgctcagggcacgaccggtgctcgatttagctctacgctcagggcacgaccggtgctcgatttagtcacgcgagaaagggaaggggctggccctgacgtgttctgttcccgcctcctctatgtatactctgagcgggctggcaaggcgcatagnnnnn

SEQ ID NO: 232914 - DNA, 129 bp, Homo sapiens
  misc_feature: GYAE6OF01CY8LD.48.73.G07.1.454.CMB.1.raw
  modified_base (129)..(129): a, c, t, g, unknown or other
  misc_feature (129)..(129): n is a, c, g, or t
tcagagtatacatacacgaccggtgctcgatttagctctacgctcagggcacgaccggtgctcgatttagagctcacgtattgggtttggggtttttaggtatctgagcgggctggcaaggcgcatagn

SEQ ID NO: 232915 - DNA, 190 bp, Homo sapiens
  misc_feature: GYAE6OF01CN61V.48.73.G07.1.454.CMB.1.raw
  modified_base (189)..(190): a, c, t, g, unknown or other
  misc_feature (189)..(190): n is a, c, g, or t
tcagagtatacatacacgaccggtgctcgatttagctctacgctcagtgcacgaccggtgctcgatttagcacacgatagttgggtttgggaccaaggtggaagtcaaacgaactgtggctgcaccatctgtcttcatcttcccgccatctgatatgtatactctgagcgggctggcaaggcgcatagnn

SEQ ID NO: 232916 - DNA, 211 bp, Homo sapiens
  misc_feature: GYAE6OF01A1AP6.48.73.G07.1.454.CMB.1.raw
  modified_base (193)..(194): a, c, t, g, unknown or other
  misc_feature (193)..(194): n is a, c, g, or t
  modified_base (196)..(211): a, c, t, g, unknown or other
  misc_feature (196)..(211): n is a, c, g, or t
tcagagtatacatacacgaccggtgctcgatttagctctacgctcagggcacgaccggtgctcgatttagctctacgctcagggcacgaccggtgctcgatttagtcacgcgagaaaggaagggctggccctgacgtgtttctgttcccacctcctctatgtatactctgagcgggctggcaaggcgcatagnngnnnnnnnnnnnnnnnn

SEQ ID NO: 232917 - DNA, 163 bp, Homo sapiens
  misc_feature: GYAE6OF01BGWOE.48.73.G07.1.454.CMB.1.raw
  modified_base (162)..(163): a, c, t, g, unknown or other
  misc_feature (162)..(163): n is a, c, g, or t
tcagagtatacatacacgaccggtgctcgatttagctctacgctcagggcacgaccggtgctcgatttagtcacgcgagaaagggaaaggggctggccctgacgtgtttctgttcccgccctcctctatgtatactctgagcgggctggcaaggcgcatagnn

SEQ ID NO: 232918 - DNA, 189 bp, Homo sapiens
  misc_feature: GYAE6OF01AT9LD.48.73.G07.1.454.CMB.1.raw
  modified_base (189)..(189): a, c, t, g, unknown or other
  misc_feature (189)..(189): n is a, c, g, or t
tcagagtatacatacacgaccggtgctcgatttagctctacgctcagggcacgaccggtgctcgatttagcacacgatagttgggtttgggaccaaggtggaagtcaaacgaactgtggctgcaccatctgtcttcatcttcccgccatctgatatgtatactctgagcgggctggcaaggcgcatagn

SEQ ID NO: 232919 - DNA, 127 bp, Homo sapiens
  misc_feature: GYAE6OF01EVEE7.48.73.G07.1.454.CMB.1.raw
tcagagtatacatacacgaccggtgctcgatttagctctacgctcagggcacgaccggtgctcgatttagagctcacgtattgggtttggggttttaggtatctgagcgggctggcaaggcgcatag

SEQ ID NO: 232920 - DNA, 257 bp, Homo sapiens
  misc_feature: GYAE6OF01BX8YB.48.73.G07.1.454.CMB.1.raw
  modified_base (255)..(257): a, c, t, g, unknown or other
  misc_feature (255)..(257): n is a, c, g, or t
tcagagtatacatacacgaccggtgctcgatttagctctacgctcagggcacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcgcatagnnn

SEQ ID NO: 232921 - DNA, 164 bp, Homo sapiens
  misc_feature: GYAE6OF01CA0OD.48.73.G07.1.454.CMB.1.raw
  modified_base (163)..(164): a, c, t, g, unknown or other
  misc_feature (163)..(164): n is a, c, g, or t
tcagagtatacatacacgaccggtgctcgatttagctctacgctcagggcacgatcggtgctcgatttagctctacgctcagggcacgaccggtgctcgatttagagctcacgtattgggttggggtttttaggtatctgagcgggctggcaaggcgcatagnn

SEQ ID NO: 232922 - DNA, 190 bp, Homo sapiens
  misc_feature: GYAE6OF01A5OZU.48.73.G07.1.454.CMB.1.raw
  modified_base (189)..(190): a, c, t, g, unknown or other
  misc_feature (189)..(190): n is a, c, g, or t
tcagagtatacatacacgaccggtgctcgatttagctctacgctcagggcacgaccggtgctcgatttagcacacgatagttgggtttgggaccaaggtggaagtcaaacgaactgtggctgcaccatctgtcttcatcttcccgccatctgatatgtatactctgagcgggctggcaaggcgcatagnn

SEQ ID NO: 232923 - DNA, 276 bp, Homo sapiens
  misc_feature: GYAE6OF01CC0CY.48.73.G07.1.454.CMB.1.raw
  modified_base (275)..(276): a, c, t, g, unknown or other
  misc_feature (275)..(276): n is a, c, g, or t
tcagagtatacatacacgaccggtgctcgatttagctctacgctcagggcacgaccggtgctcgatttagatcgtctgtgttgggtttgggtgtggtggtctccactcccgccttgacgaggctgattactactgtcagtcttttgataacaacaatcacgtggtcttcggcggaggaccagcctgaccgtcctaggtcagcccaaggctgcccctggtcactctgttcccacctcctctatgtatactctgagcgggctggcaaggcgcatagnn

SEQ ID NO: 232924 - DNA, 198 bp, Homo sapiens
  misc_feature: GYAE6OF01DGE4I.48.73.G07.1.454.CMB.1.raw
  modified_base (195)..(198): a, c, t, g, unknown or other
  misc_feature (195)..(198): n is a, c, g, or t
tcagagtatacatacacgaccggtgctcgatttagctctacgctcagggcacgaccggtgctcgatttagctctacgctcagggcacgaccggtgctcgatttagtcacgcgagaaagggaaggggctggccctgacgtgtttctgttcccacctcctctatgtatactctgagcgggctggcaaggcgcatagnnnn

SEQ ID NO: 232925 - DNA, 164 bp, Homo sapiens
  misc_feature: GYAE6OF01DOZWA.48.73.G07.1.454.CMB.1.raw
  modified_base (164)..(164): a, c, t, g, unknown or other
  misc_feature (164)..(164): n is a, c, g, or t
tcagagtatacatacacgaccggtgctcgatttagctctacgctcagggcacgaccggtgctcgatttagcgagacgcgcagggcacgaccggtgctcgatttagagctcacgtattgggtttggggtttttaggtatctgagcgggctggcaaggcgcatagn

SEQ ID NO: 232926 - DNA, 201 bp, Homo sapiens
  misc_feature: GYAE6OF01EHCTH.48.73.G07.1.454.CMB.1.raw
  modified_base (191)..(201): a, c, t, g, unknown or other
  misc_feature (191)..(201): n is a, c, g, or t
tcagagtatacatacacgaccggtgctcgatttagctctacgctcagggcacgaccggtgctcgatttagctctacgctcagggcacgaccggtgctcgatttagtcacgcgagaaaggaaggggctggcctgacgtgttctgttccacctcctctatgtatactctgagcgggctggcaaggcgcatagnnnnnnnnnnn

SEQ ID NO: 232927 - DNA, 259 bp, Homo sapiens
  misc_feature: GYAE6OF01B9ELP.48.73.G07.1.454.CMB.1.raw
  modified_base (254)..(259): a, c, t, g, unknown or other
  misc_feature (254)..(259): n is a, c, g, or t
tcagagtatacatacacgaccggtgctcgatttagctctacgctcagggcacgaccggtgctcgatttagtagcatactgttgggtttgggccaagggacaacggtcaccgtctcttcagcctccaccaagggcccatcggtcttcccctggcgccctgctccaggagcacctccgagagcacagcggccctgggctgcctggtcaaggactacttcctctctcgactctgagcgggctggcaaggcgcatagnnnnnn

SEQ ID NO: 232928 - DNA, 282 bp, Homo sapiens
  misc_feature: GYAE6OF01AGQ15.48.73.G07.1.454.CMB.1.raw
  modified_base (281)..(282): a, c, t, g, unknown or other
  misc_feature (281)..(282): n is a, c, g, or t
tcagagtatacatacacgaccggtgctcgatttagctctacgctcagggcacgaccggtgctcgatttagatcgtctgtgttgggtttgggggtgtggtggtctccactcccgccttgacgaggctgattactactgtcagtcttttgataacaacaatcacgtggtcttcggcggagggaccagcctgaccgtcctaggtcagcccaaggctgccccctcggtcactctgttcccaccctcctctatgtatactctgagcgggctggcaaggcgcatagnn

SEQ ID NO: 232929 - DNA, 150 bp, Homo sapiens
  misc_feature: GYAE6OF01EA3OV.48.73.G07.1.454.CMB.1.raw
  modified_base (129)..(150): a, c, t, g, unknown or other
  misc_feature (129)..(150): n is a, c, g, or t
tcagagtatacatacacgaccggtgctcgatttagctctacgctcagggcgacgaccggtgctcgatttagagtatacatattgggtttgggggtttttagatctgagcgggctggcaaggcgcatagnnnnnnnnnnnnnnnnnnnnnn

SEQ ID NO: 232930 - DNA, 129 bp, Homo sapiens
  misc_feature: GYAE6OF01ER5G7.48.73.G07.1.454.CMB.1.raw
  modified_base (129)..(129): a, c, t, g, unknown or other
  misc_feature (129)..(129): n is a, c, g, or t
tcagagtatacatacacgaccggtgctcgatttagctctacgctcagggcacgaccggtgctcgatttagagctcacgtattgggttgggggtttttaggtatctgagcgggctggcaaggcgcatagn

SEQ ID NO: 232931 - DNA, 304 bp, Homo sapiens
  misc_feature: GYAE6OF01CWE91.48.73.G07.1.454.CMB.1.raw
  modified_base (209)..(209): a, c, t, g, unknown or other
  misc_feature (209)..(209): n is a, c, g, or t
  modified_base (284)..(284): a, c, t, g, unknown or other
  misc_feature (284)..(284): n is a, c, g, or t
  modified_base (288)..(304): a, c, t, g, unknown or other
  misc_feature (288)..(304): n is a, c, g, or t
tcagagtatacatacacgaccggtgctcgatttagctctacgctcagggcacgaccggtgctcgatttagctctacgctcgagggcacgaccggtgctcgatttagtctctacgctacgagggcacgaccgtgctcgatttagtctctacgcgtaccgagggcacgaccggtgactcgatttagtctacgacgacggaacggaagggtnagtcgttgactggacgtaatttctcgatcgttcccgcatctgatatgtatactcgtgagcgggctggcaaggcanatgnnnnnnnnnnnnnnnnn

SEQ ID NO: 232932 - DNA, 197 bp, Homo sapiens
  misc_feature: GYAE6OF01E4LCC.48.73.G07.1.454.CMB.1.raw
  modified_base (195)..(197): a, c, t, g, unknown or other
  misc_feature (195)..(197): n is a, c, g, or t
tcagagtatacatacacgaccggtgctcgatttagctctacgctcagggcacgaccggtgctcgatttagctctacgctcagggcacgaccggtgctcgatttagtcacgcgagaaagggaaggggctggccctgacgtgtttctgttcccacctcctctatgtatactctgagcgggctggcaaggcgcatagnnn

SEQ ID NO: 232933 - DNA, 221 bp, Homo sapiens
  misc_feature: GYAE6OF01B933V.48.73.G07.1.454.CMB.1.raw
  modified_base (176)..(178): a, c, t, g, unknown or other
  misc_feature (176)..(178): n is a, c, g, or t
  modified_base (180)..(221): a, c, t, g, unknown or other
  misc_feature (180)..(221): n is a, c, g, or t
tcagagtatacatacacgaccggtgctcgatttagctctacgctcagggtcgacgaccggtgcctcgatttagtcacgcgagaaagggaagggtgatcttggcctgacgaaatttcttcagtcttcccgccatctgatatgtactactctgagcgggctaggcaaggcgcactagnnncnnnnnnnnnnnnnnnnnnnnnnnnnnnnnnnnnnnnnnnnnn

SEQ ID NO: 232934 - DNA, 174 bp, Homo sapiens
  misc_feature: GYAE6OF01CJ3T2.48.73.G07.1.454.CMB.1.raw
  modified_base (160)..(174): a, c, t, g, unknown or other
  misc_feature (160)..(174): n is a, c, g, or t
tcagagtatacatacacgaccggtgctcgatttagctctacgctcagggcacgaccggtgctcgatttagtcacgcgagaaagggaaggggctggccctgacgtgtttctgttcccgcctcctctatgtatactctgagcgggctggcaaggcgcatagnnnnnnnnnnnnnnn

SEQ ID NO: 232935 - DNA, 138 bp, Homo sapiens
  misc_feature: GYAE6OF01CY2GL.48.73.G07.1.454.CMB.1.raw
  modified_base (128)..(138): a, c, t, g, unknown or other
  misc_feature (128)..(138): n is a, c, g, or t
tcagagtatacatacacgaccggtgctcgatttagctctacgctcagggcgacgaccggtgctcgatttagagtatacatattgggtttggggtttttagatctgagcgggctggcaaggcgcatagnnnnnnnnnnn

SEQ ID NO: 232936 - DNA, 165 bp, Homo sapiens
  misc_feature: GYAE6OF01EEPJ8.48.73.G07.1.454.CMB.1.raw
  modified_base (164)..(165): a, c, t, g, unknown or other
  misc_feature (164)..(165): n is a, c, g, or t
tcagagtatacatacacgaccggtgctcgatttagctctacgctcagggcacgaccggtgctcgatttagcgagacgcgcagggcacgaccggtgctcgatttagagctcacgtattgggtttggggtttttaggtatctgagcgggctggcaaggcgcatagnn

SEQ ID NO: 232937 - DNA, 163 bp, Homo sapiens
  misc_feature: GYAE6OF01BUTFW.48.73.G07.1.454.CMB.1.raw
  modified_base (126)..(126): a, c, t, g, unknown or other
  misc_feature (126)..(126): n is a, c, g, or t
  modified_base (132)..(163): a, c, t, g, unknown or other
  misc_feature (132)..(163): n is a, c, g, or t
tcagagtatacatacacgaccggtgctcgatttagctctacgctcagggtcgacgaccggtgcctcgatttagagctcacgtattgggtttggggtttttagatcgtgagcgggctggcaagggcncatagnnnnnnnnnnnnnnnnnnnnnnnnnnnnnnnn

SEQ ID NO: 232938 - DNA, 261 bp, Homo sapiens
  misc_feature: GYAE6OF01CVEZF.48.73.G07.1.454.CMB.1.raw
  modified_base (255)..(261): a, c, t, g, unknown or other
  misc_feature (255)..(261): n is a, c, g, or t
tcagagtatacatacacgaccggtgctcgatttagctctacgctcagggcacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcgcatagnnnnnnn

SEQ ID NO: 232939 - DNA, 521 bp, Homo sapiens
  misc_feature: GYAE6OF01BUWW4.48.73.G07.1.454.CMB.1.raw
  modified_base (514)..(514): a, c, t, g, unknown or other
  misc_feature (514)..(514): n is a, c, g, or t
tcagagtatacatacacgaccggtgctcgatttagctctacgctcagggcacgaccggtgctcgatttagtcacgcgagaaagggaaagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtcccctcacctgcactgtctctggtggctccatcagcagcagtacttacttctggggctggatccgccagcccccagggaaggggctggagtggagttgggagtatttacgacagtgggagcacctactacaacccgtccctacaaagtcgaggcacatactccgtagacacgtccaagaaccaattctccctagaagctgagctctgtcgaccgccgacagacacggctgtctattactgtcgcgacggccccgagcgctaggtggtctttttgntgttccg

SEQ ID NO: 232940 - DNA, 135 bp, Homo sapiens
  misc_feature: GYAE6OF01DUBFV.48.73.G07.1.454.CMB.1.raw
  modified_base (131)..(135): a, c, t, g, unknown or other
  misc_feature (131)..(135): n is a, c, g, or t
tcagagtatacatacacgaccggtgctcgatttagctctacgctcagggcgacgaccggtgctcgatttagagtatacatattgggtttgggggtttttaggtatctgagcgggctggcaaggcgcatagnnnnn

SEQ ID NO: 232941 - DNA, 130 bp, Homo sapiens
  misc_feature: GYAE6OF01EWYLT.48.73.G07.1.454.CMB.1.raw
  modified_base (130)..(130): a, c, t, g, unknown or other
  misc_feature (130)..(130): n is a, c, g, or t
tcagagtatacatacacgaccggtgctcgatttagctctacgctcagggcacgaccggtgctcgatttagagctcacgtattgggtttgggggtttttaggtatctgagcgggctggcaaggcgcatagn

SEQ ID NO: 232942 - DNA, 302 bp, Homo sapiens
  misc_feature: GYAE6OF01ANEW6.48.73.G07.1.454.CMB.1.raw
  modified_base (264)..(264): a, c, t, g, unknown or other
  misc_feature (264)..(264): n is a, c, g, or t
  modified_base (283)..(283): a, c, t, g, unknown or other
  misc_feature (283)..(283): n is a, c, g, or t
  modified_base (287)..(302): a, c, t, g, unknown or other
  misc_feature (287)..(302): n is a, c, g, or t
tcagagtatacatacacgaccggtgctcgatttagctctacgctcagggtcacgaccggtgctcgatttagctctacgctcagggcacgaccggtgctcgatttacgctctacgctcagggtcacgaccggtgctcgatttacgctctacgctcagggtcacgacggtgctcgatttacgcagtactgcgttaggttggaccaggtgagtcaacgtactgtgctgcacatctgtctcatccgtccgcatcgtgatatgtatctntgagcggctggcaaggcanatgnnnnnnnnnnnnnnnn

SEQ ID NO: 232943 - DNA, 507 bp, Homo sapiens
  misc_feature: GYAE6OF01EZL9Z.48.73.G07.1.454.CMB.1.raw
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttctggggctggatccgccagcccccagggaaggggctggagtggattgggagtatttaccacagtgggagcacctactacaacccgtcctcaaaagtcgaggcaccatatccgtagacacgtccaagaaccaattctccctgaacgctgagctctgtgaccgccgcagacacggctgtctattactgtgcgaggcccgagcgcagtgcttttgatgtcgtttgattatggtgggccgaagggacaatggtcctccgtcttccg

SEQ ID NO: 232944 - DNA, 512 bp, Homo sapiens
  misc_feature: GYAE6OF01BT103.48.73.G07.1.454.CMB.1.raw
  modified_base (405)..(405): a, c, t, g, unknown or other
  misc_feature (405)..(405): n is a, c, g, or t
  modified_base (438)..(438): a, c, t, g, unknown or other
  misc_feature (438)..(438): n is a, c, g, or t
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttctggggctggatccgccagcccccgagggaagggctggagtggagtgggagtatttaccacgagtgggagcacctactacaacccgtcctacaaaagtcgaggcaccatatccgtagacacgtccaaagaaccaattctaccctgaacgctgagctacgngtcgaccgccgcagaccacggctgtctattacngtgcgacgcccgagcgcagtggtcttttgatgtccttgatgtgcgggacaagggacaagtggtcaccgtctacg

SEQ ID NO: 232945 - DNA, 257 bp, Homo sapiens; identical to SEQ ID NO: 232920
  misc_feature: GYAE6OF01CE5IB.48.73.G07.1.454.CMB.1.raw
  modified_base (255)..(257): a, c, t, g, unknown or other
  misc_feature (255)..(257): n is a, c, g, or t

SEQ ID NO: 232946 - DNA, 512 bp, Homo sapiens
  misc_feature: GYAE6OF01BT66X.48.73.G07.1.454.CMB.1.raw
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttctggggctggatccgccagcccccagggaaggggctggagtggattgggagtatttaccacagtgggagcacctactacaacccgtccctacaaacgtcgaggcaccatatccgtagacacgtccaagaaccaattctcctgaacgctgagctctgtgaccgccgcagacacggctgtctattactgtgcgacgcccgagcgcagtggtcttttgattgtcctttgatagtggtgggaccaagggtacaagtggtcaccggtcttcg

SEQ ID NO: 232947 - DNA, 472 bp, Homo sapiens
  misc_feature: GYAE6OF01BU3A7.48.73.G07.1.454.CMB.1.raw
  modified_base (440)..(440): a, c, t, g, unknown or other
  misc_feature (440)..(440): n is a, c, g, or t
  modified_base (457)..(472): a, c, t, g, unknown or other
  misc_feature (457)..(472): n is a, c, g, or t
tcagagtatacatacacgaccggtgctcgatttagctctacgctcagggcacgaccggtgctcgatttagtacacacacttagggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtgggccaagggacaatggtcaccgtctccttcagcctccaccaaggcccatccggtcttcccctggccacccctcctccaagacgccacctcgtgggggcacgacgccggcccgtgggcctcggccgtgggtaccaagggactacttcctatgtatactctgagcgggntggcaaggcgacatagnnnnnnnnnnnnnnnn

SEQ ID NO: 232948 - DNA, 522 bp, Homo sapiens
  misc_feature: GYAE6OF01BYX7M.48.73.G07.1.454.CMB.1.raw
  modified_base (511)..(511): a, c, t, g, unknown or other
  misc_feature (511)..(511): n is a, c, g, or t
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttactcgtggggctggactccgccacgccccgaggggagggctggagtggattggagtattaccacagtggagcacctactacacccgtcctacaaagtcgagcacatactcgtagacacgtacaagaaccattctccctagaacgctagacgtctcgtgtcgaccgccgcacgacacgctgtctattactgtcgcgacggccccgagccgcgagtggtcttttgactgtccgtttgattagtggtcggggaccaagggactaagtcggtcnccgttcttccg

SEQ ID NO: 232949 - DNA, 536 bp, Homo sapiens
  misc_feature: GYAE6OF01D124N.48.73.G07.1.454.CMB.1.raw
  modified_base (445)..(445): a, c, t, g, unknown or other
  misc_feature (445)..(445): n is a, c, g, or t
tcagagtatacatacacgaccggtgctcgatttagctctacgctcagggggctttctgagagtcatggatctcatgtgcaaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttctggggctggatccgccacgcccccgagggagggctggagtggattgggagtatttaccacagtgggagcacctactacaacccgtcctacaaaagtcgaggcaccatactccgtagacacgtaccaaagaacccaattcctaccctagaacgctgacgcctctcgtcgacccgccgcacgacacggctgtctattacngtcgcgacggcccgagcgcagtggtcttttgattcgtccgtttgattagtggtcggggaccaagggtactaagtggtaccaccgtcttccg

SEQ ID NO: 232950 - DNA, 210 bp, Homo sapiens
  misc_feature: GYAE6OF01AGHH3.48.73.G07.1.454.CMB.1.raw
  modified_base (201)..(210): a, c, t, g, unknown or other
  misc_feature (201)..(210): n is a, c, g, or t
tcagagtatacatacacgaccggtgctcgatttagctctacgctcagggcacgaccggtgctcgatttagctctacgctcagggcacgaccggtgctcgatttagctctacgctcagggtcgtacgaccggtgctcgatttagagctcgacgtattgggtttggggtttttagatctgagcgggctggcaaggcgcatagnnnnnnnnnn

SEQ ID NO: 232951 - DNA, 166 bp, Homo sapiens
  misc_feature: GYAE6OF01C98QD.48.73.G07.1.454.CMB.1.raw
  modified_base (165)..(166): a, c, t, g, unknown or other
  misc_feature (165)..(166): n is a, c, g, or t
tcagagtatacatacacgaccggtgctcgatttagctctacgctcagggcacgaccggtgctcgatttagctctacgctcagggctacgaccggtgctcgatttagagctcacgtattgggtttggggtttttaggtatctgagcgggctggcaaggcgcatagnn

SEQ ID NO: 232952 - DNA, 131 bp, Homo sapiens
  misc_feature: GYAE6OF01AXHDR.48.73.G07.1.454.CMB.1.raw
  modified_base (128)..(131): a, c, t, g, unknown or other
  misc_feature (128)..(131): n is a, c, g, or t
tcagagtatacatacacgaccggtgctcgatttagctctacgctcagggcacgaccggtgctcgatttagagtatacatattgggtttggggtttttagtatctgagcgggctggcaaggcgcatagnnnn

SEQ ID NO: 232953 - DNA, 518 bp, Homo sapiens
  misc_feature: GYAE6OF01BLXQM.48.73.G07.1.454.CMB.1.raw
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccaggggaagggctgggagtggagttgggagtatttaccacagtgggagcacctactacaacccgtcctacaaagtcgaggcaccatactccgtagacacgtccaaagaaccaattctaccctgaacgctgacgtctctgtcgaccgccgcacgacacggctgtctattactgtcgcgacggcccgagcgcagtggcttttgatgtcctttgatagtggtcgggacaagggacagtggtcaccgtctccg

SEQ ID NO: 232954 - DNA, 573 bp, Homo sapiens
  misc_feature: GYAE6OF01AVT65.48.73.G07.1.454.CMB.1.raw
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggacgaccctgtccctcacctgcactgtctctggtgctccatcagcagcagtacttacttcgtggggctggactccgccacgcccccgaggggaacggggcgtgggaggtggtagttggggagttacgtttaccgacgtaggtgggacgcacctactaccaacccgtcctacaaacgtcgacggcaccatactccgtagaccacgtaccaaacgaacctaacttcctaccctagaacgcgtagacgctcgtcgtcgacccgccgacagaccgacggctgtctagttacgtgtcgcgacggccccgagccgcgaggttcgtcttttgagtcgtacgtttgagttgtggtacgggaccgaagggtacaaggttcgtccgccgttctccg

SEQ ID NO: 232955 - DNA, 131 bp, Homo sapiens
  misc_feature: GYAE6OF01BNJOG.48.73.G07.1.454.CMB.1.raw
  modified_base (130)..(131): a, c, t, g, unknown or other
  misc_feature (130)..(131): n is a, c, g, or t
tcagagtatacatacacgaccggtgctcgatttagctctacgctcagggcacgaccggtgctcgatttagagctcacgtattgggtttgggggtttttaggtatctgagcgggctggcaaggcgcatagnn

SEQ ID NO: 232956 - DNA, 306 bp, Homo sapiens
  misc_feature: GYAE6OF01CO9YG.48.73.G07.1.454.CMB.1.raw
  modified_base (300)..(306): a, c, t, g, unknown or other
  misc_feature (300)..(306): n is a, c, g, or t
tcagagtatacatacacgaccggtgctcgatttagctctacgctcagggcacgaccggtgctcgatttagctctacgctcagggtcacgaccggtgctcgatttagctctacgctcagggtcacgaccggtgctcgatttacgctctacgctcagggtcacgaccggtgctcgagtttacgcgagtactgcgttagggttggacctaaggtgagtcaacgtactgtggactgcacctatctgtcttcagtccgttccgcatctgatatgtatactctgagcgggctggcaaggcgcatgnnnnnnn

SEQ ID NO: 232957 - DNA, 542 bp, Homo sapiens
  misc_feature: GYAE6OF01EBD9T.48.73.G07.1.454.CMB.1.raw
  modified_base (359)..(359): a, c, t, g, unknown or other
  misc_feature (359)..(359): n is a, c, g, or t
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttctggggctggatccgccagcccccgagggaaggggctggagtggagttggtagtatttaccacaggtgggagcacctactaccaacccgtcctacaaaagtcgaggcaccatanccgtagaccacgtccaaagaaccaattcctcctgaagctgacgctcgtgtcgacccgccgcacgacacggctgtctattactttgcgacggccccgagccgcagtcggtcttttggattcgtcctttgattagtggtggggacctaaggggacctagtcggtacctaccggttctcgttaccg

SEQ ID NO: 232958 - DNA, 266 bp, Homo sapiens
  misc_feature: GYAE6OF01D158K.48.73.G07.1.454.CMB.1.raw
  modified_base (255)..(266): a, c, t, g, unknown or other
  misc_feature (255)..(266): n is a, c, g, or t
tcagagtatacatacacgaccggtgctcgatttagctctacgctcagggcacgaccggtgctcgatttagtagcatactgttgggtttgggccaagggacaacggtcaccgtctcttcagcctccaccaagggcccatcggtcttccccctggcgccctgctccaggagcacctccgagagcacagcggccctgggcctgcctggtcaaggctacttcctatgtatactctgagcgggctggcaaggcgcatagnnnnnnnnnnnn

SEQ ID NO: 232959 - DNA, 328 bp, Homo sapiens
  misc_feature: GYAE6OF01B8FUL.48.73.G07.1.454.CMB.1.raw
  modified_base (323)..(328): a, c, t, g, unknown or other
  misc_feature (323)..(328): n is a, c, g, or t
tcagagtatacatacacgaccggtgctcgatttagctctacgctcagggcacgaccggtgctcgatttagtgtgagtagttccgcgggcacgaccggtgctcgatttagagagagtgtgttgggttgggggtgtggtggtctccactcccgccttgacgaggctgattactactgtcagtcttttgataacaacaatcacgtggtcttcggcggagggaccagcctgaccgtcctaggtcagcccaaggctcgccccctcggtcactctcgttccccgccctcctctatgtactactctgagcgggctggcaaggcgcatagnnnnnn

SEQ ID NO: 232960 - DNA, 261 bp, Homo sapiens
  misc_feature: GYAE6OF01D1C15.48.73.G07.1.454.CMB.1.raw
  modified_base (255)..(261): a, c, t, g, unknown or other
  misc_feature (255)..(261): n is a, c, g, or t
tcagagtatacatacacgaccggtgctcgatttagctctacgctcagggcacgaccggtgctcgatttagtagcatactgttgggtttggggccaagggacaacggtcaccgtctcttcagcctccaccaagggccaatcggtcttcccctggcgccctgctccaggagcacctccgagagcacagcggccctgggctgcctggtcaaggactacttcctctctcgactctgagcgggctggcaaggcgcatagnnnnnnn

SEQ ID NO: 232961 - DNA, 538 bp, Homo sapiens
  misc_feature: GYAE6OF01EM5CF.48.73.G07.1.454.CMB.1.raw
  modified_base (361)..(361): a, c, t, g, unknown or other
  misc_feature (361)..(361): n is a, c, g, or t
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctgggctggatccgccagcccccagggaagggctggagtggattggggagtatttaccacagtgggagcacctactacaacccgtcctacaaaagtcgaggcaccatatccgtanacacgtccaaagaaccaattcctccctgaacgctgacgctctgtcgacccgccgcagacacggctgtctattacgtgtgcgacggccccgagcgcaggtggtctttttgattcgtccgttttgattagtggtacggggccgaaaggggtacaaagttgggtcctaccggtcttcccg

SEQ ID NO: 232962 - DNA, 190 bp, Homo sapiens; identical to SEQ ID NO: 232922
  misc_feature: GYAE6OF01AFH4Q.48.73.G07.1.454.CMB.1.raw
  modified_base (189)..(190): a, c, t, g, unknown or other
  misc_feature (189)..(190): n is a, c, g, or t

SEQ ID NO: 232963 - DNA, 190 bp, Homo sapiens; identical to SEQ ID NO: 232922
  misc_feature: GYAE6OF01C9IW5.48.73.G07.1.454.CMB.1.raw
  modified_base (189)..(190): a, c, t, g, unknown or other
  misc_feature (189)..(190): n is a, c, g, or t

SEQ ID NO: 232964 - DNA, 657 bp, Homo sapiens
  misc_feature: GYAE6OF01DTLMB.48.73.G07.1.454.CMB.1.raw
  modified_base (157)..(157): a, c, t, g, unknown or other
  misc_feature (157)..(157): n is a, c, g, or t
tcagagtatacatacacgaccggtgctcgatttagctctacgctcagggggctttctgagagtcatggatctcatgtgcaagaaaatgaagcacctgtggttcttcctcctgctggtggcgctcccagatggtcctgtcccagctgcagctgcaggngtcggccaggactggtagaacgtccgttcggacaccctgtccctcacctgcacttgtctcgtggtcgctccatcgagcagcagtacttacttcgtgggctggactccgccgacgcccccgagggaacgggtctgggacgtggtagttgggagttacgtttaccgacgtaggttagggacgacctaaccctaacgtaacccgtaacccgtaccctaacgaaaaacggttccgaacgggaccctaacctaacgtaacgttccggtaacgaaccgtaaccggttaccaaacgtaaacctaacgttccctacccgtagaacgtctagacgtactcgtcgtcgacccgtccgacacgaaccgacgtcttcgttacttacttacgtcggtacgaccggacccgggcccgagtccgagtacggttgttccgttttgcgttcgtaccgtttgattaggtcggtacgggaccgaagggtactagttcggtccgtaccgttcgttacccg

SEQ ID NO: 232965 - DNA, 319 bp, Homo sapiens
  misc_feature: GYAE6OF01DPMB9.48.73.G07.1.454.CMB.1.raw
  modified_base (314)..(319): a, c, t, g, unknown or other
  misc_feature (314)..(319): n is a, c, g, or t
tcagagtatacatacacgaccggtgctcgatttagctctacgctcagggcacgaccggtgctcgatttagcgagacgcgcagggcacgaccggtgctcgatttagatcgtctgtgttgggttgggggtgtggtggtctccactcccgccttgacgaggctgattactactgtcagtcttttgataacaacaatcacgtggtcttcggcggagggaccagcctgaccgtcctaggtcagcccaaggctgccccctcggtcactctgttcccacctcctctatgtatactctgagcgggctggcaaggcgcatagnnnnnn

SEQ ID NO: 232966 - DNA, 191 bp, Homo sapiens
  misc_feature: GYAE6OF01DRRWC.48.73.G07.1.454.CMB.1.raw
  modified_base (189)..(191): a, c, t, g, unknown or other
  misc_feature (189)..(191): n is a, c, g, or t
tcagagtatacatacacgaccggtgctcgatttagctctacgctcagggcacgaccggtgctcgatttagcacacgatagttgggtttgggaccaaggtggaagtcaaacgaactgtggctgcaccatctgtcttcatcttcccgccatctgatatgtatactctgagcgggctggcaaggcgcatagnnn

SEQ ID NO: 232967 - DNA, 166 bp, Homo sapiens
  misc_feature: GYAE6OF01BGVAN.48.73.G07.1.454.CMB.1.raw
  modified_base (160)..(166): a, c, t, g, unknown or other
  misc_feature (160)..(166): n is a, c, g, or t
tcagagtatacatacacgaccggtgctcgatttagctctacgctcagggcacgaccggtgctcgatttagtcacgcgagaaagggaaggggctggccctgacgtgtttctgttcccgcctcctctatgtatactctgagcgggctggcaaggcgcatagnnnnnnn

SEQ ID NO: 232968 - DNA, 243 bp, Homo sapiens
  misc_feature: GYAE6OF01BPP20.48.73.G07.1.454.CMB.1.raw
  modified_base (194)..(196): a, c, t, g, unknown or other
  misc_feature (194)..(196): n is a, c, g, or t
  modified_base (198)..(243): a, c, t, g, unknown or other
  misc_feature (198)..(243): n is a, c, g, or t
tcagagtatacatacacgaccggtgctcgatttagctctacgctcaggggcacggaccggtgctcgatttagcacacgatagttgggtttgggaccaaggtggaagtcaaacgaactgtggctgcaccatctgtcttcattcttcccgccatctgtatatgtatacttctgagcgggctggcaaggcgcatagnnngnnnnnnnnnnnnnnnnnnnnnnnnnnnnnnnnnnnnnnnnnnnnnn

SEQ ID NO: 232969 - DNA, 647 bp, Homo sapiens
  misc_feature: GYAE6OF01DR84D.48.73.G07.1.454.CMB.1.raw
  modified_base (324)..(324): a, c, t, g, unknown or other
  misc_feature (324)..(324): n is a, c, g, or t
tcagagtatacatacacgaccggtgctcgatttagctctacgctcagggggctttctgagagtcatggatctcatgtgcaaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagttacttacgttcgtgggctggactccgccacgccccgaggggacgggctgggagtggagttgggagttattaccacgaggtgggacncacctactaccaacccgtcctacaaagtcgacgcacatactcgagacacgtaccaaagaacctaattcctacctagaacgtactggaacgtcttcgtacgtaccgacccgtccgacgaacggaccgtaccgggtcttacgttacttaacgtttacgtcggttaccggaccgggacccgggccccggtaaggcccggtacgtagggtttcggtttaccgtttttggaacgtttcggttacccgttttaggacgtttacggttcggggtaccggggtaaccgaaagggtactaacgttcgggtaccctaccggttccttaacccg

SEQ ID NO: 232970 - DNA, 283 bp, Homo sapiens
  misc_feature: GYAE6OF01AXSVC.48.73.G07.1.454.CMB.1.raw
  modified_base (281)..(283): a, c, t, g, unknown or other
  misc_feature (281)..(283): n is a, c, g, or t
tcagagtatacatacacgaccggtgctcgatttagctctacgctcagggcacgaccggtgctcgatttagatcgtctgtgttgggtttgggggtgtggtggtctccactcccgccttgacgaggctgattactactgtcagtcttttgataacaacaatcacgtggtcttcggcggagggaccagcctgaccgtcctaggtcagcccaaggctgccccctcggtcactctgttcccaccctcctctatgtatactctgagcgggctggcaaggcgcatagnnn

SEQ ID NO: 232971 - DNA, 561 bp, Homo sapiens
  misc_feature: GYAE6OF01BX2R2.48.73.G07.1.454.CMB.1.raw
  modified_base (179)..(179): a, c, t, g, unknown or other
  misc_feature (179)..(179): n is a, c, g, or t
  modified_base (204)..(204): a, c, t, g, unknown or other
  misc_feature (204)..(204): n is a, c, g, or t
  modified_base (255)..(255): a, c, t, g, unknown or other
  misc_feature (255)..(255): n is a, c, g, or t
  modified_base (313)..(313): a, c, t, g, unknown or other
  misc_feature (313)..(313): n is a, c, g, or t
tcagagtatacatacacgaccggtgctcgatttagctctacgctcgagggggctttctgagagtcatggatctcatgtgcaagaaaatgaagcacctgtggttcttcctcctgctggtggcggctccagatgggtcctgtcccagctgcagctgcaggagtccgggcccaggactgggngaacgccttcggagccctgtccctnacctggcactgctcgtggtcggcttccatcagtcagcagtacttacgttgngggctggactccgccacgccccgagggacgggctggagtggagtggatacttacgacnggtggacgcacctacaccgaccgtcctacgaaacgtcgagcacgtatacgtcgtagacgtacgtaccgaaacgtaacctaacgttcctacccgtagaacgccgtagacgtacgtctcggtacccgaccgccgacacgtaccgacggtctcgtacttaacgttactgtcgacggacggcccgaggtcgcgagtcgtgtttgactgtccgttgatgtgggtcggacgaggtacagtggcctcgttcgtac

SEQ ID NO: 232972 - DNA, 224 bp, Homo sapiens
  misc_feature: GYAE6OF01CQ7FB.48.73.G07.1.454.CMB.1.raw
  modified_base (224)..(224): a, c, t, g, unknown or other
  misc_feature (224)..(224): n is a, c, g, or t
tcagagtatacatacacgaccggtgctcgatttagctctacgctcagggcacgaccggtgctcgatttagcgagacgcgcagggcacgaccggtgctcgatttagcactcgcacgttgggtttgggaccaaggtggaagtcaaacgaactgtggctgcaccatctgtcttcatcttcccgccatctgatatgtatactctgagcgggctggcaaggcgcatagn

SEQ ID NO: 232973 - DNA, 689 bp, Homo sapiens
  misc_feature: GYAE6OF01C9W0V.48.73.G07.1.454.CMB.1.raw
tcagagtatacatacacgaccggtgctcgatttagctctacgctcagggggctttctgagagtcatggatctcatgtgcaagaaaatgaagcacctgtggttcttcctcctgctggtggcgctcccagatggtcctgtccagctgcagctgcaggacgtcgggcccagggactgggtagaacgccgttcggacgtaccctgtccctcacctgctacgtgtctcgtggtcgcctcatcagcagctagttacttacgtcgtgggctcggactccgccaggccccggagggagggtcgtgggacgttggggtagttacgggtacgttacgtttaccgacgggtacgtcgggaactaccgtaccctaaccgtaccctaaccccggtacccgtaacgaaaacggttcgaacggacctaacctaacgtacgtaccgaacgtaacccgaacgtaaccaaacgtaaccctaacttaccgtacccgtagtaacgtcgttacggtacgtcgtacgtcggtccggaccccgaccgacgtacgaccgtacgttaccgttcgttacttacgttacggtcggccggacggacccggaccgcggtcgtacgtacggttcgttgtttacgtcgtacgttcggtagttagttcggtacgggaccggtacgaacggtactacggttacgccttaccgtcgttacccg

SEQ ID NO: 232974 - DNA, 190 bp, Homo sapiens; identical to SEQ ID NO: 232922
  misc_feature: GYAE6OF01BCAEE.48.73.G07.1.454.CMB.1.raw
  modified_base (189)..(190): a, c, t, g, unknown or other
  misc_feature (189)..(190): n is a, c, g, or t

SEQ ID NO: 232975 - DNA, 519 bp, Homo sapiens
  misc_feature: GYAE6OF01BWW9J.48.73.G07.1.454.CMB.1.raw
  modified_base (513)..(513): a, c, t, g, unknown or other
  misc_feature (513)..(513): n is a, c, g, or t
tcagagtatacatacacgaccggtgctcgatttagctctacgctcagggcacgaccggtgctcgatttagtcacgcgagaaagggaaagggggctttctgagagtcatggatctcatgtgcaagaaaatgaagcacctgtggttcttcctcctgctggtggcggctcccagatgggtcctgtcccagctgcagctgcaggagtcgggcccaggactggtgaacgccttcggagaccctgtccctcacctgcactgtctctggtggctccatcagcagcagtacttacttcgtggggctggatccgccacgcccccgagggaagggctggagtggagttgggagtatttaccacgagtgggagcacctactaccaacccgtcctacaaagtcgagcaccatactcgtagacacgtaccaagaaccaattcctaccctagaacgctgagctctgtcgaccgtcgcagacacggctgtctatacgtgtgcgacggcccagcgcgagtgtcttttgnttgtcg

SEQ ID NO: 232976 - DNA, 258 bp, Homo sapiens
  misc_feature: GYAE6OF01DZU8L.48.73.G07.1.454.CMB.1.raw
  modified_base (256)..(258): a, c, t, g, unknown or other
  misc_feature (256)..(258): n is a, c, g, or t
tcagagtatacatacacgaccggtgctcgatttagctctacgctcagggcacgaccggtgctcgatttagtagcatactgttgggtttggggccaagggacaacggtcaccgtctcttcagcctccaccaagggcccatcggtcttccccctggcgccctgctccaggagcacctccgagagcacagcggccctgggctgcctggtcaaggactacttcctatgtatactctgagcgggctggcaaggcgcatagnnn

SEQ ID NO: 232977 - DNA, 681 bp, Homo sapiens
  misc_feature: GYAE6OF01CI171.48.73.G07.1.454.CMB.1.raw
tcagagtatacatacacgaccggtgctcgatttagctctacgctcagggggctttactgacgagtcatggactctcatgtgcaagaaaatgaagcacctgtggttcttcctcctgctggtggcggctccagatgggtcctgtcccagctgcagctgcaggagtccgggcccaggtactggtgaagccgttcggacgacccgtgtccctcacctgctactgtctcgtggtgcctcatcagcagcagtacttacttcgtgggctggactccgccacgcccccgagggagggcgtggagtggacgttgggagtagtttaccagtaggtgggaacgccgaacctacgtaaccgaacccgttccctaacgaaaaacggtcgaacggccaacctaataacgtaccgtaacgacctaacgtaccaaacgaaccctaacgttccaccctagaacgtctacgatctcgtacggtaccgaccgccgtacgaacgaccgtacggccttacggtacttaacttacgtgtacggccgaaccgggcccccgaggccgtacgtacgttcgggttacctttttgacgtttcggtacccgttttaggtaagttacggttcggggttacgggggtaaccccgtaaagggggtaacctaaacggttccgggttaccctaaccccggtttcgttacccggg

SEQ ID NO: 232978 - DNA, 589 bp, Homo sapiens
  misc_feature: GYAE6OF01AJGFN.48.73.G07.1.454.CMB.1.raw
  modified_base (579)..(579): a, c, t, g, unknown or other
  misc_feature (579)..(579): n is a, c, g, or t
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaacgccttcggacgaccctgtccctcacctgcactgtctctggtgctccatcagcagcagttactacttcgtgggctggactccgccaggcccccgaggggacgggctggaggtggagttgggagttacgtttaccgacgtaggtgggacgctacctacgtaccaacccgtcctaacgaaacgtcgaaggccaccgagtactaccgtacgaaccgacgtaccgaaacgtaacctaacttcctccgtagaacgtctagacgtctacgtggtacgacccggccgacacgaccgtacggtccttacgtcttacgttacgtcgtacgaccggacgtcccgaggtcgcgtacgtggtctttgactcgttcgttgattagtggtcggacgaaggactagtacggtcncgttctaccg

SEQ ID NO: 232979 - DNA, 576 bp, Homo sapiens
  misc_feature: GYAE6OF01DX3KP.48.73.G07.1.454.CMB.1.raw
  modified_base (192)..(192): a, c, t, g, unknown or other
  misc_feature (192)..(192): n is a, c, g, or t
  modified_base (322)..(322): a, c, t, g, unknown or other
  misc_feature (322)..(322): n is a, c, g, or t
tcagagtatacatacacgaccggtgctcgatttagctctacgctcagggggctttctagagagtcatggatctcatgtgcaaagaaaatgaagcacctgtggttcttcctcctgctggtggcggctcccagatgggtcctgtcccagctgcagctgcaggagtcgggcccaggactggtgaagccttcgganaccctgtccctcacctgcactgtctctggtgctccatcagcagcagtacttacttctggggctggactccgccacgccccgagggaagggctggaggtggagtttgggagtatttaccgacgagtgggancacctactaccaacccgtcctacaaacgtcgacggcaccatactccgtagacacgtaccaaagaaccctaattcctacccgtagaacgctgacgctcgtcgtacgaccgccgacacgaccgacgctgtctaacttacgtgtacgcgacggccccgagcgacgacggttcggtcttttagacgttcgtccgtttgattagtggtacggggaccgaacgggtactaacggttacggtacgtcccgttcgttacccg

SEQ ID NO: 232980 - DNA, 513 bp, Homo sapiens
  misc_feature: GYAE6OF01DDR5T.48.73.G07.1.454.CMB.1.raw
  modified_base (357)..(357): a, c, t, g, unknown or other
  misc_feature (357)..(357): n is a, c, g, or t
  modified_base (378)..(378): a, c, t, g, unknown or other
  misc_feature (378)..(378): n is a, c, g, or t
  modified_base (399)..(399): a, c, t, g, unknown or other
  misc_feature (399)..(399): n is a, c, g, or t
  modified_base (425)..(425): a, c, t, g, unknown or other
  misc_feature (425)..(425): n is a, c, g, or t
  modified_base (428)..(428): a, c, t, g, unknown or other
  misc_feature (428)..(428): n is a, c, g, or t
  modified_base (436)..(436): a, c, t, g, unknown or other
  misc_feature (436)..(436): n is a, c, g, or t
  modified_base (455)..(455): a, c, t, g, unknown or other
  misc_feature (455)..(455): n is a, c, g, or t
  modified_base (475)..(475): a, c, t, g, unknown or other
  misc_feature (475)..(475): n is a, c, g, or t
tcagagtatacatacacgaccggtgctcgatttagctctacgctcagggcacgaccggtgctcgatttagtcacgcgagaaagggaaagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctcgtggtgctccatcagcagcagtacttacttcgtgggctggactcccgccacgcccccgagggaagggcgtggagtgagtggagtattacacgagtggancacctactaccaaccgtccanaaagtcgagcacatatccganacacgtacaagaccaatctcctgaanctnagcttcgngtacgaccgccgacagacncgctcgtctatacgtgtcgngacggccccgagccgctaggtgtcttttgagtgttccg

SEQ ID NO: 232981 - DNA, 282 bp, Homo sapiens
  misc_feature: GYAE6OF01EI6HV.48.73.G07.1.454.CMB.1.raw
  modified_base (281)..(282): a, c, t, g, unknown or other
  misc_feature (281)..(282): n is a, c, g, or t
tcagagtatacatacacgaccggtgctcgatttagctctacgctcagggcacgaccggtgctcgatttagatcgtctgtgttgggtttgggggtgtggtggtctccactcccgccttgacgaggctgattactactgtcagtcttttgataacaacaatcacgtggtcttcggcggagggaccagcctgaccgtcctaggtcagcccaaggctgccccctcggtcactctgttcccgccctcctctatgtatactctgagcgggctggcaaggcgcatagnn

SEQ ID NO: 232982 - DNA, 306 bp, Homo sapiens
  misc_feature: GYAE6OF01DUG6O.48.73.G07.1.454.CMB.1.raw
  modified_base (156)..(156): a, c, t, g, unknown or other
  misc_feature (156)..(156): n is a, c, g, or t
  modified_base (265)..(265): a, c, t, g, unknown or other
  misc_feature (265)..(265): n is a, c, g, or t
  modified_base (269)..(269): a, c, t, g, unknown or other
  misc_feature (269)..(269): n is a, c, g, or t
  modified_base (278)..(278): a, c, t, g, unknown or other
  misc_feature (278)..(278): n is a, c, g, or t
  modified_base (282)..(282): a, c, t, g, unknown or other
  misc_feature (282)..(282): n is a, c, g, or t
  modified_base (284)..(284): a, c, t, g, unknown or other
  misc_feature (284)..(284): n is a, c, g, or t
  modified_base (288)..(306): a, c, t, g, unknown or other
  misc_feature (288)..(306): n is a, c, g, or t
tcagagtatacatacacgaccggtgctcgatttagctctacgctcagggcacgaccggtgctcgatttagctctacgctcagggcacgaccggtgctcgatttagctagtactgcgtagggttggaccgaacggtggaacgtccgaaacgttacgngtggtactgctacggtataccgtacggttcgtacgtccgtacccgtacacgtcgtcgtagtacgttggtatacctgtggtaacggtccggactggcgaggcactatagntcgngtgagctcngacngnatgnnnnnnnnnnnnnnnnnnn

SEQ ID NO: 232983 - DNA, 559 bp, Homo sapiens
  misc_feature: GYAE6OF01BFS0W.48.73.G07.1.454.CMB.1.raw
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttactctggggctggactccgccacgcccccgaggggaacgggctgggagtggagttgggaagttactttaccacgaggtgggagcacctactaccaacccgtcctacaaaagtcgaggcaccatactccgtagacacgtaccaaacgaacctaattcctaccctagaacgccgtagacgcctcgtggtcgacccgccgcaacgaccgacggctcgtctaattactgtcgcgacggccccgagcgcgagtggtcttttgacttgtcctttgattagtggtcggggaccaagggtaccagtcggtcctaccggtcttaccg

SEQ ID NO: 232984 - DNA, 344 bp, Homo sapiens
  misc_feature: GYAE6OF01CK3OI.48.73.G07.1.454.CMB.1.raw
  modified_base (293)..(293): a, c, t, g, unknown or other
  misc_feature (293)..(293): n is a, c, g, or t
  modified_base (301)..(301): a, c, t, g, unknown or other
  misc_feature (301)..(301): n is a, c, g, or t
  modified_base (314)..(314): a, c, t, g, unknown or other
  misc_feature (314)..(314): n is a, c, g, or t
  modified_base (320)..(344): a, c, t, g, unknown or other
  misc_feature (320)..(344): n is a, c, g, or t
tcagagtatacatacacgaccggtgctcgatttagctctacgctcagggcacgaccggtgctcgatttagctctacgctcagggcacgaccggtgctcgatttagctctacgctcagggtcacgaccggtgactcgatttagctctacgctctagggcacgaccggtgctcgatttacgcagtactgcgttggttggacctaaggtgaatcgaaacgtacgtgtggcctgactaccgtagtcctgttccttacacttccgtttccgactatcgttgattatgtactaccgttngagcggcncggagaacggcanaagtgnnnnnnnnnnnnnnnnnnnnnnnnn

SEQ ID NO: 232985 - DNA, 709 bp, Homo sapiens
  misc_feature: GYAE6OF01CA86G.48.73.G07.1.454.CMB.1.raw
tcagagtatacatacacgaccggtgctcgatttagctctacgctcagggggcttttctgagagtcatggatctcatgtgcaaagaaaatgaagcacctgtggttcttcctcctgctggtggcggctcccagatgggtcctgtcccagctgcagctgcaggagtccgggcccaggactggtgaacgccgttcggacgaccctgtccctcacctgctactgtctcgtggtcgactccatcagcagctacgtacttacgtcgtgggctggactccgccacggccccgaggggacgggctggagtggagttgggagttacttaccgacgtaggtaggacgacctaacctacgtaacccgtaacccgtacctaacgaaacgtcgagaccacaatacgtaccgtagacctaaccgtaccaaacgtaacctaacttcctaccgtagaacgtctagacgtcttcgtacggtaccggacccgccgacgaacgaccgtacggtcgttacgttacttaacgtttaccgtcggtacggtacccggaccggtcccccggaaggtccgtaccgtacgggtttcggtttaccgtttttacggacgtttccgttacccgttttaggtaacgtttacgggttcggggttaaccggggaacccggttaaaggggtacccgttaaacggttcccgggttaacccgttaccccggtttcgttaaccccg

SEQ ID NO: 232986 - DNA, 587 bp, Homo sapiens
  misc_feature: GYAE6OF01AMWD0.48.73.G07.1.454.CMB.1.raw
  modified_base (417)..(417): a, c, t, g, unknown or other
  misc_feature (417)..(417): n is a, c, g, or t
  modified_base (575)..(575): a, c, t, g, unknown or other
  misc_feature (575)..(575): n is a, c, g, or t
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttctgggctggatccgccagcccccgagggagggctggagtggagttgggagtatttaccacgagtgggagcacctactacaacccgtcctacaaagtcgaggcacatactcgtagacacgtccaagacctaacttctaccctagacgctgacgctcgtgtcgacccgcccganacgacgaccggcttcgtcttagtttactttgaccggtaccggccccgtagccggtacgtacggtcggttctttttggacttcgttacccgttttaggacttaggttgggtcgggggtaacccgaaaggggtacctaaggttcggtaccgtacccgttntcccgtttaccg

SEQ ID NO: 232987 - DNA, 561 bp, Homo sapiens
  misc_feature: GYAE6OF01DD45J.48.73.G07.1.454.CMB.1.raw
  modified_base (369)..(369): a, c, t, g, unknown or other
  misc_feature (369)..(369): n is a, c, g, or t
tcagagtatacatacacgaccggtgctcgatttagctctacgctcagggggctttctgagagtcatggatctcatgtgcaaagaaaatgaagcacctgtggttcttcctcctgctggtggcggctcccagatgggtcctgtcccagctgcagctgcaggagtcgggcccaggactggtgaagccttcggacgacccctgtccctcacctgcactgtctctggtcgctccatcagcagcagtacttacttcgtggggctggatccgccacgcccccgagggaacggggctggagtggattgggatatttacacagtgggagcacctactaccaacccgtcctacgaaagtcgaggcaccatactacgtanacacgtaccaagaaccaattacctccctagaacgtccgtgaacgcttcgtcgtcgaccgccgcagaaccgcggtctcgtactacttactgtcgccgtacggccccgagccgcaggtcgttcttttgcttcgtccgtttgagttcgttcgggtcgggaccaagggtactagtacggtcaccggttcttacccg

SEQ ID NO: 232988 - DNA, 617 bp, Homo sapiens
  misc_feature: GYAE6OF01BFFGL.48.73.G07.1.454.CMB.1.raw
  modified_base (372)..(372): a, c, t, g, unknown or other
  misc_feature (372)..(372): n is a, c, g, or t
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttctgggctggatccgccacgcccccgaggggagggctggaggtggagttgggagtactttaccgacgtaggtgggagcacctacctaccaacccgtcctacaaagtcgaaggcaccatactccgtaanaccgaccgtaccaaacgtaacctaacttcctacccgtagaacgctagacgtcttctcgtacgacccgccgacgaacgaccacggtctaggtccttaacgttcgtggtacggccgaccgggtccccggagccgacgtaggttcggttcgttttagacgttcgttccgtttagtagttaggttcgggtcggggtacccgtaaaggggtactaacggtacgggttacccgtcccggttccgttacccg

SEQ ID NO: 232989 - DNA, 700 bp, Homo sapiens
  misc_feature: GYAE6OF01BMJVN.48.73.G07.1.454.CMB.1.raw
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtcgctccatcagcagcagtacttacgttcgtgggctggactccgccacgcccccgaggggagggtcgtggagtggtagttgggagttactttaccgaacgtaggtagggacgtaccgaacctaaccgtaacccgaaccccgtcctaacgaaaagtcgaacgccaaccatactaccgtaacgactacgtaccaaacgtaacctaactttcctacccgtagaacgtcgtacgtacgtcgtaccgtcgtacggaccccgccgacgaacggaaccgtaccggtccttacgttacttaacgtttacgtcggtacggacccggtaaccgggtacccccggaggtacccgtccgtacgggttaccggtttcgtttttagtaacgttccgttaccgttttacggtaagtttacgggtcggggttaccggggtaaccggaaacggggtaacctaacggttcggttacccgttaccggttccgtttacccg

SEQ ID NO: 232990 - DNA, 709 bp, Homo sapiens
  misc_feature: GYAE6OF01CNVVF.48.73.G07.1.454.CMB.1.raw
  modified_base (335)..(335): a, c, t, g, unknown or other
  misc_feature (335)..(335): n is a, c, g, or t
tcagagtatacatacacgaccggtgctcgatttagctctacgctcagggggctttctgagagtcatggatctcatgtgcaaagaaaatgaagcacctgtgttcttcctctgctggtggcgctccagatgggtcctgtcccagctgcagctgcaggagtccgggcccaggactggtagaagtccgttcggacgtaccccttgtcccctacacctgctacttcgtctcgtggtcgctaccatcagcagctagtacttacgtcgtgggctggactccgccgacgccccggagggagggcgtggagtggtagttggtatactttacgagaggtaggacncaacctactaacccgaacccgtcctaacgtaaaacgcgaacggactaaccaattacgtaccgtaacgaacctaaccgtaaccgaaaacgaaaccctaactttcccgacccgtagaaacgtccgtagacgtactcgtacgtaccggacccgccgtacgaacgaccgaccggtcgttacgttacttaacgtttacgtcgggtaccggacccggaacccgggaccccggacggtaccggtaccgttacggggtttcggtttccgtttttaggaccgtttcgttacccgtttggtaacgttcggttacggggttacccggggaaccgttaaagggtaccttaacggttacgggtacccgtaaccggtttcgttacccg

SEQ ID NO: 232991 - DNA, 578 bp, Homo sapiens
  misc_feature: GYAE6OF01C7XKY.48.73.G07.1.454.CMB.1.raw
  modified_base (361)..(361): a, c, t, g, unknown or other
  misc_feature (361)..(361): n is a, c, g, or t
  modified_base (372)..(372): a, c, t, g, unknown or other
  misc_feature (372)..(372): n is a, c, g, or t
  modified_base (382)..(382): a, c, t, g, unknown or other
  misc_feature (382)..(382): n is a, c, g, or t
  modified_base (388)..(388): a, c, t, g, unknown or other
  misc_feature (388)..(388): n is a, c, g, or t
  modified_base (419)..(419): a, c, t, g, unknown or other
  misc_feature (419)..(419): n is a, c, g, or t
tcagagtatacatacacgaccggtgctcgatttagctctacgctcagggggctttctgagagtcatggatctcatgtgcaaagaaaatgaagcacctgtggttcttcctcctgctggtggcggctcccagatgggtcctgtcccagctgcagctgcaggagtcgggcccaggactggtgaagccttcggagacccctgtccctcacctgcactgtctgtggtgctcatcagcagcagtacttacgtcgtgggctggactccgccacgccccgagggaggcgtggagtggacgtagggatagttaccagagtggacgcacctactaccaacctcctacgaaagtcgacgcacatactcgtanacacgtacaanaaccattccnctgaanctagatctctgtaccgaccgccgcacgaccncggtctgtactattacgtgtacgaccggtacggccccgtaacggcgtacgtacggttcggtttacctttgacgtttcgtccgttttagagttacggttcgggtaccggggaaccgaaagggtaccttaagtccgggtacctacccgttccgtttacccg

SEQ ID NO: 232992 - DNA, 284 bp, Homo sapiens
  misc_feature: GYAE6OF01DYIHD.48.73.G07.1.454.CMB.1.raw
  modified_base (283)..(284): a, c, t, g, unknown or other
  misc_feature (283)..(284): n is a, c, g, or t
tcagagtatacatacacgaccggtgctcgatttagctctacgctcagggcacgaccggtgctcgatttagatcgtctgtgttgggtttgggggtgtggtggtctccactcccgccttgacgaggctgattactactgtcagtcttttgataacaacaatcacgtggtcttcggcggagggaccagcctgaccgtcctaggtcagcccaaggctcgccccctcggtcactctcgttcccaccctcctctatgtactactctgagcggctggcaaggcgcatagnn

SEQ ID NO: 232993 - DNA, 284 bp, Homo sapiens
  misc_feature: GYAE6OF01BS39A.48.73.G07.1.454.CMB.1.raw
  modified_base (281)..(284): a, c, t, g, unknown or other
  misc_feature (281)..(284): n is a, c, g, or t
tcagagtatacatacacgaccggtgctcgatttagctctacgctcagggcacgaccggtgctcgatttagatcgtctgtgttgggtttgggggtgtggtggtctccactcccgccttgacgaggctgattactactgtcagtcttttgataacaacaatcacgtggtcttcggcggagggaccagcctgaccgtcctaggtcagcccaaggctgccccctcggtcactctgttcccgccctcctctatgtatactctgagcgggctggcaaggcgcatagnnnn

SEQ ID NO: 232994 - DNA, 281 bp, Homo sapiens
  misc_feature: GYAE6OF01AHY2C.48.73.G07.1.454.CMB.1.raw
  modified_base (281)..(281): a, c, t, g, unknown or other
  misc_feature (281)..(281): n is a, c, g, or t
tcagagtatacatacacgaccggtgctcgatttagctctacgctcagggcacgaccggtgctcgatttagatcgtctgtgttgggtttgggggtgtggtggtctccactcccgccttgacgaggctgattactactgtcagtcttttgataacaacaatcacgtggtcttcggcggagggaccagcctgaccgtcctaggtcagcccaaggctgccccctcggtcactctgttcccgccctcctctatgtatactctgagcgggctggcaaggcgcatagn

SEQ ID NO: 232995 - DNA, 634 bp, Homo sapiens
  misc_feature: GYAE6OF01BLXHK.48.73.G07.1.454.CMB.1.raw
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagacccctgtccctcacctgcactgtctcgtggtgcctccatcagcagcagtacttacttcgtgggctggactccgccacgcccccgaggggacgggcgtggagtggagttgggagtactttacacgaggtggacgcacctactaccaacccgtcctacgaaagtcgagcacatacgtccgagacacgtaccaaacgaacctaactttcctaccctagaacgtcgtgacgtcctcgtgtccgacccgccgcgaacgaccgcggtctcgttccttattacgtcgtacggaccggtaccgggaccccggtaggtcccggacgtacgggttacggtttcgtttttacggacgtttcggtttcccgtttaggtacgtttaggttcgggtacggggtacccgaaacggggtacgtaaggttaccggtacccgttaccggttccgttacccg

SEQ ID NO: 232996 - DNA, 316 bp, Homo sapiens
  misc_feature: GYAE6OF01DTSUZ.48.73.G07.1.454.CMB.1.raw
  modified_base (283)..(316): a, c, t, g, unknown or other
  misc_feature (283)..(316): n is a, c, g, or t
tcagagtatacatacacgaccggtgctcgatttagctctacgctcagggcgacgaccggtgctcgatttagatcgtctgtgttgggtttgggggtgtggtggtctccactcccgccttgacgaggcctgattactactgtcagtcttttgataacaacaatcacgtggtcttcggcggaggccagcctgaccgtcctaggtcagcccaaggctcgccccctggtcactctgttcccgccctcctctatgtatactctgagcggctggcaaggcgcaatagcannnnnnnnnnnnnnnnnnnnnnnnnnnnnnnnnn

SEQ ID NO: 232997 - DNA, 660 bp, Homo sapiens
  misc_feature: GYAE6OF01DGWPF.48.73.G07.1.454.CMB.1.raw
  modified_base (322)..(322): a, c, t, g, unknown or other
  misc_feature (322)..(322): n is a, c, g, or t
tcagagtatacatacacgaccggtgctcgatttagctctacgctcagggggctttctgagagtcatggatctcatgtgcaaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtcgctccatcagcagcagtacttacttcgtgggctggactccgccacgccccgagggagggcgtggagtggagttgggagtactttaccacgtaggtggganaccaacctaccgtacctaacccggtacctacgaaaaagtcgaacggacaacctatactccgagaccaacgtaccaaacgaacctaacttcctaccctagaacgtctacgacgtcgtctacggtacgacccgccgaccgaacgaccgacggtcgttcgtacttacttacgtcggtacggccgtaccgggcccccgaggccgtaccgtaggtttacggttccgttttttagacggtttcgttccgttttacggtagtttacgggttcgggttacggggggaacccgtaaaacggggtactaaacggtttcgggttacccgtacccggtttgtttaccccg

SEQ ID NO: 232998 - DNA, 533 bp, Homo sapiens
  misc_feature: GYAE6OF01B7MBA.48.73.G07.1.454.CMB.1.raw
  modified_base (308)..(308): a, c, t, g, unknown or other
  misc_feature (308)..(308): n is a, c, g, or t
  modified_base (357)..(357): a, c, t, g, unknown or other
  misc_feature (357)..(357): n is a, c, g, or t
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttcgtggggctggatccgccacgcccccgagggaagggctggagtggagttggagtatttaccanagtggagcacctactacaacccgtcctacaaaagtcgaggcaccatacnccgtagacacgtaccaaagaaccaattcctccctagaacgctgacgctctggtcgacccggccgacagaccacggctcgtctattacttgcgacggcccgagcgcagtcggtcttttgatgtcctttgattagtggtgggacctaagggactagtggtccaccgttctcgttaccg

SEQ ID NO: 232999 - DNA, 551 bp, Homo sapiens
  misc_feature: GYAE6OF01EHF96.48.73.G07.1.454.CMB.1.raw
  modified_base (130)..(130): a, c, t, g, unknown or other
  misc_feature (130)..(130): n is a, c, g, or t
  modified_base (328)..(328): a, c, t, g, unknown or other
  misc_feature (328)..(328): n is a, c, g, or t
  modified_base (368)..(368): a, c, t, g, unknown or other
  misc_feature (368)..(368): n is a, c, g, or t
  modified_base (474)..(474): a, c, t, g, unknown or other
  misc_feature (474)..(474): n is a, c, g, or t
tcagagtatacatacacgaccggtgctcgatttagctctacgctcagggggctttctgagagtcatggatctcatgtgcaaagaaaatgaagcacctgtggttcttcctcctgctggtggcgctcccagntgggtcctgtcccagctgcagctgcagggacgtccgggcccaggactggtgaacgtccttcggacgacccctcgtccctcacctgcactgtctctggtgcctccatcagcagcagtacttacttcgtgggctggactccgccacggccccgagggacgggctggagtggagttgggagttacttaccacgaggtggancacctactaccgacccgtccacaaagtcgaggcacatacnccgtagaccacgtaccaaacgaccctaattcctacctagaactctcgactctctgtacgacccgcgcagaccgacgtctgtctattacgtgtcgacgtacggccgngcgcagtgttctttgatgttccgttgattgtcggacgggtacgaaacgggtactaaggtcgttcgccgtcttacccg

SEQ ID NO: 233000 - DNA, 543 bp, Homo sapiens
  misc_feature: GYAE6OF01EGZWL.48.73.G07.1.454.CMB.1.raw
  modified_base (465)..(465): a, c, t, g, unknown or other
  misc_feature (465)..(465): n is a, c, g, or t
  modified_base (486)..(486): a, c, t, g, unknown or other
  misc_feature (486)..(486): n is a, c, g, or t
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttcgtgggctggactccgccacgcccccgaggggacgggctggaggtgggagttggggagttatttaccgacgaggtgggagcacctactaccaacccgtcctacaaacgtcgaggcaccatactccgtagaccacgtaccaaacgaacctaacttcctaccctagaacgtctagacgtctctcggtcgacccgccgacgacgaccgacgctgtctattacngtcgcgacggcccgagcgcgngtgtctttgcttgtcgttgattgtggacgggcaagggtacacgtggctccgtctccg

SEQ ID NO: 233001 - DNA, 962 bp, Homo sapiens
  misc_feature: GYAE6OF01A57A0.48.73.G07.1.454.CMB.1.raw
tcagagtatacatacacgaccggtgctcgatttagctctacgctctagggggtcgggtttctggagacgtcatggagtacttcacgttggttcgactaaggaaaatgaacgcgaccctgttggttaccttccgtccgtggccttggtacggcggtcgtacccgttagggacttgggggtcccttgggttttccccaggccttggttcctttaaggccgttggacccaagggtacggttccggggacccgtaaaggacgttggggtggaaacgggtccgggttacgggacggtaccccgttcgtacccgtccaccggtcgacctacccgttggtacctccgttcggtccggtccgtttaccgacttccgaggtactacgactagtttaccgttacgttccggtcgggctaggactccgaccgtaccggcccccgaggggaacgggccgtacgggagggtcggtaggtttcgggtacgttacgttttaccggacggtaaggttacgggaacgtaccgtaccgtaactaacccgtaaccccgttaccgttaaacgtaaaacggttacggtacgggacccgtaaccgttacgttaccggtaccgggtaacgggacccgtaacgtttaaccggaaaaccgtaaacccttaacgtttccccgttaacccggtaagggtaaaccctcgttaccggtaacgtaccttacgttacggtaccgtacccgtacccgtaccgtaaaccggtaaccgtaccgggtaacctttacggtttacccttaacgtttaacgcggttaaccgacccggacccgggtacccgtagttaccgttacgttacggttcggttaccttttacggtaaacgttaccggttaccggtttacggacgggttacggggtcgggtacccggggaaccgggtaaacccggtacgttacgtacccgggtaccttacccggttccgttaacccg

SEQ ID NO: 233002 - DNA, 204 bp, Homo sapiens
  misc_feature: GYAE6OF01ATXRX.48.73.G07.1.454.CMB.1.raw
  modified_base (191)..(204): a, c, t, g, unknown or other
  misc_feature (191)..(204): n is a, c, g, or t
tcagagtatacatacacgaccggtgctcgatttagctctacgctcagggcacgaccggtgacgtcgatttagcacacgatagttgggtttgggaccaaggtggaagtcaaacgaactgtggctgcaccatctgtcttcatcttcccgccatctgatatgtatactctgagcgggctggcaaggcgcatagnnnnnnnnnnnnnn

SEQ ID NO: 233003 - DNA, 166 bp, Homo sapiens
  misc_feature: GYAE6OF01CMXOV.48.73.G07.1.454.CMB.1.raw
  modified_base (162)..(166): a, c, t, g, unknown or other
  misc_feature (162)..(166): n is a, c, g, or t
tcagagtatacatacacgaccggtgctcgatttagctctacgctcagggcacgaccggtgctcgatttagtcacgcgagaaagggaagggggctggccctgacgtgtttctgttcccaccctcctctatgtatactctgagcgggctggcaaggcgcatagnnnnn

SEQ ID NO: 233004 - DNA, 671 bp, Homo sapiens
  misc_feature: GYAE6OF01DITJQ.48.73.G07.1.454.CMB.1.raw
tcagagtatacatacacgaccggtgctcgatttagctctacgctcagggggctttctgagagtcatggatctcatgtgcaaagaaaatgaagcacctgtggttcttcctcctgctggtggcggctcccagatgggtcctgtcccagctgcagctgcaggagtcgggcccaggactggtgaagccttcggagaccctgtccctcacctgcactgtctcgtggtcgcctccatcgagcagctagttacttacttcgtggggctggactccgccgacgccccgagggacgggctgggagtggagttgggagttactttaccgacgtaggtgggacgcctaaccctaaccgtaaccctaacccgtccctaacgaaaacggtccgaacggaccaacctaagttaccgtacccggtaacgaaccctaaccgtaaccgaaaacgtaaacccgtaactttaccctaccctaggaaccgtcgtagacgtccttcgtacggtaccgacccgcgacgacgaccgacggtcttacgtacttacgttacgtcgtcggtaccggaccggtcccgaggcgtacgtaggttcgtttcttttgacgttcgttaccgtttaggtagtttaggtcgggtacgggaccgaaacgggtactaacggttccgtaccgtaccgttccttacccg

SEQ ID NO: 233005 - DNA, 715 bp, Homo sapiens
  misc_feature: GYAE6OF01C5QWS.48.73.G07.1.454.CMB.1.raw
tcagagtatacatacacgaccggtgctcgatttagctctacgctcagggggctttctgagagtcatggatctcatgtgcaaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctcatcagcagcagttacttacttcgtggggctgactccgccacgccccgagggagggcgtgggagtggagttgggagtacgtttaccgacgaggtgggacgacaccgtactaaccgaacccgtacccgtacaaaaacgtcgaacggaccaaccgtaactacgtaccgttaacgaccgtaaccgtaacccgaaacgtaaaccgtaactttaccctacccgtacgtaaacgtaccgtagacgtccttacgttacgggttaccggaaccccggtcccggacctaacggaacccgacgggtacctttacggttaccttaagttttaccgttcggtacgggtacccggtaccggggacccccgagggtccgtaccgtacgggtttcgggttacctttttaggacgttcgtaccgttttaggaagtttacggttgggttacggggtaacccgtaaggggtaaccttaaggtccggtacccgtacccggttcttacccg

SEQ ID NO: 233006 - DNA, 611 bp, Homo sapiens
  misc_feature: GYAE6OF01B0KWT.48.73.G07.1.454.CMB.1.raw
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccgttcggagaccctgtccctcacctgcactgtctcgtggtcgctccatcagcagcagtacttacttcgtgggctggactccgccacggcccccgaggggaacgggctggaggtggagttgggagttactttaccgacgtaggtgggacgactacctaacctaccgaaccccgtcctaacgaaacgtcgacggcacatactacgtacgacacgtaccaacgaacctaattcctaccgtagaacgtcgtagacgtctcgtcgcgacccgccgacgacgaccgaccggtctcgtacttattacgtcggtacgaccggaccgggccccgacgccgtccgtaggttcggttcgtttttagacgtttcggtccgtttgtagttggtcggtcggggaccgaagggtactaagtcggtccgtaccgttcgttacccg

SEQ ID NO: 233007 - DNA, 631 bp, Homo sapiens
  misc_feature: GYAE6OF01DE8IO.48.73.G07.1.454.CMB.1.raw
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagacccctgtccctcacctgccactgtctctggtggctccatcagcagcagtacttacttcgtggggctggactccgccacgcccccgaggggacggggctgggagtggagttgggagtagttaccacgaggtaggagcacctactacacccgtccacaaagtcgaggcactatactccgtaagacacgtaccaacgaacctaactttcctacccttagaacgtccgtaggacgtactcgttgtacgaccccggcccgtaccgaacgaccgacggtccttagttccttaatttcgtaggttccggaccggtaaccgggtcccccggaggcccgtacgtaggttcggttctttttggacgttcgtcccgttttagatttaggtcgggttcgggggtaaccgaaggggtacctaacggttcggacccgtaccgtcctttacccgg

SEQ ID NO: 233008 - DNA, 296 bp, Homo sapiens
  misc_feature: GYAE6OF01C4368.48.73.G07.1.454.CMB.1.raw
  modified_base (278)..(278): a, c, t, g, unknown or other
  misc_feature (278)..(278): n is a, c, g, or t
  modified_base (284)..(296): a, c, t, g, unknown or other
  misc_feature (284)..(296): n is a, c, g, or t
tcagagtatacatacacgaccggtgctcgatttagctctacgctcagggcgacgaccggtgctcgatttagatcgtctgtgttgggtttgggggtgtggtggtctccactcccgccttgacgaggctgattactactgtcagtctttgataacaacaatcacgtggtcttcggcggaggaccagccctgaccgtcctaggtcagcccaaggctgcccccctcggtcactctgttccccaccctcctctaatgtatactctgagcgggctggcaaggcncatagnnnnnnnnnnnnn

SEQ ID NO: 233009 - DNA, 599 bp, Homo sapiens
  misc_feature: GYAE6OF01DH5CE.48.73.G07.1.454.CMB.1.raw
tcagagtatacatacacgaccggtgctcgatttagctctacgctcagggggctttctgagagtcatggatctcatgtgcaaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttctggggctggactccgccacgccccgagggacgggctggagtggagttgggagtactttaccacgaggtgggagcaccgtactaccaacccgtacctacaaaagtcgaacggcaccatactccgtagacacgtaccaaagtaaccaacttcctaccctagaacgtctacgacgcttcgtcgtacgacccgccgcgacgaccgacggcttcgtactacttacgtgtcgaccgtacgggccccgacgccgcgtagttcggttctttttgacttcgtccgtttaggtattacggtcgggttaccggggaaccgaaacgggtaacaaacgttcgggtaccctaccggttcttacccg

SEQ ID NO: 233010 - DNA, 177 bp, Homo sapiens
  misc_feature: GYAE6OF01DF0JA.48.73.G07.1.454.CMB.1.raw
  modified_base (158)..(158): a, c, t, g, unknown or other
  misc_feature (158)..(158): n is a, c, g, or t
  modified_base (164)..(177): a, c, t, g, unknown or other
  misc_feature (164)..(177): n is a, c, g, or t
tcagagtatacatacacgaccggtgctcgatttagctctacgctcagggcacgaccggtgctcgatttagctctacgctcagggcacgaccggtgctcgatttagagctcacgttattgggtttggggtttttagatctgagcgggctggccaaggcncatagnnnnnnnnnnnnnn

SEQ ID NO: 233011 - DNA, 681 bp, Homo sapiens
  misc_feature: GYAE6OF01EPKA5.48.73.G07.1.454.CMB.1.raw
tcagagtatacatacacgaccggtgctcgatttagctctacgctcagggcacgaccggtgctcgatttagtcacgcgagaaagggaaagggggctttctgagagtcatggatctcatgtgcaagaaaatgaagcacctgtggttcttcctcctgctggtggcggctcccagatgggtcctgtcccagctgcagctgcaggcgtcgggccaggactggtgaacgtccgttcggacgaccctgtccctcacctgcactgtctctggtggcctccatcagcagctagtacctttacttcgtggggctggacgtccgccgacgcccccgaggggaacgggctgggagtggagttgggtagttacttaccgacgtaggtgggacgccacctaccgtaacccgtaaccccgttaccctacgaaaacggttccgacggaccaacctaacgttacctaccgggtaacgaaccgtaaccgtacccgaaaacgtaaccctaactttcccgtaccctacggtaacgtccgtagtaccgtcttacgtcggtacgaccccggtccgtaccgacggaaccgtaccggtcgttacgttacccttagtttaaccggtcggttaccggaccggtaacccggccccggacggaccggccgtagggttccgtttcgtttttacgtcgttcggtttacccg

SEQ ID NO: 233012 - DNA, 750 bp, Homo sapiens
  misc_feature: GYAE6OF01BPBDV.48.73.G07.1.454.CMB.1.raw
tcagagtatacatacacgaccggtgctcgatttagctctacgctcagggggctttctgagagtcatggatctcatgtgcaaagaaaatgaagcacctgtggttcttcctcctgctggtggcgctcccagatgggtcctgtcccagctgcagctgcaggagtcgggccaggactggtgaacgccttcggacgtaccctgtccctacacctgctactgtctcgtggtcgcctccatcagcagcagttacttacttcgtgggctgactccgccgacgccccgagggacgggctggagtggagttgggattacgtttaccacgtagtggacgccgtaaccgtacctaaccgtaaccccgtaccccgtaacgtaaaacggtaccgacggaccaaccgtaagtacgtacccgtaacgaaccgaacccgttaaccgaaaaccgtaaaacctaactttaccctacccgttagaaacgtcctacggaacggtcctaccgttacgtaccggaccccggacccgacgaacggaaccgtaccgggtcgttagttaccttaacgttttacgcggttacggacccgggtaccgggtacccccggaaggtcccggtaacgttacgggttccggtttccgtttttagacgtttacggttcccgtttttaggaaacgttacggttacggggaccgggggttaaccggtaaaacgggtaacgtaaacgggttccgggttaccccgtaacccggttccgtttaaccccg

SEQ ID NO: 233013 - DNA, 669 bp, Homo sapiens
  misc_feature: GYAE6OF01BI5B7.48.73.G07.1.454.CMB.1.raw
  modified_base (177)..(177): a, c, t, g, unknown or other
  misc_feature (177)..(177): n is a, c, g, or t
  modified_base (254)..(254): a, c, t, g, unknown or other
  misc_feature (254)..(254): n is a, c, g, or t
  modified_base (381)..(381): a, c, t, g, unknown or other
  misc_feature (381)..(381): n is a, c, g, or t
  modified_base (408)..(408): a, c, t, g, unknown or other
  misc_feature (408)..(408): n is a, c, g, or t
tcagagtatacatacacgaccggtgctcgatttagctctacgctcaggggctttctgagagtcatggatctcatgtgcaagaaaatgaagcacctgtggttcttcctcctgctggtggcggctccagatgggtcctgtcccagctgcagctgcaggagtcgggcccaggactgggtnaacgccttcgggacgaccctgtccctcgacctgcacttgtctcgtggtcgactcatcagcagcagtacttacttcgngggctggactccgccacgccccgaggggaggccgtggagtcggagttaggagttacttaccacgaggtgggacacacctacgaacacccgtacctaacgaaacgtcgacggcaactagtataccganacctacgtacaacgtaactacttaccnccgtagaacgtctacgactcgtctcggtacgaccgcccgacacgaccgtacgtcgttcgtacttagttactggtaacggaccggtacgggacccccgaggtccgtacggtaccggtcggtttaccgttttacgggtcgtttaccggtaccgttttttaggaagtttcgggttacggggttaacccgggggtacccgtaaaaacggggttaacgttaaccgggtttaccggacccgtttaaaccgttccccgtttaacccgg

SEQ ID NO: 233014 - DNA, 738 bp, Homo sapiens
  misc_feature: GYAE6OF01BJPBG.48.73.G07.1.454.CMB.1.raw
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactgggtgaagccgttcggagacccctgtcccctcacctgcactgtctcgtggtcgcctccatcagcagcagttacttacttcgtgggctggactccgccacgccccgaggggacgggctggaggtggagtgggagttacgttaccgacgaggtgggacgtcctaacctactaaccgaaccccggtacctaacgaaaacggtccgaacggacccaacgtaactactaccggtaacgacctaaccgtaccgaaacgtaacctaactttccctacccgtaggaaaccgtcgtacggtacgtccttacgtacggtaccgtaacccggcccggtacacggtaccaacggtccttaggtaccttagttaccgtggtaccgaccggaccgggtacccccgaggtcccgtacgtacgggttcggtttaccgttttacggtacgtttaccggttaccgttttagggtacgtttaccggttcgggggtacccgggggtaaacccgtaaacgggggtaaccgtttaaacgggtttcccgggttaaaccctttcccccgggttaccttttaccccggg

SEQ ID NO: 233015 - DNA, 877 bp, Homo sapiens
  misc_feature: GYAE6OF01ALT1D.48.73.G07.1.454.CMB.1.raw
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggacgaccctgtccctcacctgcactgtctcgtggtgctccatcagcagcagttacttacttcgtgggctggactccgccacggccccgaggggacgggcgtggaggtggtagttgggtagttacgtttaccgacgtaggtacgggacgtaccgtaacccgttaaccgtaacccgaaccccgttaccccgtaaacgaaaacggttccggaacggtaccctaaaccgtacgttaacgtacccggtaacgaaccgtaacccggtaacccgaaaacggtaaaccctaacgtttaccctacccgtaaggtaacgtccgttacggtacgttaccgttaccgtacgggtacccggaccccggtcccggaaccgaacggtaacccgtacccggggttaccttaccggtttaccttaacgttttaccggttcggtacccgggtaaccccggggtacccggggtaccccccggtagggtaccccggttaccggttaacggggttttccgggttttaccgttttttacgggtaaacccggttttccgggttttaaccccggtttttagggtaaaccggttttacgggtttaccgggggttaccggggggtaacccggttaaaacggggggttaacccgtttaaacgggtttaccccggggttaaccccgttaccccgggtttaccccgttttaaccccggg

SEQ ID NO: 233016 - DNA, 604 bp, Homo sapiens
  misc_feature: GYAE6OF01BYBHP.48.73.G07.1.454.CMB.1.raw
  modified_base (327)..(327): a, c, t, g, unknown or other
  misc_feature (327)..(327): n is a, c, g, or t
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagcagtacttacttcgtggggctggactccgccacgccccgaggggacgggctgggaggtggagttgggagttatttaccgacgtaggtgggacnctacctactaccaaccccgtcctacgaaacgtcgagccacatacgtacgtagaccacgtaccaacgtaacctaacttcctaccgtagaacgtctacgacgtctacgtcgtcgacccgccgacacgaccgacgtctcgtctagttactgtcgcggaccgcccgagccgtcgtacggttcggttctttttagacgttcgttacccgtttaggtattaggttcgggtacggggacccgtaaagggtaacctaggtcggtacccgtacccgttcttacccg

SEQ ID NO: 233017 - DNA, 128 bp, Homo sapiens
  misc_feature: GYAE6OF01C3PR4.48.73.G07.1.454.CMB.1.raw
  modified_base (128)..(128): a, c, t, g, unknown or other
  misc_feature (128)..(128): n is a, c, g, or t
tcagagtatacatacacgaccggtgctcgatttagctctacgctcagggcacgaccggtgctcgatttagagctcacgtattgggtttggggtttttagtatctgagcgggctggcaaggcgcatagn

SEQ ID NO: 233018 - DNA, 810 bp, Homo sapiens
  misc_feature: GYAE6OF01CMECG.48.73.G07.1.454.CMB.1.raw
tcagagtatacatacacgaccggtgctcgatttagctctacgctcagggggctttactgacgagtcgatggactctcatgtgcaaagaaaatgaagcacctggtggttcttcctcctgctggtggcgctccagatggtcctgtcccagctgcgagctgcgaggagtccgggccgaggacgtgggtgaacgtccgttcgggacgtacccgtcgtccctcaccgtgctactgtctgtggtcgctccagtcagcagtctaagttacttacgttcggtgggtctaggtactccggcccgaccggaccccccggaagggggtaacggggtccggtaggggtacgggtagggtacgggtttaggggtaacgtttaaccgtttaacccggacggttaacggggttacgggaaaccggtaccgtaaaccccgttaaccgtaaaccccgtaaccccggttaccctaaacggtaaaaaccggttcggaacggtaaccgaaccgtaacgttaaccgtaaccggtaacgtaacccgaaccggttaaacccaaaccggtaaaaccctaaccgttacccgtaacccgtaagtaaaccggtctaggtaacctccgttacgtacggtacccgaccggacccgcgaacggacccgtacgtccgtacgttaccgtaacgttaccggtcggttaccggaccggtacccgggtacccggacggtccgtacggtacggtttcgttacgttttgaccgttcgttccgtttaggtatacggtgggtaccgggacgtaacggtacgtagttccggtccgtcgttcgttacccgg

SEQ ID NO: 233019 - DNA, 372 bp, Homo sapiens
  misc_feature: GYAE6OF01DZAY4.48.73.G07.1.454.CMB.1.raw
  modified_base (114)..(114): a, c, t, g, unknown or other
  misc_feature (114)..(114): n is a, c, g, or t
  modified_base (317)..(317): a, c, t, g, unknown or other
  misc_feature (317)..(317): n is a, c, g, or t
  modified_base (346)..(372): a, c, t, g, unknown or other
  misc_feature (346)..(372): n is a, c, g, or t
tcagagtatacatacacgaccggtgctcgatttagctctacgctcagggcacgaccggtgctcgatttagctctacgctcagggcacgaccggtgctcgatttacgctctacgntcagggcacgaccggtgctcgatttagctctacgctcaagggcacgaccggttgactcgtagtttacgcgagttaccgtggcgtttaggggtttgggaacctaagggttggaagtaccgaaaacggtaaccttggaggtacctggacctaaccgtattccgtgtcttacagttccttccgctatctggattagtgtaatcctntggagcggtctggacaagggcactagtgnnnnnnnnnnnnnnnnnnnnnnnnnnn

SEQ ID NO: 233020 - DNA, 671 bp, Homo sapiens
  misc_feature: GYAE6OF01B29ZZ.48.73.G07.1.454.CMB.1.raw
tcagagtatacatacacgaccggtgctcgatttagctctacgctcagggggctttctgagagtcatggatctcatgtgcaaagaaaatgaagcacctgtggttcttcctcctgctggtggcggctcccagagtgggtcctgtcccagctgcagctgcaggagtccgggcccaggactggtgaacgtccgttcggacgtaccctcgtccctcacctgcactgtctcgtggtcgctccatcagcagctagttacttacgttcgtgggctcggactccgccaccgccccggaaggggacggggctgggagtggtagttaggattacttaccagaggtggacgctacctactaaccacccgtaccaacgaaacgtcgacgaccacatacgtacgtagacctacgtaccaaaacgtaacctaacttcctaccgtagaacgtcgtagacgtctcgtacgtaccggaccccgccgacgacgaaccgtccgggtcttcgtaccttaacttcgaggttccggacccggaccgggtccccgacgcggtaccgtagggtttacggtttccgttttacggacgttcgtttaccgtttagtacgttagggttcggggtaaccggggaccgtaaaacggggtaccttaacggttcccgggtacccttacccgttcccgttacccg

SEQ ID NO: 233021 - DNA, 647 bp, Homo sapiens
  misc_feature: GYAE6OF01CB18E.48.73.G07.1.454.CMB.1.raw
tcagagtatacatacacgaccggtgctcgatttagctctacgctcagggggcttttctgagagtcatggatctcatgtgcaagaaaatgaagcacctgtggttcttcctcctgctggtggcggctcccagatgggtcctgtcccagctgcagctgcaggagtcgggcccaggactgggtacgaagccgttcggacgtaccctcgtccctcaccgtgctactgtctcgtggtgcctcatcgagcagctagttacttacgttcgtgggcgtggactccgaccgacgaccccggaggggacgggctgggagtggagttagggagttacgttaccgagtaggtgggacacctaccgtaactaacccgaacccgttacccgtaacgtaaaacggtccgaacggtacccaactacgtaacgtccgtaagaccaccgtaaccaaacgtaaacctaacttccgtaccgtacggaactcgtacgacgtctcgtacggccgtacccgcgacgagaccgcggtcttacgtattacgtcgtgacgcgaccggcccagtccgacgtgttcggttctttgacttcgtcgtttgagttggttcggggacggtaacgaacgggtaacctaacggttcggtaccgttaccggttccttacccgg

SEQ ID NO: 233022 - DNA, 824 bp, Homo sapiens
  misc_feature: GYAE6OF01BBS5T.48.73.G07.1.454.CMB.1.raw
  modified_base (643)..(643): a, c, t, g, unknown or other
  misc_feature (643)..(643): n is a, c, g, or t
tcagagtatacatacacgaccggtgctcgatttagctctacgctcagggggctttctgagagtcatggatctcatgtgcaaagaaaatgaagcacctgtggttcttcctcctgctggtggcggctcccagagtgggtcctgtcccagctgcagctgcgaggaggtccgggcccgaggactgggtagaacgccgttcggacgtaccctcgtcccctcacctcgccacgttcgtctcgtggtcggtcctaccatcagcagtctaacgttaccttacgttcggtcgggtcgtcggtaccgtcccgccgaaccggacccccggaagggggaacggggtcggtagggagggtagggttacggttaggggtaacgtttaacgttaacccgacggtagggtacgggaccgtaccgtaaccctaaaccgtaaccccgtaaaccccgttacccgtaaacgtaaaacggtaccgaacggtaccaactaactaccgtaccgtaacgaaccgtaaccgtaacccgaaacgtaaaccttaacttacccgtaccgtaagtaacgtacgtacggaacttccgttaccgtacgtacccggtacccgaccgacggaaccggtaaccgttaccggtacttacgttacttacgtttaccggnggtaccgggtaccgggaacccggtcccggagggacctccggtacggtttcggtttactttacggtacggttaccgtttcggttaacggttaagttcggggttaccggggtaacggggtaaccggtaaacggggttaacgtaacggttaccgggtacccttacccggttcccgttaacccgg

SEQ ID NO: 233023 - DNA, 660 bp, Homo sapiens
  misc_feature: GYAE6OF01B44MN.48.73.G07.1.454.CMB.1.raw
  modified_base (490)..(490): a, c, t, g, unknown or other
  misc_feature (490)..(490): n is a, c, g, or t
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtagaagtccttcggacgaccctgtccctcacctgcactgtctcgtggtcgcctccatcagcagcagtacttacttcgtgggctggactccgccacgccccgaggggacgggctggagtggtagtgggattacttaccgacgaggtggacgcctacctactaaccacccgtacctacgaaacgtccgagaccacgtatactaccgtagaccacgtaccaaacgtaacctaacttcctaccctagaacgtcgtagacgtcctacgtcgtaccgacccgccgacgaacgaccgacggtctcgtacttacgtttacgnggtacgccggaccgggtccccgaggcccgtacgtacgggttcgtttccgtttttagacgttcccgttaccggtttgaaggtttacggttcggggggttaccgggaaacccgtaaaggggtacccttaaacgggttccggtaacccggttaccccggtttccgtttacccg

SEQ ID NO: 233024 - DNA, 676 bp, Homo sapiens
  misc_feature: GYAE6OF01BNN8L.48.73.G07.1.454.CMB.1.raw
  modified_base (190)..(190): a, c, t, g, unknown or other
  misc_feature (190)..(190): n is a, c, g, or t
  modified_base (509)..(509): a, c, t, g, unknown or other
  misc_feature (509)..(509): n is a, c, g, or t
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcgganaccctgtccctcacctgcactgtctctggtcggctccatcagcagcagtacttactcgtgggctggactccgccacgccccgagggaacgggctggagtggtagttgggagttacttaccgacgaggtcgggagtccaacctacctaacctaaccccgtaccctacgaaaacgtccgaacgaccaaccgtatacgtaccggtaacgaccgtaaccgtaccaaacgaaccctaagttccgtacccgtagtaacgctaggaacgtccgtacgttagtccgacccggccgactacgacgtaccggctcgtactagttaccgngtcgaccggaccggtcccgtagcccgtacgtacggttacggttccgttttaggacttaccggtccgtttttaggtaacgttacgggttcgggtacccgggggtaaccgaaacggggtacccgttaaaggttccgggttaacccgttacccggttctttaacccccgg

SEQ ID NO: 233025 - DNA, 659 bp, Homo sapiens
  misc_feature: GYAE6OF01A91BG.48.73.G07.1.454.CMB.1.raw
  modified_base (202)..(202): a, c, t, g, unknown or other
  misc_feature (202)..(202): n is a, c, g, or t
tcagagtatacatacacgaccggtgctcgatttagctctacgctcagggcacgaccggtgctcgatttagtcacgcgagaaagggaaagggggctttctgagagtcatggatctcatgtgcaagaaaatgaagcacctgtggttcttcctcctgctggtggcggctcccagatgggtcctgtcccagctgcagctgcagggngtccgggcccaggactgggtgaacgccgttcggacgccctgtccctcacctgcactgtctcgtggtgctccatcagcagcagttacttacgttcggtcgggctggactccgccgacggccccgaggggacgggctaggacggtggagttagggagttacgtttaccgacgtagggtcgggacgacctaacccgtaacctaacccgtaaccccgttacccctaaacgaaacggtaccggacggaccctaacctaagtaccgtacccggtaacgtaaccgaaccggtaaccaaaacggaaccttaacctttcccgtacccgttagaacgtccgtagacgtccttcgtacggtccgacccgccgacgacgaccgacggtcttacgtcttacgttcgtcggcgtaccggccggcccggacgccgtacgtacgggttcgttagttttacgcgttcgttaccg

SEQ ID NO: 233026 - DNA, 773 bp, Homo sapiens
  misc_feature: GYAE6OF01B1H0K.48.73.G07.1.454.CMB.1.raw
tcagagtatacatacacgaccggtgctcgatttagctctacgctcagggggctttctgagagtcatggatctcatgtgcaagaaaatgaagcacctgtggttcttcctcctgctggtggcgctccagagtgggtcctgtcccagctgcagctgcagggagtccgggacccagggtactgggtacgaacggtcccgttacgggaacgtacccctcgtcccctacacctgactacctgtcttcgtgggtcgctacatcagcacgcagttacttcgtcggtgggctggactcccgaccgaccggccccggaaggggacggggtccgtagggaggtgggtaacgttggggtaacttacgttaccgaggtaacggtcgggaactacctaacccgtaacctaacccgtaacccgtacccgtaaacgtaaaagtccggaaacggaccctaaccgtattaccgtaccggtaacgacccaaccgtaaccaaaacgtaaccctaacttaccctaccgtaggaaacgtcgtacgacgtacgttcgtaccgacggaacccggccgacgaacgacccggtacgtaccgtcgttacctaacgttacgtcggtaccggaccgggacccggaccccggacggaccggtacggttaacggttcggtttacgttttacggtaccgttacggtttcccgtttaggtaacgttacggggttaccgggaccggggtaaccgaaacgggtaaccgttaacggtaccgggtaccctaaccggttcggtttaacccg

SEQ ID NO: 233027 - DNA, 718 bp, Homo sapiens
  misc_feature: GYAE6OF01CHPH5.48.73.G07.1.454.CMB.1.raw
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcggcccaggactggtgaagccgttcggagaccctgtccctcacctgcactgtctctggtggctccatcagcagctagtacttacttcgtgggctggactccgccacgccccgagggagggcgtggagtggagttgggagtacttaccgacgtaggtgggacgcaacctaccgtaaccgtaaccccgtacctaacgaaaacgtcgaacggaccaacctaacgtaacgtaccgtaacgacctaaccgtaaccaaacgtaaacccgtaacttacccgtaccctaggaacgtccgtacgaacgtcccttacgtcggttacgaccccggtccgactaacggaacccgaccggtccttacgtacctttaacgtttacgtcgggtaccggaccgggtacccggtacccccggtacggtacccgtcgtacgggttcgggttacctttttacggacgtttcgggttacccttttagggtaactttacgggttcggggtaacggggtaaccccgtaaaggggtaaccctaacggttccggtaacccgtacccggttcccgttacccg

SEQ ID NO: 233028 - DNA, 689 bp, Homo sapiens
  misc_feature: GYAE6OF01C7R9C.48.73.G07.1.454.CMB.1.raw
tcagagtatacatacacgaccggtgctcgatttagctctacgctcagggggctttctgagagtcatggatctcatgtgcaaagaaaatgaagcacctgtggttcttcctcctgctggtggcggctcccagagtggtcctgtcccagctgcagctgcgaggacgtccgggcccaggactggtagaacgtcccgttcggacgacccctcgtcccctcacctgcacttgtctcgtggtcgctccatcagcagctagttacttacgttcgtgggtctggactccgccaccggaccccgaaggggacgggcgtagggtacggtaggtagttgggtacgttaacgtttaccgacgtaggtagggacgtaccgtaaccctaaccgtaacccgtaacccgtaccctaacgaaaacggtccgaacggacctaaccgtaacttacgtacccgtaacgaacctaaccgtaaccaaacgtaaaccctaactttccctaacccgtacgacgtaccgtagacgtctacgtcggtaccgacccgaccgacgaacggaccgacggtcttagtacttacgttcgtcgcggtaccggaccggcccgacgtccgtcgtaggttcgttcgttttagcttcgttccgtttagagttaggtcgggtacgggtaccgaagggtactaagtcggtaccgtcgttccgttaccg

SEQ ID NO: 233029 - DNA, 671 bp, Homo sapiens
  misc_feature: GYAE6OF01DN9Z0.48.73.G07.1.454.CMB.1.raw
tcagagtatacatacacgaccggtgctcgatttagctctacgctcagggggctttctgagagtcatggatctcatgtgcaaagaaaatgaagcacctgtggttcttcctcctgctggtggcggctcccagatgggtcctgtcccagctgcagctgcaggagtcgggcccaggactggtgaagccttcggacgaccctgtccctcacctgcactgtctctggtcgctccatcagcagcagtacttacttcgtgggctggactccgccacgccccgagggacgggcgtggagtggagttgggagttaactttaccgacgaggtgggacgacgtaccctaacctaccgaaccccgtcctaacgaaaacgtccggaagaccaccatactacccgtaagacctaccgtaccaaacgaaacctaacgttcctacccgtagaacgtctagacgtcttcgtcgtacgacccgccgacgacgaccgacggtccttagtacttaagttacgtggtacgcggaccgggccccgaggtccgacgtacggttcggttcctttttagggaccgtttcggtcccgtttttaggaacgtttacgggttacgggttaccgggggacccgtaaaacgggggtaccttaaacggttccgggttacccttaacccgggttcctttacccgg

SEQ ID NO: 233030 - DNA, 158 bp, Homo sapiens
  misc_feature: GYAE6OF01CLBMO.48.73.G07.1.454.CMB.1.raw
  modified_base (143)..(158): a, c, t, g, unknown or other
  misc_feature (143)..(158): n is a, c, g, or t
tcagagtatacatacacgaccggtgctcgatttagctctacgctcagggcacgaccggtgctcgatttagacagtatatatccgcgggcggtgctcgatttagacagtatatatcgaggcggctggacgaaggcgacagtagnnnnnnnnnnnnnnnn

SEQ ID NO: 233031 - DNA, 655 bp, Homo sapiens
  misc_feature: GYAE6OF01C5V5X.48.73.G07.1.454.CMB.1.raw
  modified_base (187)..(187): a, c, t, g, unknown or other
  misc_feature (187)..(187): n is a, c, g, or t
  modified_base (627)..(627): a, c, t, g, unknown or other
  misc_feature (627)..(627): n is a, c, g, or t
tcagagtatacatacacgaccggtgctcgatttagctctacgctcagggggctttctgagagtcatggatctcatgtgcaagaaaatgaagcacctgtggttcttcctcctgctggtggcgctccagatgggtcctgtcccagctgcagctgcaggagtcggccaggactggtgaagccttcggacnccctgtccctcacctgcactgtctcgtggtcgctccatcagcagtcagttacttacgttcgtgggctggctccgccacgccccgaggggacgggctaggagtggtagtagggtagttacttaccagtaggtcggacgacctaccgtaactacccgaacccgtcctaacgaaaacgtcgaacggtacaacctatacgtaccgaagtacctaccggtaaccaacgtaaaccctagttaccctaccgtagaacgtcgtacgactccgttcgtacggtaccgacccggaccgtacgaaggacccgtacggtacctttacgttacgttaacttacggttcggtacggccggaacccggtccccgaggtcccgtacgtcgggttacgttcttttacgagttccgttaccgtttagaacgttgtcgggtacgggtactaaacgggtntaacgttcggtaccgtcgttcgttaccg

SEQ ID NO: 233032 - DNA, 282 bp, Homo sapiens
  misc_feature: GYAE6OF01EQ6CI.48.73.G07.1.454.CMB.1.raw
  modified_base (281)..(282): a, c, t, g, unknown or other
  misc_feature (281)..(282): n is a, c, g, or t
tcagagtatacatacacgaccggtgctcgatttagctctacgctcagggcacgaccggtgctcgatttagatcgtctgtgttgggtttgggggtgtggtggtctccactcccgccttgacgaggctgattactactgtcagtcttttgataacaacaatcacgtggtcttcggcggagggaccagcctgaccgtcctaggtcagcccaaggctgccccctggtcactctgttcccgccctcctctatgtatactctgagcgggctggcaaggcgtcatagnn

SEQ ID NO: 233033 - DNA, 772 bp, Homo sapiens
  misc_feature: GYAE6OF01DNC5O.48.73.G07.1.454.CMB.1.raw
  modified_base (304)..(304): a, c, t, g, unknown or other
  misc_feature (304)..(304): n is a, c, g, or t
tcagagtatacatacacgaccggtgctcgatttagctctacgctcagggggctttctgagagtcatggatctcatgtgacaaagaaaatgaagcacctggttggtttcttcctctgcgtgggtcggcggctacccagagtcgggtcctgtcccagctgcagctgacgagggacggtccgggacccaggacgtggtacgaacgtccgttacggacgtaccctcgtccctcactgctactgtctgtggtacgctacatacgagacgagtactaacgttacttacgtcggtgggtacgtacggaccncccggaccgaccggaccccgggaaggggtaacgggtcgtagggtaggtagggttaggttacggtaactttacgttaaccgaaggtagggtacggactaccgttaacctaaccgtaacccgtaacccgtaaccgtaaacgtaaaacggtcgaacggacctaaccgtagtaaccgtaccgtaacgaaccgtaaaccggtaaaccaaacgttaaaccgttaccttacccgtaccgtaagtacgtccgtagtacgttaccgttacgtacggtaccggaacccgtaccgaacgaacgtacgtacggtacttacggttaacttacggtacgtcgacggacccgtaccggacccggtagcccgttaggtacggttcgtttacgtttcgacggtttacgttaccggttagtacgttagggtcgggaacgggtaacggaaggttactacgggtacccgttaccgttcgttcgtaccg

SEQ ID NO: 233034 - DNA, 673 bp, Homo sapiens
  misc_feature: GYAE6OF01AZ5B3.48.73.G07.1.454.CMB.1.raw
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggacgaccctgtccctcacctgcactgtctcgtggtgctccatcagcagcagttacttacttcgtgggctggactccgccacgccccgagggacggcgtggagtggtagtgggtagttacgttaccgacgaggtggacgactaccgtacctaccgaaccccgtccaacgaaacgtcgacgaccacatactccgtagacaccgtaccaaacgaacctacttcctaccgtagaacgtctagacgtctcgtcggtacgacccgcccgacgacgaaccgtaccggtccgttacggttaccttaacgtttacgtcggtacggacccgggtacccgggtccccggaggccgtacggtacggttcggtttaccgtttttaggacgtttccggttaccgttttaggtaacgtttacggttcggggtaccggggtaaccggtaaacggggtaaccttaacgggttacccggttaccgtacccggttcgttacccgg

SEQ ID NO: 233035 - DNA, 332 bp, Homo sapiens
  misc_feature: GYAE6OF01ACWD6.48.73.G07.1.454.CMB.1.raw
  modified_base (298)..(332): a, c, t, g, unknown or other
  misc_feature (298)..(332): n is a, c, g, or t
tcagagtatacatacacgaccggtgctcgatttagctctacgctcagggcacgaccggtgctcgatttagatcgtctgtgttgggtttgggggtgtggtggtctccactcccgccttgacgaggctgattactactgtcagttcttttgataacaacaatcacgtggtcttcgggcggagggaccagcctgacccgtcctaggtcacgccaaggcctcgccccctggtccactcctcgttccccacccttcctctatgtactactcgtgaggcgggctaggacaacggcgacagtagnnnnnnnnnnnnnnnnnnnnnnnnnnnnnnnnnnn

SEQ ID NO: 233036 - DNA, 129 bp, Homo sapiens
  misc_feature: GYAE6OF01DO1G9.48.73.G07.1.454.CMB.1.raw
  modified_base (127)..(129): a, c, t, g, unknown or other
  misc_feature (127)..(129): n is a, c, g, or t
tcagagtatacatacacgaccggtgctcgatttagctctacgctcagggcacgaccggtgctcgatttagagctcacgtattgggtttggggtttttagatctgagcgggctggcaaggcgcatagnnn

SEQ ID NO: 233037 - DNA, 804 bp, Homo sapiens
  misc_feature: GYAE6OF01CRMLG.48.73.G07.1.454.CMB.1.raw
tcagagtatacatacacgaccggtgctcgatttagctctacgctcagggggctttctgagagtcatggatctcatgtgcaaagaaaatgaagcacctgtggttcttcctcctgctggtggcggctcccagagtgggtcctgtcccagctgcagctgcaggacgtcgggcccaggactggtagaacgtccgttcggacgtacccctcgtcccctccaccgtgacctacttcgttctcgttgggtcggcctaccatccaggcaggtactacgttacctttacgttcggtggggcctggacctcccgaccgaccggaccccggagggggtacgggcgtgggaggtggagttggggaattaacgtttaccgagtagggtgggacgtacctacccgtaaacctaacccgaaccccgttacccgtaacgaaaacggtcggaacggacccaacgtaataccggtaccgtaacgaccctaaccgtaacccaaacgtaaccctaacttacctacccgtagaacgtaccgtagtaacgtcgtccgtcggtaccgaccccggcgaccgtaacgaccggtacggtacgttacgtacctttacgttactcgggtacggaccccggtacccgggaccccggtagggtcccgtacggttcgggttaccggtttcgtttttaccgcggttttaccggttaccgttttaggtagttttaaggggtacccgggggttacgggggtaaacccgggtaaaacgggtacccgtaaaacgggtttccgggtttaccccgttaacccccgggttccgtttaaccccg

SEQ ID NO: 233038 - DNA, 723 bp, Homo sapiens
  misc_feature: GYAE6OF01DL2TE.48.73.G07.1.454.CMB.1.raw
tcagagtatacatacacgaccggtgctcgatttagctctacgctcagggggctttctgagagtcatggatctcatgtgcaaagaaaatgaagcacctgtggttcttcctcctgctggtggcggctcccagagtggtcctgtcccagctgcagctgcaggaggtccgggcccaggactgggtgaagcccgttcgggacgaccccttgtcccctcacctgccacttgtctcgtggtcgctccatcagcagcagttacttacgttcgtggggctggactcccgccgaccgccccggaggggacgggcgtagggaggtggagttgggacttacgttaaccgacgtaggtgggacaccgaaccttaaccgtaacccgtaaaccccgtccctaaacgaaaaacggtccggaacggtaccaacctaagttacgtaccgtaacgacctaaccgtaacccaaaacgtaaaccctaactttccccgtaccgttaacgaacgtaccgttagaacgtccgttccgtacggtaccggacccgccgacaacggacccgacggtcttacgtacttaattcgtacgtcggaaccggtccggccccgagggcctacgtacggttcggttttacttttggacctttcggttaccgttttagacggtttacggtcggggtaccgggtaaccggtaacggggtaactaacggttccggtaaccgttacccgttcgttacccgg

SEQ ID NO: 233039 - DNA, 647 bp, Homo sapiens
  misc_feature: GYAE6OF01C34SR.48.73.G07.1.454.CMB.1.raw
  modified_base (192)..(192): a, c, t, g, unknown or other
  misc_feature (192)..(192): n is a, c, g, or t
  modified_base (620)..(620): a, c, t, g, unknown or other
  misc_feature (620)..(620): n is a, c, g, or t
tcagagtatacatacacgaccggtgctcgatttagctctacgctcagggggctttctgagagtcatggatctcatgtgcaagaaaatgaagcacctgtgttcttcctcctgctggtggcgctcccagatcggtcctgtcccagctgcagctgcaggcgtccggcccaggacgtggtgaacgccgttcggacnccctgtccctcaccgtgactcttcgtctcgtggtcgcctacatcagcagctagtacttcgtcggtggtctggactccgccgacggccccggagggagggtctgggagtggtacgttaggacgttacttaccgaacggtaggtacgggacgtacctaaccgtaccgtaaccaacccgtacctaaacgaaacgtcgacgtacacctagtactacggaactacaccgaaccaaacgaaccttacttaccacctagaacgtcacggactcgttcgacggtacccgaccggacccgtacgaaccgtaccgtcggtacttacgtattaaccgtttcgacggtcggtccggacccggacccgtgaccgtacgtacggttcgttacgtttagcgtttcgtaccgttgagttcggtgggaccgggtacaaacgggtntaacggtccgtaccgtcctgttacccg

SEQ ID NO: 233040 - DNA, 720 bp, Homo sapiens
  misc_feature: GYAE6OF01C06YU.48.73.G07.1.454.CMB.1.raw
  modified_base (268)..(268): a, c, t, g, unknown or other
  misc_feature (268)..(268): n is a, c, g, or t
  modified_base (705)..(705): a, c, t, g, unknown or other
  misc_feature (705)..(705): n is a, c, g, or t
tcagagtatacatacacgaccggtgctcgatttagctctacgctcagggggctttctgagagtcatggatctcatgtgcaaagaaaatgaagcacctgtggttcttcctcctgctggtggcggctcccagatgggtcctgtcccagctgcagctgcaggaggtccggcccaggactggtagaacgtccgttcggacgaccccttcgtcccctcaccgtgccacgtgtctcgtggtgcctcatcgagcagctaagttacttacgttcgngggctggactccgccaccggaccccggaggggacgggcgtaggacggtagggagttagggtattaacgttacccgagtagggtacggacgacctaacctaccgttaacccgaacccgttcccgtaacgaaaacggtccgaacggacctaaccgtaaacgttaccgtaccggtaacgacccgtaacgtaaccctaaacgtaaacctacttacccgtacccgtaaggacgtacctacggaaccgtcccttacggtcgtaccgacccggtaccgacgtaccgtaacggacgttcctacggttacttagttacgtcggtacgggtaccggaccgggcccggtagccgtaccgtacggttcgtttcttttaggacgttcgttaccgtttggaacgttcggttacgggaccgggtacgtaacgggtacttacgtcggtacccnccgtttctaacccgg

SEQ ID NO: 233041 - DNA, 636 bp, Homo sapiens
  misc_feature: GYAE6OF01CEHNB.48.73.G07.1.454.CMB.1.raw
tcagagtatacatacacgaccggtgctcgatttagctctacgctcagggggctttctgagagtcatggatctcatgtgcaaagaaaatgaagcacctgtggttcttcctcctgctggtggcgctcccagatgggtcctgtcccagctgcagctgcaggagtcgggcccaggactggtgaacgccttcggacgaccctgtccctcacctgccactgtctcgtggtcgctcatcagctagcagttacttacgtcgtgggctggactccgccacgccccgaggggaagggcgtggagtggagttggacgttacttaccgacgaggtggacgccaacctacctaaccaaccccgtcctaacgaaaacgtcgacggaccaaccatactaccgtaacgaccaacgtaccaaacgaaacctaacttcctaccctaggaacgtacgtacgaacgtccgttcgtacggtaccgacccggtaccgaccgaaccgaccgtaccggtcttacgttacttaactttacgtcggtacggaccggaccggcccgagtcgacgtacggttcgttaccgttttgagtttcgtccgtttagacgttaggtcggtacgggacgtaaaggactagtacggtcctaccggtcttacg

SEQ ID NO: 233042 - DNA, 713 bp, Homo sapiens
  misc_feature: GYAE6OF01BL6SY.48.73.G07.1.454.CMB.1.raw
tcagagtatacatacacgaccggtgctcgatttagctctacgctcagggggctttctgagagtcatggatctcatgtgcaagaaaatgaagcacctgtggttcttcctcctgctggtggcgctcccagatgggtcctgtcccagctgcagctgcaggagtccgggcccaggactgggtgaacgtccgttcggacgtacccctgtcccctcaccgtgcctactgtctctgggtcgcctccatcgagccagcacgtacttacgtcgtgggctaggactccgccgaccgccccggaggggacgggctgggacgtgggtagttgggtacgttagttaaccgacgtaggtagggacgaccgtaaccttaccaacccgtaaccccgtacctaacgtaaacggtaccgacggacctaaccgattaccgtaccgtacgaccgtaaccgtaccaaaacgaaccctaacttccctaaccctaggaacgtcctaggtactccgtaccgtcgtaccggacccgccgacgtaaccgaccggacgttccgtacgtacgttaacttccggtcggccggacccgggacccgggccccgtaacgggccgttacgggtaccggtttgggttaccgttttacggttagttccggttcgtttaagttacgtaggttcggggtacgggtaccggaaagggtaactacggtaccgtccgtaccgttcgtaccccg

SEQ ID NO: 233043 - DNA, 966 bp, Homo sapiens
  misc_feature: GYAE6OF01D2EPX.48.73.G07.1.454.CMB.1.raw
tcagagtatacatacacgaccggtgctcgatttagctctacgctcagggggctttctgagagtcatggatctcatgtgcaaagaaaatgaagcacctgtggttcttcctcctgcgtggtggcgcctccgagtggtcggtctcgtccagtctgcacgtcgtcgacggagggtaccgggcccgggaccggaacgggtacggtgggtaacggtaaccggttcccggttaccgggaacccgtccccgttcccgttcccctacctaccgtcgacctcgttcgttccgttcggttcggggtccgtccctacgtacgtaccgacgacgacgtacttaacgttttaaccgtttccgttcggggtcgggtccgtacggtacccgtcccggacccggtaacccccgggacccgggggtaaaggggggaccgggtcggttagggggtagggtagggttacggggtttaacggggttaactttaaccgtttaacccgaagggtacggggtacggaaccgtaaccccgtaacccttaaacccgtaaacccccggtaacccccgttaacccgtaaaaggtaaaccggtccggaaccgtacctaacctaacgttaccgtaaccggtaaccaaccccggtaacctaaacccgaaaaaccgttaacccttaaccgtttaccgtacccggtaagtaacggtcgtaacgtacgttcctacgtacggcccgtaaccccgcggacgtaaccggaccgtcgttaccgttacggttactttacgttacgtcgggtaacccggcccgggaccccggtacccgggtaacggtccggtaccgggtttcggtttaccggtttttacgtttaccggttacggtttacccgtttggtttaacggttacggtttaggggtcccgggggtaaacccgggtaaacgggtaacgtacggttacggttacccgttaacccggttccttaaccgttacccg

SEQ ID NO: 233044 - DNA, 655 bp, Homo sapiens
  misc_feature: GYAE6OF01AZJ3N.48.73.G07.1.454.CMB.1.raw
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccagggactggtgaagcccttcggagacccctgtcccctcacctgccactgtctcgtgggtcgcctccatcagcagcagttacttacttcgtgggctggactcccgccacggcccccgaggggaacgggcgtgggaggtggtagttgggtagttactttaccgagtaggtgggacgaccacctaactacctaaccccgtcctacgaaagtcgagccacactactccgtacgacctacgtaccaaagaaccctacttcctaccgtagaacgtcctagacgtcccttcgtacggtaccgacccgccgtacaacggaccgaccggtcgttcgtacctttattacgtcggtaccggtcggacccgggtccccgagtccgaccgtagggttcggttcttttggacgtttcggttcccgtttaggacgttacgttcgggtacggggtaccaaggggtaaccttaggtaccggttacccgtcccgttgttaccccg

SEQ ID NO: 233045 - DNA, 991 bp, Homo sapiens
  misc_feature: GYAE6OF01B2HE2.48.73.G07.1.454.CMB.1.raw
tcagagtatacatacacgaccggtgctcgatttagctctacgctcagggggctttctgagagtcatggatctcatgtgcaaagaaaatgaagcacctgtggttcttcctcctgctggtggcggctcccagagtgggtcctcgtcccagctgcagctgcgaggacgtccgggcccgaggacgtgggtacggaacgtccgttacgggacgtacccctcgtcccctccacctgcctacgttcgttcgtcgtggtcgcctcatcagcagctacgttaccttacgttcggtcgggcgtcggaccgtcccggacccgaccgggtacccccgggaaggggggtacggggtccggttaggggtacggtagggttacggtttacggggtaacgtttaaccgtttaaccgaacgggttagggtacgggaacggtaacccgtaaacccgttaaaccgtaaccccggtaaaccccgttaacccgtaaacggtaaaaaccggtccggaaaccggtaacctaaacccgtaacgttaaccgttacccggtaaccgtaaccgtaacccggaaacgtaaaaccgtaaacccttaaacgtttccccgtaacccggttacggaaaccggttccgttaacggaacccgtttcccgtaccggttaccggtaccccgtaacccggcccggtaaacggtaccggaaacccgttccgggtaccgtttacggttaacctttaccgggtttaccggtacgggttaccggaaccccggggtaacccgggccccggttaagggtccggttaacgggttaccgggttttacggttttaccggttttttcggaaaccggtttttcccggggtttaaccttttaggggtaattttaaccggggggtttaccggggtaaacccggggggttaaccggtaaaaaccggggtttaccgtttaaaccgggggtttaccccggttaaacccccggtttaacccgggttttcccgtttaaaccccggg

SEQ ID NO: 233046 - DNA, 613 bp, Homo sapiens
  misc_feature: GYAE6OF01D9MG9.48.73.G07.1.454.CMB.1.raw
  modified_base (442)..(442): a, c, t, g, unknown or other
  misc_feature (442)..(442): n is a, c, g, or t
tcagagtatacatacacgaccggtgctcgatttagctctacgctcagggcacgaccggtgctcgatttagtgacatctcgtagttctttggggggatctcatgtgcaagaaaatgaagcacctgtggttcttcctcctgctggtggcggctcccagatgggtcctgtcccagctgcagctgcagggacgtcgggcccaggactggtgaacgccttcggagaccctgtccctcacctgccactgtctctggtcgctccatcagcagcagtacttactcgtgggctggactccgccacggccccgaggggaacgggcgtggacgtggtagttgggtattattaccagagtggacgctactactaccaacccgtcctacaaacgtcgacggcaaccatactaccgagaccacgtaccaaacgaacctaattccaccctaggaacnctagactctcgtacgtcgacccgccgacgacgtaccgacggtctcgtacttacttacgtggtcgccggtacggtcccccggaaggtcccggtcgtaacggttcggtttcgtttttacgacgtttccggtaccttttggaatttcggttccggggtccggggtaaacccggg

SEQ ID NO: 233047 - DNA, 737 bp, Homo sapiens
  misc_feature: GYAE6OF01DMCB6.48.73.G07.1.454.CMB.1.raw
tcagagtatacatacacgaccggtgctcgatttagctctacgctcagggggctttctgagagtcatggatctcatgtgacaaagaaaatgaagcacctgtggttcttcctcctgctggtggcggctcccagatgggtcctgtcccagctgcagctgcaggagtccgggcccaggactggtgaagccttcggacgaccctcgtccctcacctgccacgtgtctcgtgggtcgcctccatcagcagctacgttacttacttcgtgggctggactccgccgaccgccccggaggggacggggcgtgggacggttggtaggttagggtacgtttaacgttaccgaacgtagggtacgggacaccgtaacctacctaacccgaacccgtacctaacaaacgtcgaacgcacctactactaccgtaacacgtaccgaaccaaacgtaaacctacttcccgtacccgttaagacgtacgtacgaacgtcttccgtacggtaccggacccgcccgaccgaacggaaccgtccgggtactttacgtacttaagttacggtcgggttaccggccggaaccggggtccccggacggtacggtacccggttagggttcgttttacccggtttttagtcccggtttacggttccgttttaacggaacgtttacgggttcgggggtaaccggggtacggtaaaccgggttaacgaacggtttccgggttaacctccggttccttaacccgg

SEQ ID NO: 233048 - DNA, 719 bp, Homo sapiens
  misc_feature: GYAE6OF01B4GDA.48.73.G07.1.454.CMB.1.raw
  modified_base (321)..(321): a, c, t, g, unknown or other
  misc_feature (321)..(321): n is a, c, g, or t
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctcgtggtgcctccatcagcagcagttacttacttcgtgggctggctccgccacgcccccgaggggaacgggcgtggaggtcggtagttgggagttactttaccgagnggtgggacgtacctacccgtacctaaccctaacccgtaccctaacgaaaacggtcgaacggacctaaccaacgttactacccggtaacgaccaaccgtaccaaacggaaacctactttacctaccgtagaacgtcgtagacgtcctcgtcgtcgacccgccacgacgaccgacggtcttacgtcttaacgttcgtcgtacggtacccggccggtacccccggaggccgtaccggttaggtttccgggtttaccgtttttacggtacgtttcccgggtttaccgttttaagggtaaccgtttacggtttcgggggtacccgggggttaaacccgaacgggggttaaccttaaacgggttacccgggtttacccgttacccggttcccgttttaccccgg

SEQ ID NO: 233049 - DNA, 791 bp, Homo sapiens
  misc_feature: GYAE6OF01AZ1QE.48.73.G07.1.454.CMB.1.raw
  modified_base (129)..(129): a, c, t, g, unknown or other
  misc_feature (129)..(129): n is a, c, g, or t
tcagagtatacatacacgaccggtgctcgatttagctctacgctcagggggctttctgagagtcatggatctcatgtgacaagaaaatgaagcacctgtggttcttcctcctgctggtggcgctccagntcgggtcctgtcccagctgcagctgacgaggacggtccgggacccaggacgtggtaggaacgtcccgttcggacgtaccccttcgtcccctacaccgtgctacgttgtcctcgtggtcgcctaccatcgacgacagtcgtacgttaccttacgttcggtacgggtctcggtacctcccgaccgaccggccccgggaagggggtacgggcgtaggggacggtggtaggttacggggtaacttaccgttaaccgaggtaggtacggacgtacccctaaccgtaaccgtaacccgtaacccccgttaccgaacgtaaacggtccgaacggacccaaccgtaacgttacccggtacgtaacgaacccgtaacccgtaaccgtaaaacgtaacccttaacgttacccgtaccgtacggaactccggtacgacgttctaccgtacggtccggaacccgccgacgacggtaccgtcggtcttacggttacgttacttacggtcgaccgggtaccggacccggtcccgtagggcccggttagtacggtttcggtttcgtttacggtacttccgggtttacctagggttacgttacgggtacggggttacccgggtaacgtaacgggttaacgttaccggttacggttacccctccgggtttcttacccgg

SEQ ID NO: 233050 - DNA, 689 bp, Homo sapiens
  misc_feature: GYAE6OF01A3N9C.48.73.G07.1.454.CMB.1.raw
  modified_base (250)..(250): a, c, t, g, unknown or other
  misc_feature (250)..(250): n is a, c, g, or t
  modified_base (611)..(611): a, c, t, g, unknown or other
  misc_feature (611)..(611): n is a, c, g, or t
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctcgtggtcgctcatcgagcagcagtacttacttcgnggtctggactccgccacgccccgagggacggcgtgggagtggtagttgggtaagttactttaaccgacgtaggtagggacgtaccgtaacccgttaacctaacccgtaacccccgttacccgtaaaccgtaaaacggtccgaacggacctaactacgaacgttacgtaaccggttaacgaaccgtaaaccgtaacccaaacgtaaacccttaacgttacccttacccgtaacgaacgtctacggtactcgtacgtcgtacggacccgtccgacgtacgaaccgcggtcttagtaccgttagttaccgtgttccggaccggtaccggccccggtagccgacgtaggttggtttccttttagngtttccgtcgtttagtacgttaaggtcgggtaacgggaccgtaagggtaccgtaaggtccggttacgtccgttacccg

SEQ ID NO: 233051 - DNA, 807 bp, Homo sapiens
  misc_feature: GYAE6OF01ENN62.48.73.G07.1.454.CMB.1.raw
tcagagtatacatacacgaccggtgctcgatttagctctacgctcagggggctttctgagagtcatggatctcatgtgacaagaaaatgaagcacctgtgttcttcctcctgctggtggcgctcccagacgtcgggtcctgtcccagctgcagctggcaggagtccgggcccaggacttggtgaacgtccgttcggacgtacccttcgtcccctcacctgctacttcgtccgtcgtggtcgcctccatcgagcagcctagtacttactcgtgggctgacctccgccgacgccccgtaggggaacggtcgtaggtaggtggtagtttaggggtaacgtttacgttacccgaggtagggtacgggtacgtaccgtaacccgttaccgtaaccgtaaccccgtaccctaaacgaaacgtcggaacggaccaacctagtactaccgtagaaccgaccgttaaccaaacgaaacccttaacttcccgtacccgtaacgtaaccggtacgtaccgtaacgtccgttaccgttaccggttaccggaaccccggacccggacgtaaccggtaccgtaccggttaccgttaggttaccttttaaacgttacgtcggttacggacccgggaacccgggtaccccggtaaggcccgtacggttaggttcggtttaaccgttttgtaacgtttccggtttaccgttttggtaaactttacggggttcccgggttaaccgggggtaccgttaaaacgggggtaacttaaccgggtttacccggttcccgtttaaacccggtttcccggttttaaccccgg

SEQ ID NO: 233052 - DNA, 574 bp, Homo sapiens
  misc_feature: GYAE6OF01ADLPG.48.73.G07.1.454.CMB.1.raw
  modified_base (363)..(363): a, c, t, g, unknown or other
  misc_feature (363)..(363): n is a, c, g, or t
  modified_base (398)..(398): a, c, t, g, unknown or other
  misc_feature (398)..(398): n is a, c, g, or t
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagacccctgtccctcacctgcactgtctcgtggtgctccatcagcagcagtactacttctgggctggatccgccagcccccgagggaggctggagtgatggagtagtttaccacaggtgggagcacctactaccaacccgtcctacgaaaagtcgaggccaccatactaccgtanacaccgtaccaaagaaccacttctcccgtagaacncgttgacgtcctcgtggtaccgaacccggccgtacgaacgaccacggccgtgttactaacttacgtgtacgcggaccggccccgtagcgctagttcgtcgttttgagttcgccgttttgataggttggtccggggacaaggggtaccaaggttcggtaccgtcccgtcgtttcccg

SEQ ID NO: 233053 - DNA, 724 bp, Homo sapiens
  misc_feature: GYAE6OF01BUHUG.48.73.G07.1.454.CMB.1.raw
tcagagtatacatacacgaccggtgctcgatttagctctacgctcagggggctttctgagagtcatggatctcatgtgcaagaaaatgaagcacctgtggttcttcctcctgctggtggcggctcccagatcgggtcctgtcccagctgcagctgcaggagtcgggcccaggactggtgaagccgttcggacgaccctgtcccctcacctgcacttgtctcgtggtcgctcatcagcagcagttacttactcgtgggctggactccgccaccgccccggagggacggggcgtggaggtggtagttcgggaagttacgtttaccgaggtagggtcgggacgacctaaccctaaccgtaacccgtaaccccgtacccgtaataaaccggtcgaacggtacctaactaacgttaacttaccggaacgtaacccaacgttaacccaaacgtaaccctaacttaccctaccgtagacgtctacggtactcccgtacgtacggtaccgacccgtaccgaccgtaacggaaccggtccgtccgttacgttacgttaaccgttacggtcgtaccggtaccggggacccgtccccggaaggtccgtaccggtacgttcggtttctttggtaccgtttcggttccgtttacggttagtacggttacggggtacccgggaacggtaaacgggaactttaccgggtacggttacccgtcccgtttcgttaccccgg

SEQ ID NO: 233054 - DNA, 769 bp, Homo sapiens
  misc_feature: GYAE6OF01CMJUC.48.73.G07.1.454.CMB.1.raw
tcagagtatacatacacgaccggtgctcgatttagctctacgctcagggggcttttctgagagtcatggatctcatgtgcaagaaaatgaagcacctgtggttcttcctcctgctggtggcggctccagatgtgtcctgtcccagctgcagctgcgaggcgtcgggcccaggtactggtagacgtccgttacggacgtccctcgtccctcacctgctactgtctcgtggtcgctccatcagccagtctacgttacttacgtcgtcgggctggacctcccgaccgaccggaccccggaaggggacgggtcgtagggacggttggtacgttagggtaacgtttaacgttacccgaggtacgggtacgggaacgtaccctaaccgttaacccgtaaacccgtaaccccgttacccgtaaacgtaaaacggtcggaaccggtacctaaaccgtaacgtacgtacccggtacgtaaccgaaccgtaacccaaaacgtaaccctaacgtttccctacccgtagaacgtcgtacgactcgttccgtacggtaccgacccgccgtacgaaccgtaccgtacggttacttacgttaccgttaacgttccgtacggtccggaccggtccgggtaccccgtaggtccggtacgttcggttacgtttacgtttaggtacgtttacggtttacgtttacgtagggttccggggtaccgggtaaccgttaaacggggtaccttaacggggttacccgtcccgttacccggttcgttaccccgg

SEQ ID NO: 233055 - DNA, 696 bp, Homo sapiens
  misc_feature: GYAE6OF01ED9V0.48.73.G07.1.454.CMB.1.raw
tcagagtatacatacacgaccggtgctcgatttagctctacgctcagggggctttctgagagtcatggatctcatgtgcaagaaaatgaagcacctgtggttcttccctcctgctggtggcggctcccagatgggtcctgtcccagctgcagctgcgaggagtccgggcccaggactgggtagaacgtccgttcggacgtaccccttcgtccctccacctgcctactcgtctcgtggtcggacctccatcagcagctagttacttacgttcggtgggctggactccgccgaccggccccggaaggggtacgggtcgtagggtaggtcgggtaggttaggggtacgtttaacttaaccgaggtagggtcgggacaccgtaacccgttaacctaaccgtaaccccgtaccgtaaacgaaacggtcgaacggtaccaacgtacttacgtaccgaacgtacctaccgtaacgaaacgtaaacctacttcccgtaccgtagacgtcgtagactcgtcgtacgtaccgacccgccgacgaaccggacgtcgtcgttacgtacttacgttacgtcggaccgaccggtaccgggcccgtaagccgacgttacggttcgtttcgttgtacgttcttacgttgtacgttggtcgggtaccgggtacaaacgggtactaacggttcggtaccctccggttcttaccg

SEQ ID NO: 233056 - DNA, 820 bp, Homo sapiens
  misc_feature: GYAE6OF01CDS2V.48.73.G07.1.454.CMB.1.raw
  modified_base (118)..(118): a, c, t, g, unknown or other
  misc_feature (118)..(118): n is a, c, g, or t
  modified_base (129)..(129): a, c, t, g, unknown or other
  misc_feature (129)..(129): n is a, c, g, or t
  modified_base (226)..(226): a, c, t, g, unknown or other
  misc_feature (226)..(226): n is a, c, g, or t
tcagagtatacatacacgaccggtgctcgatttagctctacgctcagggggctttctgagagtcatggatctcatgtgacaaagaaaatgaagcacctggtgttcttcctctgctggnggcgctccagngtcggtcctcgtccagctgcagcagcgagggacggccgggccaaggtactgggtacgtaacgtccggttacgaacgtcccttcgtccctccaccgtnaccgtcgttcgttcctcggtcggtcgcctaccagtccgacgatacggtattaacggttaaccctttgtccggttacgggcgttacgggcctaccgacccggaaccggtaccccgggaagggggtacgggtcgagggtaggtacggagtttacggaattctaaccgaggttaggacgggtaccaaccttaccctaaaccgtaacccgtaacccgttaccccaaagtaaaaccggtcgacggtaacctacgtaacgtaacgtaccggtaactaccgaaccgttaaaccggaaaacttaaaccctacgtttacccgttacggaacgtaacgccgttacgtaccgttacgtacgtaccggaccgaacccgacggaacctaccgggaacgtacccgttacgtttacgtacgttttaaccgttaccggttacgaccgggacccggtaaccgaccccggtcgtacccgtaaggggttcgttacgggttttcgtacttccgggttcgtttacccgttagggtaaatttcgggggaccggggtaggtaaacccggttaaacggacgttaacggtcccggttaccgttaccgtacggtttcccc

SEQ ID NO: 233057 - DNA, 750 bp, Homo sapiens
  misc_feature: GYAE6OF01AR6A5.48.73.G07.1.454.CMB.1.raw
  modified_base (223)..(223): a, c, t, g, unknown or other
  misc_feature (223)..(223): n is a, c, g, or t
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaacgccttcggagacccctgtcccctcacctgcactgtctctggngcctccatcagcagctagtaccttacttcgtcggggtctcggactccggcccacggccccccgaaggggaacggggcgtgggaggtcggtagttggggtagttaacgtttaccgaacgtagggtgggacgaccgtaaccgtacctaaccgaaaccccgttacccctaacgaaaacgttacgacggaccaaccatactacccggtagaacctaccgtaaccgaaacgaaacctaactttaccctacccgtagaacgactggacgtctaccgttaggtaccggacccgacccgacctacggaaccgtacccgggaccttcgttacttacgtttaaccgttcgtacggcccgggtacccgggtcccccgggacggtacccggtccggtaacgggtttcgtttacccggtttttaggaccgttcgggttccgttttaacggtagttacggttccggggtacggggaacccggtaaacgggtaaccgtaacgggtttacccggtccgttaaccccgttccggtttaaccccg

SEQ ID NO: 233058 - DNA, 277 bp, Homo sapiens
  misc_feature: GYAE6OF01CDSLL.48.73.G07.1.454.CMB.1.raw
  modified_base (151)..(151): a, c, t, g, unknown or other
  misc_feature (151)..(151): n is a, c, g, or t
  modified_base (252)..(252): a, c, t, g, unknown or other
  misc_feature (252)..(252): n is a, c, g, or t
  modified_base (258)..(277): a, c, t, g, unknown or other
  misc_feature (258)..(277): n is a, c, g, or t
tcagagtatacatacacgaccggtgctcgatttagctctacgctcagggcacgaccggtgctcgatttagtagcatactgttgggtttgggccaagggacaacggtcaccgtctcttcagcctccaccaagggcccatcggtcttcccccnggtcgccctgctccaggagcacctccgagagcacagcggccctgggctggacctgggtcaaggactacttccatgtatactctgaggcggctggcaaggcncatagnnnnnnnnnnnnnnnnnnnn

SEQ ID NO: 233059 - DNA, 798 bp, Homo sapiens
  misc_feature: GYAE6OF01E4HEP.48.73.G07.1.454.CMB.1.raw
  modified_base (608)..(608): a, c, t, g, unknown or other
  misc_feature (608)..(608): n is a, c, g, or t
tcagagtatacatacacgaccggtgctcgatttagctctacgctcagggcacgaccggtgctcgatttagtgacatctcgcagttcgtttgggggatctcatgtgacaaagaaatgaagcacctgtcggttccttcctctgcgtggtcggcgctccgagacgtcggtcctcgtccagctgcacgctgcgacggtacggtccggccgaggtacgtggtacgtacgtccgttcggaccgtacccttccgtccctactaccgtcgtaccgtacgttcgtcgttcggtcggtaccgcctaccgtaacgtccgacgtacgtacgttacgtaacgttttacgtttacggttcggtacgggtaccgtacggaccgtccccgacccggacccggtaccggggtaggggtaccggtcggtacgggtcggttagggtaacggtttcggttaaacgtttacgttaaccggaggtacgggtcggtaacctacccgaaaccgttaaccccgtaacccgacccgttaaacgtaacggaaacggtccgacggactaccgtacgtacgtacgaccaacctacggtaaaccaacgttaaccttaccgtccctaagaacgttaccngttacgaccgtttccgcggtaacgccccgtacgcccttaaggaaccttccgggacttcgttaatcctttacgggtcgccggtccggaaccgggtccccgaaagtcggtcccgtttaggtaacgggtttttcccgttatttagacccgttcggtttaagtagggtcggttaccggtacgggggtaacccgg

SEQ ID NO: 233060 - DNA, 914 bp, Homo sapiens
  misc_feature: GYAE6OF01D77EX.48.73.G07.1.454.CMB.1.raw
tcagagtatacatacacgaccggtgctcgatttagctctacgctcagggggctttctgagagtcatggatctcatgtgcaagaaaatgaagcacctgtggttcttcctcctgctggtgcggctcccagatgggtcctgtcccagctgcagctgcaggagtcggccaggactggtgaagtccttaccggacgtaccccttcgtcccctccaccgttcgacctaccgttcgttccttcgttacgggtcggcccttccaactcgacggcaacggactaacgttaccttttaaccgtttcggtcggggtccgtacgggaccttcccgacccgaccgaccccccgggaaggggaacgggggtccgtagggacggttcggggtaacggtttacggggaacgttttaaccgtttacccgaaccggttagggtacggggtaaccgaccctaaccccgtttaaacccgttaaaccccgtaaacccccccggttaacccctttaaaccgaaaaaccgggttcccggaacgggtaacccaaaccccgtaaagttaacccgttaaccccggtaaacgtaaaccccgaacccgggttaaaccccaaaaaccggttaaaccccttaaaccgttttaccccgtacccttaacggaaaccgtacccgtttaggaacccgttaccgttacgttaccgggttacccggacccccgtaccggtaaccgaacggaacccgtaacccggttccttacggttaactttacgtttaccgtacgggtcccgaccgggtaacccgggtaccccacgggtctaccggttaagggttccggttttgttttaccgagtttccgtaccgttttcggaagttacggttcgggtacgggaacccgttaagggtaacctagtccggttacccgcgttcttacccgg

SEQ ID NO: 233061 - DNA, 901 bp, Homo sapiens
  misc_feature: GYAE6OF01C6GS4.48.73.G07.1.454.CMB.1.raw
  modified_base (208)..(208): a, c, t, g, unknown or other
  misc_feature (208)..(208): n is a, c, g, or t
  modified_base (259)..(259): a, c, t, g, unknown or other
  misc_feature (259)..(259): n is a, c, g, or t
tcagagtatacatacacgaccggtgctcgatttagctctacgctcagggggctttctgagagtcatggatctcatgtgcaaagaaaatgaagcacctgtggttcttcctcctgctggtggcggctcccagatgggtcctgtcccagctgcagctgcaggagtcgggcccaggactggtagaacgtccgttcggagaccctgtcccctnacctgcactgtcctgtggtcgctccatcagcagctagttacttacgttcgngggtctggactcccgacccgacggcccccggaaggggaacggggtcgtagggtacggtagggtacggtttaggggtaacgtttaacgtttaacccgaacggtaacgggtcggggtaacctaacccgtaaccccgttaaacccgtaaccccgtaaacccccggtttaccccgttaaccggtaaaaacggttccgggaaacgggtaccctaacccgaaacgtttaaccgttaccccggtaacgaacccgtaaaccggttaaccccgaaaacggtaaaaaccccttaacgttcccgtaacccgttaacggaacgtaccttaggaaccggttctttacggtacggtaccggaccccgtacccgggacaaaccggtacccgaccggttacctttacgttaccctttaaagttaccggttggtacggtacccgggaaccgtcccccggttaaggcccgggttaacgtacgggttttcccgggtttattttttacgggacccgttttaggttaccccgtttttaagggtaacttagggtttaccgggggtaaccccgggggtaaacccggttaaacgggggtaaacccgtttaaacggggtttaccgggttaaccccggtaccccgggtttttcctttaacccccgggg

SEQ ID NO: 233062 - DNA, 749 bp, Homo sapiens
  misc_feature: GYAE6OF01CB6FU.48.73.G07.1.454.CMB.1.raw
tcagagtatacatacacgaccggtgctcgatttagctctacgctcagggggctttctgagagtcatggatctcatgtgcaaagaaaatgaagcacctgtggttcttcctcctgctggtggcggctcccagagtgggtcctgtcccagctgcagctgcgaggagtccgggccaggactgggtgaacgtccgttcggacgacccttcgtcccctcacctgacctacgtcgtctcgttgggtcgacctccagtcagcacgtctaacgttacctttacgttcggtcggggtcctacgggacctcccggacccgacccgggacccccggaagggggtaacggggccgtggggtaggtcgggtagtttacggggtaacgttacgtttaacccgaacggtagggtacgggacgtaccgtaacccgttaacctaaccccggtaaccccgtaacccgtaacggtaaaacggtccgggaacgacctaaccgtaactacgtaccgtaacgacctaccgtaaccaaacgtaaccttacgttccctacgtacgacgtcgtagacgtcttcgtacgtccggacccgcgacgaacgaccgtcggtctacgttactttacgtcgtcggcggacccggtaccggtacccgaggccgtacggtacggttcgtttacgttttgaccgttgtttcgtttacgagtttacggtcggggtacggaaccggttaacgggctttacggtacggttccgtacccgttctaaccg

SEQ ID NO: 233063 - DNA, 746 bp, Homo sapiens
  misc_feature: GYAE6OF01A2LQ2.48.73.G07.1.454.CMB.1.raw
  modified_base (391)..(391): a, c, t, g, unknown or other
  misc_feature (391)..(391): n is a, c, g, or t
  modified_base (604)..(604): a, c, t, g, unknown or other
  misc_feature (604)..(604): n is a, c, g, or t
tcagagtatacatacacgaccggtgctcgatttagctctacgctcagggggctttctgagagtcatggatctcatgtgacaagaaaatgaagcacctgtgttcttcctctgctggtggcgctccgagtgtgggtcctgtcccagctgcagctgcgagggacgtccggggacccagggactgggtagaacgtccgttacggaactcccttcgtcccctcgacctgctacttcgtctcgtggtcgcctcatcgagtcagtctacgttacttacgttcggtggggctacggtacctcccggacccgaccggaaccccgggagggggtacgggtcggtggggtaacgggttgggttaaggtagggttacgttaaccgtttaaccgaggtaagggngggtacaacccgtacccgtaacctaaccgtaaccccctaccgaaagtaaacgtcgacgtaaccaaccgtactacggtaccgtaacgaaccgtacctaaccgaaactaaccgttaactcccgtaaccgtaaggacctacgtcgtaacgtccgtagacgtccccgaacggcccgaaaggaccacgggtaccgtcttacggttacttaacgtttcnccgggtaccgccggaaccgggtcccgtaggcctaagggtcgttcggtttacttcggagtttacctagttacgacgtttaggggtcgggtaaacgggactaacgggttacggtaacgttccggtaaccctcgttcccgttacg

SEQ ID NO: 233064 - DNA, 706 bp, Homo sapiens
  misc_feature: GYAE6OF01DM78X.48.73.G07.1.454.CMB.1.raw
tcagagtatacatacacgaccggtgctcgatttagctctacgctcagggggctttctgagagtcatggatctcatgtgcaagaaaatgaagcacctgtggttcttcctcctgctggtggcggctcccagagtggtcctcgtcccagctgcagctgcaggagtcggccaggctggtgaacgccttcggacgaccctcgtccctacacctgctacgtgtctcgtggtcgctccatcgacgcacgactagttaccttacgttcggtgggtctagggactcccggacccgaccggaccccggaagggggacgggtcgtagggtacgttagggtacggtttagggtacgttaacttttaccgaacggtaggtcgggaacacctacctaaccgtaacccgtaacccgtaccgtaacaaaacggtccggaacggtaccaaccgtaacgtaccgtaccgtaacgaccaaccgtaaaccgaaacgtaacccttaacgtttccctaaccgtacgaacgttccgtaggaccttacgtcgtaaggtcccgaccgacccgagtacgaccgtacggtccgttcgttacttgttacgtgcggtacgggaccgcccgagccgtagtaggttcggtttcgttttagacgttcgttcgtttagtacgttgtcgggtaccgggtacaaacgggaccgttagtaccggtccgtcgttccgttaccg

SEQ ID NO: 233065 - DNA, 238 bp, Homo sapiens
  misc_feature: GYAE6OF01ENHRB.48.73.G07.1.454.CMB.1.raw
  modified_base (217)..(238): a, c, t, g, unknown or other
  misc_feature (217)..(238): n is a, c, g, or t
tcagagtatacatacacgaccggtgctcgatttagctctacgctcagggcacgaccggtgctcgatttagctctacgctcagggcacgaccggtgctcgattagctcgatatagttggttggaccaaggtggaagtcaaacgactgtgctgcacatctgtcttcatcttcccgcatctgatatgtatactcgtgagcgggctggcaaggcgcatagnnnnnnnnnnnnnnnnnnnnnn

SEQ ID NO: 233066 - DNA, 717 bp, Homo sapiens
  misc_feature: GYAE6OF01EB2JV.48.73.G07.1.454.CMB.1.raw
tcagagtatacatacacgaccggtgctcgatttagctctacgctcagggggctttctgagagtcatggatctcatgtgcaagaaaatgaagcacctgtggttcttcctcctgctggtggcgctcccagatgggtcctgtcccagctgcagctgcaggagtcggcccaggactggtgaagccttcggacgacccctgtcccctcacctgcacttgtctcgtggtcgcctccatcagcagctagtacttactcgtgggctggactccgcctacgaccccgagggacgggtctgggaggtggagttgggacgttactttaccgacgtaggtacgggacgactaacccttacgtaaccctaaccccgtccctaacgtaaacgtcgaacgtacccactactaacgtccgtaacgtaaccgaccgtaaccaaacggtaaacctaactttcccgtacccgaagtaacgtcgtacgacgtccttacgtcggtaccgtacccgacccgacgtacgaacccgtacggtccttacgtttaactacgtttacgtcggttacggaccggtacccgggtaccccgaggtcccggacgttacgggttcgtttacgtttttacggacgtttaccgttaccggtttaggtaacgttacgggttcggggtaacccggggaaccggttaaacgggtacgtaacggttcccggtaccttacccggttctttacccgg

SEQ ID NO: 233067 - DNA, 827 bp, Homo sapiens
  misc_feature: GYAE6OF01BB89N.48.73.G07.1.454.CMB.1.raw
  modified_base (741)..(741): a, c, t, g, unknown or other
  misc_feature (741)..(741): n is a, c, g, or t
tcagagtatacatacacgaccggtgctcgatttagctctacgctcagggggctttctgagagtcatggatctcatgtgcaagaaaatgaagcacctgtggttcttcctcctgctggtggcgctcccagatggtcctgtcccagctgcagctgcgaggacggtccgggacccaggtacgtgggtagaacgtccgttacgggacgtaccccttcgtcccctcgacctgcctacgttgttcctcgttggtcggcctaccatccagaccagtcctaacgttacctttaccgttcggtaggggcctggaccgtcccggcccgtacccggacccccgggaaggggtacggggtcgacggggtaggtagggtacgttacggggtaacgttacgtttaccgacggtaacgggttacgggacgtacccgtaacccgttaaacctacccgttaaaccccccggtacccgtaaaccgtaaaacggtaccggaaccgggtaccctaaaccgtacgttaaacccgtacccggtaaacggtacccgtaaacccgtaaacccgtaaaacgtaaccccgttaactttaccccgttaccccgtaaggtaaccggtcgttacggaccgttcgtaccgtaggtcccggaacccggacccgacgaccggtaccggtaccgtcgttaccgtttactaacgtttcgcggtacggccggaaccggccccggtcggaccgcggttacggtcggtttcggtttacncggttacgttcgtttacgtagtcgggttacgggccggtaacggaaccggtacgtacgtaccgggttcctaacccgttcgttacccg

SEQ ID NO: 233068 - DNA, 799 bp, Homo sapiens
  misc_feature: GYAE6OF01C0LM2.48.73.G07.1.454.CMB.1.raw
  modified_base (669)..(669): a, c, t, g, unknown or other
  misc_feature (669)..(669): n is a, c, g, or t
  modified_base (787)..(787): a, c, t, g, unknown or other
  misc_feature (787)..(787): n is a, c, g, or t
tcagagtatacatacacgaccggtgctcgatttagctctacgctcagggggctttctgagagtcatggatctcatgtgcaaagaaatgaagcacctgtggtttcttcctcctgctggtggcgctccagatggtcctgtcccagctgcagctgcaggcgtcggccaggtctggtacgaacgtccgttacggacgtacccttcggtcccctcacctcgtactaccgttggtccgttcggttcgggtccgtccttactagccgaaggcctaacggtacttaacggtttaacctttaccggtttcggggtaccggggtaccgttaccgggtaacccgttcccggaacccggaaccccgggtaaccccggggaaggggggtaccggggtacgtacgggggtaaggtttacggtacgggtttaaggggttaacctttaaccgtttaccggaaaccgggttggggtaacccggtaacgtaccccgttaaccctaaaccgttaaccccccggtaacccgttaacctaacggtaaaacggtccgtaacggaccctaacgtacgttaaccgacccgttaagacccgtaaacgtaaccgaaacgttaaccttacgtttccgaccgtaagtcgtacgttcggactacgtccgttacgcgaccccgagtaaccgacggtacncgttctagtttcttaaccgtgcggtcgggacccgtcgacgtcgtcgtactggttacgttccttaggccttagttcgtagtagtcgggtaggacgacaagggtaccttagtcgtaaccngttcttaacccg

SEQ ID NO: 233069 - DNA, 668 bp, Homo sapiens
  misc_feature: GYAE6OF01B0YPL.48.73.G07.1.454.CMB.1.raw
  modified_base (267)..(267): a, c, t, g, unknown or other
  misc_feature (267)..(267): n is a, c, g, or t
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcagggaggtccgggcccaggactgggtagaacgccgttcgggactacccgtgtcccctcacctgccactcgtctcgtggtcgcctccatcagcagctagttacttacgttcgnggctggactccgccacggcccgagggacggtctggagtggtagttgggtagttacttacgacgtaggtggacacgtacctaacgtaccgaacccgtaccgtaacgaaacgtcgacgtacacgtatacgtacgtacgacctacgtaccgaaacgaacctagtcctaccgagtacgtcgtagacgtcgtacgtcggacgaccgtacgacgtacgaccgtacggtcgtattaccgtagtttacgcggtacgccggaccggtcccggagtaccggtacgtaggttcgttcgttttacgacgtttcggttaccgtttaggtacgttacgggtcggggtaccgggtaaccggtaaagggttaccttaaacggttccgggtaaccctttccccggggtctttaccccg

SEQ ID NO: 233070 - DNA, 877 bp, Homo sapiens
  misc_feature: GYAE6OF01CP4T7.48.73.G07.1.454.CMB.1.raw
tcagagtatacatacacgaccggtgctcgatttagctctacgctcagggggctttctgagagtcatggatctcatgtgcaaagaaaatgaacgcacctgtgttcttcctcctgctggtggcgctcccagctcggtcctgtcccagctgcagctgcgaggacggtccgggacccgaggaccgtgggtacgaacgtccgttacgggacgtacccgtcgtccctccgacctcgctactcgttctcgtggtcgcctccgatacgagtacagtactacgttaaccttacgttccggtgggtccgtaggtacccgtcccgccggtaaccccggacccccggtaagggggtacgggtcggtaggggtaggttagggttacggtttaccggggtaccgtttaacctttaaccggaacggttacgggtagggtacccgaacccgttacccggttaacctaaccccgtaaaccccgttcccgtaaacgtaaacgtaccggacgtaccgaacctacgttaacgtaccgacgtaaccaaccgtaaccgaaacgtaaacctaccgtttccgtaccgtaaggtaaccgtcgtcggtaaccgttcgttacccggtacggtaaccgggcccccggtaacgacccggtaaccggtaacgtaccggttaacgttccgttttaactttaaccgttttacgggttccgaaccgggtacccggtaaccccggttcgaacggttcccggttaggtttaccggttttgtttaaccgttacggttcgtttacggttacgtaaacgggtttcgtaaccgggggttaaccggtaaaccggaaagggttaaccgtagggttaacccgttaccccgggtacttttcccgggtacttaaccccccg

SEQ ID NO: 233071 - DNA, 812 bp, Homo sapiens
  misc_feature: GYAE6OF01C9UW8.48.73.G07.1.454.CMB.1.raw
  modified_base (278)..(278): a, c, t, g, unknown or other
  misc_feature (278)..(278): n is a, c, g, or t
tcagagtatacatacacgaccggtgctcgatttagctctacgctcgaggggggtctttctgagagtcagtggatctcatgtgacaaagaaaagtgaacgcaccttggttcggtttccttcccgttcctgcgttgggtcggccggcctccgaggtcgtcgggtcctcgtaccaggtcgtagacgagtcgtcggaccggaaggggccggtccgggaccctagggtacgttcgggacggtaacgtccgtacgggaccctccgttctcccgtctacgcgacncgttcgtcgtcgtcgtagcctcataccgagtcaagtcgttacgttacttggtcggaggtctacgcgtccgccgaccggacggtagggacggtcgtagggtacggttcggtaggttacggtaacgttacacccggtaggtacgggacggtacctaaccggtaaccccttaacccgaacccgtaacccggtaataaaccggtaacggaccgtaaacgtacgacccttaacgtaaccggtaccggtaactaaccgtaaccggtaaaactaacccggttaaacctacgttccctacgggttaacaccgtacgtacgtaccgttacgttcggaccggtaccgtacggacccgtacgacgtccgttacgttcgtaacttaccggtattcggtaacgccggaccgacgtcgacggaaccgttcgtaggtttcgtttaactcggttacgttcgttacggttactgggttaccgggtagggtaacccgggaacgttaacggtacgttaaccggtccgggtaacctttcggttaccctaccggg

SEQ ID NO: 233072 - DNA, 714 bp, Homo sapiens
  misc_feature: GYAE6OF01D5HUA.48.73.G07.1.454.CMB.1.raw
  modified_base (344)..(344): a, c, t, g, unknown or other
  misc_feature (344)..(344): n is a, c, g, or t
  modified_base (621)..(621): a, c, t, g, unknown or other
  misc_feature (621)..(621): n is a, c, g, or t
tcagagtatacatacacgaccggtgctcgatttagctctacgctcagggggctttctgagagtcatggatctcatgtgcaagaaaatgaagcacctgtggttcttccctcctgctggtgggcggctcccagagtgggtcctgtcccagctgcagctgcaggaggtccgggcccaggactggtagaagcccttacgggacgtacccctgtcccctcgaacctgcctacgtgtctcgtggtcgcctcatcaggcagctacgtacgttacgttcgtggggactcgactccgcgaccggaccccggagggagggcgtaggagtagggtagttgggtaatacttaaccngtaacggtgggacacgacctacctaaccgtaacccgtaccgtaacgaaaccggtgaccgaccacctataccgtaccgtaacgtaccacccggttaaccaaacgtaacccgtaacgtttccctacccgtagaaccgtacggtagacgttacgtccgtacggtacggtccccgacccgaacgtacggtaacccgcggtcgttcgttacttacgtttacgtcgttcgggacggtccccgggacccgtacggccggcgtacggtttcggttagttttacgngttccgttacggtttacgttagggttacgtccggggtagggtacccgggaaaagtccggtaaacgttccgggtacgtccccggttattccccg

SEQ ID NO: 233073 - DNA, 793 bp, Homo sapiens
  misc_feature: GYAE6OF01A6JUE.48.73.G07.1.454.CMB.1.raw
tcagagtatacatacacgaccggtgctcgatttagctctacgctcagggggctttctgagagtcatggatctcatgtgcaagaaaatgaagcacctgtggttcttcctcctgctggtggcgctccagatcgggtcctcgtcccagctgcagtctgcgaggacgtcgggcccgagggactggtagaacgtccgttcggaacgtcccgtgtccctcaccgtgccacgtgtctcgtggtcgcctcgatcacgcagcgtacgttacttacgttcggtcgggtctcggtaccgtccgaccgaccggaccccgggaaggggaacggggtcgtacggggtacggttggttaacgggttacggggtaacgtttacgtttaaccggacggttaggggtacgggacgtaccgtaacccgtaaccgtaacccgtaaccccgtaccgtaacgaaaacggtcggaacggacctaactacgtaaccgtaccgtaaacgaccgtaaccgtaaccgtaaacaaaccttaccgttccctaccgtagaacgtacgtacgtacgtacctacgtacggtaccgacccgtccggtacacggtacccgcgttaccttacgttacttaaacggttcctagggtaccgaccgggtacccgggtacccgtaacgggtccgttaccggtaacgggtttcggttttcctttaacggccttttacggttaccgtttaggtaacggtttacgggtaccggggtacgggaaccgggtaaacggtaacgttcgtaacgggtccccgttaggttccgttacccgg

SEQ ID NO: 233074 - DNA, 282 bp, Homo sapiens
  misc_feature: GYAE6OF02ID0G0.48.73.G07.1.454.CMB.1.raw
  modified_base (281)..(282): a, c, t, g, unknown or other
  misc_feature (281)..(282): n is a, c, g, or t
tcagagtatacatacacgaccggtgctcgatttagctctacgctcagggcacgaccggtgctcgatttagatcgtctgtgttgggtttgggggtgtggtggtctccactcccgccttgacgaggctgattactactgtcagtcttttgataacaacaatcacgtggtcttcggcggagggaccagcctgaccgtcctaggtcagcccaaggctgccccctcggtcactctgttccccgcctcctctatgtatactctgagcgggctggcaaggcgcatagnn

SEQ ID NO: 233075 - DNA, 128 bp, Homo sapiens
  misc_feature: GYAE6OF02GUAXR.48.73.G07.1.454.CMB.1.raw
  modified_base (128)..(128): a, c, t, g, unknown or other
  misc_feature (128)..(128): n is a, c, g, or t
tcagagtatacatacacgaccggtgctcgatttagctctacgctcagggcacgaccggtgctcgatttagagctcacgtattgggtttggggttttaggtatctgagcgggctggcaaggcgcatagn

SEQ ID NO: 233076 - DNA, 300 bp, Homo sapiens
  misc_feature: GYAE6OF02HKXXD.48.73.G07.1.454.CMB.1.raw
  modified_base (283)..(300): a, c, t, g, unknown or other
  misc_feature (283)..(300): n is a, c, g, or t
tcagagtatacatacacgaccggtgctcgatttagctctacgctcagggtcgacgaccggtgctcgatttagatcgtctgtgttgggtttcgggggtgtggtggtcttccactcccgccttgacgaggcctgattactactgtcagtcttttgataacaacaatcacgtggtcttcggcggagggaccagcctgaccgtcctaggtcagcccaaggctgcccctggtcactctgttcccacctcctctatgtatactctgagcgggctggcaaggcgcatagnnnnnnnnnnnnnnnnnn

SEQ ID NO: 233077 - DNA, 224 bp, Homo sapiens
  misc_feature: GYAE6OF02HTYNY.48.73.G07.1.454.CMB.1.raw
  modified_base (200)..(224): a, c, t, g, unknown or other
  misc_feature (200)..(224): n is a, c, g, or t
tcagagtatacatacacgaccggtgctcgatttagctctacgctcgagggcgacgaccggtgctcgatttagctctacgctcagggcacgaccggtgcgtcgatttagtcaacgtcgagaaagggaaggggctggccctgacgtgtttctgttcccaccctctctatgtatactctgagcgggctggcaaggcgcatagnnnnnnnnnnnnnnnnnnnnnnnnn

SEQ ID NO: 233078 - DNA, 162 bp, Homo sapiens
  misc_feature: GYAE6OF02I8LVC.48.73.G07.1.454.CMB.1.raw
  modified_base (161)..(162): a, c, t, g, unknown or other
  misc_feature (161)..(162): n is a, c, g, or t
tcagagtatacatacacgaccggtgctcgatttagctctacgctcagggcacgaccggtgctcgatttagtcacgcgagaaagggaaaggggctggccctgacgtgttctgttcccgccctcctctatgtatactctgagcgggctggcaaggcgcatagnn

SEQ ID NO: 233079 - DNA, 281 bp, Homo sapiens
  misc_feature: GYAE6OF02IJ9UN.48.73.G07.1.454.CMB.1.raw
  modified_base (280)..(281): a, c, t, g, unknown or other
  misc_feature (280)..(281): n is a, c, g, or t
tcagagtatacatacacgaccggtgctcgatttagctctacgctcagggcacgaccggtgctcgatttagatcgtctgtgttgggtttgggggtgtggtggtctccactcccgccttgacgaggctgattactactgtcagtcttttgataacaacaatcacgtggtcttcggcggagggaccagcctgaccgtcctaggtcagcccaaggctgccccctcggtcactctgttcccgcctcctctatgtatactctgagcgggctggcaaggcgcatagnn

SEQ ID NO: 233080 - DNA, 130 bp, Homo sapiens
  misc_feature: GYAE6OF02GA9XX.48.73.G07.1.454.CMB.1.raw
  modified_base (130)..(130): a, c, t, g, unknown or other
  misc_feature (130)..(130): n is a, c, g, or t
tcagagtatacatacacgaccggtgctcgatttagctctacgctcagggcacgaccggtgctcgatttatagctcacgtattgggtttgggggtttttaggtatctgagcgggctggcaaggcgcatagn

SEQ ID NO: 233081 - DNA, 157 bp, Homo sapiens
  misc_feature: GYAE6OF02IHT8A.48.73.G07.1.454.CMB.1.raw
  modified_base (156)..(157): a, c, t, g, unknown or other
  misc_feature (156)..(157): n is a, c, g, or t
tcagagtatacatacacgaccggtgctcgatttagctctacgctcaggggtgctcgatttagctctacgctcagggcacgaccggtgctcgatttagagctcacgtattgggtttggggtttttaggtatctgagcgggctggcaaggcgcatagnn

SEQ ID NO: 233082 - DNA, 194 bp, Homo sapiens
  misc_feature: GYAE6OF02GLRIN.48.73.G07.1.454.CMB.1.raw
  modified_base (190)..(194): a, c, t, g, unknown or other
  misc_feature (190)..(194): n is a, c, g, or t
tcagagtatacatacacgaccggtgctcgatttagctctacgctcgagggcacgaccggtgctcgatttagcacacgatagttgggtttgggaccaaggtggaagtcaaacgaactgtggctgcaccatctgtcttcatcttcccgccatctgatatgtatactctgagcgggctggcaaggcgcatagnnnnn

SEQ ID NO: 233083 - DNA, 280 bp, Homo sapiens
  misc_feature: GYAE6OF02HI829.48.73.G07.1.454.CMB.1.raw
tcagagtatacatacacgaccggtgctcgatttagctctacgctcagggcacgaccggtgctcgatttagatcgtctgtgttgggtttgggggtgtggtggtctccactcccgccttgacgaggctgattactactgtcagtcttttgataacaacaatcacgtggtcttcggcggagggaccagcctgaccgtcctaggtcagcccaaggctgccccctcggtcactctgttcccgccctcctctatgtatactctgagcgggctggcaaggcgcatag

SEQ ID NO: 233084 - DNA, 190 bp, Homo sapiens; identical to SEQ ID NO: 232922
  misc_feature: GYAE6OF02G97LY.48.73.G07.1.454.CMB.1.raw
  modified_base (189)..(190): a, c, t, g, unknown or other
  misc_feature (189)..(190): n is a, c, g, or t

SEQ ID NO: 233085 - DNA, 309 bp, Homo sapiens
  misc_feature: GYAE6OF02G4Q6D.48.73.G07.1.454.CMB.1.raw
  modified_base (283)..(287): a, c, t, g, unknown or other
  misc_feature (283)..(287): n is a, c, g, or t
  modified_base (289)..(309): a, c, t, g, unknown or other
  misc_feature (289)..(309): n is a, c, g, or t
tcagagtatacatacacgaccggtgctcgatttagctctacgctcagggcggacgaccggtgctcgatttagatcgtctgtgttgggtttgggggtgtggtggtctccactcccgccttgacgaggctgattactactgtcagtcttttgataacaacaatcacgtggtcttcggcggagggaccagcctgaccgtcctaggtcagcccaaggctgccccctggtcactctgttcccaccctcctctatgtatactctgagcgggctggcaaggtcgcatagnnnnnannnnnnnnnnnnnnnnnnnnn

SEQ ID NO: 233086 - DNA, 130 bp, Homo sapiens; identical to SEQ ID NO: 232941
  misc_feature: GYAE6OF02FO99O.48.73.G07.1.454.CMB.1.raw
  modified_base (130)..(130): a, c, t, g, unknown or other
  misc_feature (130)..(130): n is a, c, g, or t

SEQ ID NO: 233087 - DNA, 321 bp, Homo sapiens
  misc_feature: GYAE6OF02GFOSM.48.73.G07.1.454.CMB.1.raw
  modified_base (320)..(321): a, c, t, g, unknown or other
  misc_feature (320)..(321): n is a, c, g, or t
tcagagtatacatacacgaccggtgctcgatttagctctacgctcagggcacgaccggtgctcgatttagtgtgagtagttccgcgggcacgaccggtgctcgatttagagagagtgtgttgggtttgggggtgtggtggtctccactcccgccttgacgaggctgattactactgtcagtcttttgataacaacaatcacgtggtcttcggcggagggaccagcctgaccgtcctaggtcagcccaaggctgccccctggtcactctgttccccgccctcctctatgtatactctgagcgggctggcaaggcgcatagnn

SEQ ID NO: 233088 - DNA, 257 bp, Homo sapiens
  misc_feature: GYAE6OF02FT2QL.48.73.G07.1.454.CMB.1.raw
  modified_base (256)..(257): a, c, t, g, unknown or other
  misc_feature (256)..(257): n is a, c, g, or t
tcagagtatacatacacgaccggtgctcgatttagctctacgctcagggcacgaccggtgctcgatttagtagcatactgttgggtttggggccaagggacaacggtcaccgtctcttcagcctccaccaagggcccatcggtcttccccctggcgccctgctccaggagcacctccgagagcacagcggccctgggctgcctggtcaaggactacttcctatgtatactctgagcgggctggcaaggcgcatagnn

SEQ ID NO: 233089 - DNA, 191 bp, Homo sapiens; identical to SEQ ID NO: 232966
  misc_feature: GYAE6OF02G1URV.48.73.G07.1.454.CMB.1.raw
  modified_base (189)..(191): a, c, t, g, unknown or other
  misc_feature (189)..(191): n is a, c, g, or t

SEQ ID NO: 233090 - DNA, 501 bp, Homo sapiens
  misc_feature: GYAE6OF02HY852.48.73.G07.1.454.CMB.1.raw
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtactacttctggggctggatccgccagccccccagggaagggctggagtggattggggagtatttaccacagtgggagcacctactacaacccgtcctcaaaagtcgaggcaccatatccgtagacacgtccaaagaaccaattctccctgaagctgagctctgtgaccgccgcagacacggctgtctattactgtgcgacggcccgagcgcagtgcttttgatgcttgatatgtgggccagggacaagtggtctaccgtctcg

SEQ ID NO: 233091 - DNA, 256 bp, Homo sapiens
  misc_feature: GYAE6OF02I7TO6.48.73.G07.1.454.CMB.1.raw
  modified_base (255)..(256): a, c, t, g, unknown or other
  misc_feature (255)..(256): n is a, c, g, or t
tcagagtatacatacacgaccggtgctcgatttagctctacgctcagggcacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcgcatagnn

SEQ ID NO: 233092 - DNA, 443 bp, Homo sapiens
  misc_feature: GYAE6OF02IIVID.48.73.G07.1.454.CMB.1.raw
  modified_base (413)..(413): a, c, t, g, unknown or other
  misc_feature (413)..(413): n is a, c, g, or t
  modified_base (438)..(443): a, c, t, g, unknown or other
  misc_feature (438)..(443): n is a, c, g, or t
tcagagtatacatacacgaccggtgctcgatttagctctacgctcagggcacgaccggtgctcgatttagtacacacacttagggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgcctttgatatgtggggccaagggacaatggtcaccgtctcttcagcctccaccaagggcccatcggtcttccccctggcaccctcctccaagagcacctctgggggcacagcggccctgggctgcctggtcaggactacttcctatgtatactntgagcgggctggcaaggcgcatagnnnnnn

SEQ ID NO: 233093 - DNA, 257 bp, Homo sapiens
  misc_feature: GYAE6OF02F6ZBO.48.73.G07.1.454.CMB.1.raw
  modified_base (255)..(257): a, c, t, g, unknown or other
  misc_feature (255)..(257): n is a, c, g, or t
tcagagtatacatacacgaccggtgctcgatttagctctacgctcagggcacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctctctcgactctgagcgggctggcaaggcgcatagnnn

SEQ ID NO: 233094 - DNA, 511 bp, Homo sapiens
  misc_feature: GYAE6OF02IZVB5.48.73.G07.1.454.CMB.1.raw
  modified_base (396)..(396): a, c, t, g, unknown or other
  misc_feature (396)..(396): n is a, c, g, or t
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaagggctggagtggattgggagtatttaccacagtgggagcacctactaccaaccgtccctcaaaagtcgaggcaccatatccgtagacacgtccaagaaccaattctccctgaacgctganctctgtgaccgccgcagaccacggctgtctattactgtcgcgacggccccgagccgcagtgtcttttgatgtcctttgatagtggtggccaagggacaagtggtcaccgtctccg

SEQ ID NO: 233095 - DNA, 257 bp, Homo sapiens; identical to SEQ ID NO: 233088
  misc_feature: GYAE6OF02FG12T.48.73.G07.1.454.CMB.1.raw
  modified_base (256)..(257): a, c, t, g, unknown or other
  misc_feature (256)..(257): n is a, c, g, or t

SEQ ID NO: 233096 - DNA, 284 bp, Homo sapiens
  misc_feature: GYAE6OF02GRM7I.48.73.G07.1.454.CMB.1.raw
  modified_base (281)..(284): a, c, t, g, unknown or other
  misc_feature (281)..(284): n is a, c, g, or t
tcagagtatacatacacgaccggtgctcgatttagctctacgctcagggcacgaccggtgctcgatttagagagagtgtgttgggtttgggggtgtggtggtctccactcccgccttgacgaggctgattactactgtcagtcttttgataacaacaatcacgtggtcttcggcggagggaccagcctgaccgtcctaggtcagcccaaggctgccccctcggtcactctgttcccgccctcctctatgtatactctgagcgggctggcaaggcgcatagnnnn

SEQ ID NO: 233097 - DNA, 285 bp, Homo sapiens
  misc_feature: GYAE6OF02JXBTC.48.73.G07.1.454.CMB.1.raw
  modified_base (278)..(285): a, c, t, g, unknown or other
  misc_feature (278)..(285): n is a, c, g, or t
tcagagtatacatacacgaccggtgctcgatttagctctacgctcagggcacgaccggtgctcgatttagatcgtctgtgttgggtttgggggtgtggtggtctccactcccgccttgacgaggctgattactactgtcagtctttgataacaacaatcacgtggtcttcggcggagggaccagcctgaccgtcctaggtcagcccaaggctgccccctggtcactctgttcccaccctcctcatgtatactctgagcgggctggcaaggcgcatagnnnnnnnn

SEQ ID NO: 233098 - DNA, 282 bp, Homo sapiens
  misc_feature: GYAE6OF02GTG2M.48.73.G07.1.454.CMB.1.raw
  modified_base (281)..(282): a, c, t, g, unknown or other
  misc_feature (281)..(282): n is a, c, g, or t
tcagagtatacatacacgaccggtgctcgatttagctctacgctcagggcacgaccggtgctcgatttagatcgtctgtgttgggtttgggggtgtggtggtctccactcccgccttgacgaggctgattactactgtcagtcttttgataacaacaatcacgtggtcttcggcggagggaccagcctgaccgtcctaggtcagcccaaggctgccccctcggtcactatgttcccaccctcctctatgtatactctgagcgggctggcaaggcgcatagnn

SEQ ID NO: 233099 - DNA, 164 bp, Homo sapiens
  misc_feature: GYAE6OF02I541T.48.73.G07.1.454.CMB.1.raw
  modified_base (162)..(164): a, c, t, g, unknown or other
  misc_feature (162)..(164): n is a, c, g, or t
tcagagtatacatacacgaccggtgctcgatttagctctacgctcagggcacgaccggtgctcgatttagtcacgcgagaaagggaaaggggctggccctgacgtgtttctgttcccaccctcctctatgtatactctgagcgggctggcaaggcgcatagnnn

SEQ ID NO: 233100 - DNA, 527 bp, Homo sapiens
  misc_feature: GYAE6OF02JL0CM.48.73.G07.1.454.CMB.1.raw
  modified_base (387)..(387): a, c, t, g, unknown or other
  misc_feature (387)..(387): n is a, c, g, or t
  modified_base (396)..(396): a, c, t, g, unknown or other
  misc_feature (396)..(396): n is a, c, g, or t
  modified_base (459)..(459): a, c, t, g, unknown or other
  misc_feature (459)..(459): n is a, c, g, or t
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccagggactggtgaagccttcggagaccctgtccctcacctgcactgtctctggtgctccatcagcagcagtacttacttctggggctggatccgccagcccccagggaagggctgggagtggacttgggagttatttaccacgagtgggagcacctactacaccgtccctacaaagtccgaggcaccatactccgtagacacgtccaagaaccaattccncctagaacnctgatctctgtcgaccgcgctagaccacggctgtactattactgtcgcgacggccccgagccncgagtcggcttttgacttgtcctttagattatggtacggcgaagggcaagttcggacaccgttctacg

SEQ ID NO: 233101 - DNA, 550 bp, Homo sapiens
  misc_feature: GYAE6OF02HHANG.48.73.G07.1.454.CMB.1.raw
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttcgtggggctggactccgccacgcccccgagggaacggggctggagtggagttgggagttatttaccacgaggtgggagcacctactacacccgtcctacaaagtcgagccacatactccgtagacacgtaccaaacgaacctaattcctaccctagaacgcctgacgtcctcgtcgtcgacccgccgacacgacacggctcgttctattacgtgtcgcgacggcccgagccgcgagtcgtcttttgattcgtccgtttgatagtggtacgggaccgaagggactaaggtcggtcaccgttctccg

SEQ ID NO: 233102 - DNA, 502 bp, Homo sapiens
  misc_feature: GYAE6OF02F17V7.48.73.G07.1.454.CMB.1.raw
  modified_base (498)..(498): a, c, t, g, unknown or other
  misc_feature (498)..(498): n is a, c, g, or t
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctgggagtggattgggagtatttaccacagtgggagcacctactacaaccgtccctcaaagtcgagcaccatatccgtagacacgtccaagaccaattctcctagaagctgagctctgtgaccgccgcagacacggctgtctattactgtgcgaggccccgagcgcagtcgcttttgattgcctttgattgtgtgggcaagggcaagtggtcaccgtntccg

SEQ ID NO: 233103 - DNA, 325 bp, Homo sapiens
  misc_feature: GYAE6OF02H8UR7.48.73.G07.1.454.CMB.1.raw
  modified_base (321)..(325): a, c, t, g, unknown or other
  misc_feature (321)..(325): n is a, c, g, or t
tcagagtatacatacacgaccggtgctcgatttagctctacgctcagggcacgaccggtgctcgatttagtgtgagtagttccgcgggcacgaccggtgctcgatttagagagagtgtgttgggtttgggggtgtggtggtctccactcccaccttgacgaggctgattactactgtcagtcttttgataacaacaatcacgtggtcttcggcggagggaccagcctgaccgtcctaggtcagcccaaggctgccccctcggtcactctcgttcccgccctcctctatgtatactctgagcgggctggcaaggcgcatagnnnnn

SEQ ID NO: 233104 - DNA, 224 bp, Homo sapiens
  misc_feature: GYAE6OF02HRD7Z.48.73.G07.1.454.CMB.1.raw
  modified_base (222)..(224): a, c, t, g, unknown or other
  misc_feature (222)..(224): n is a, c, g, or t
tcagagtatacatacacgaccggtgctcgatttagctctacgctcagggcacgaccggtgctcgatttagctctacgctcagggcacgaccggtgctcgatttacgctcgatatagttgggtttgggaccaaggtggaagtcaaacgactgtggctgcacatctgtcttcatcttcccgcatctgatatgtatactctgagcgggctggcaaggcgcatagnnn

SEQ ID NO: 233105 - DNA, 226 bp, Homo sapiens
  misc_feature: GYAE6OF02IO4DL.48.73.G07.1.454.CMB.1.raw
  modified_base (224)..(226): a, c, t, g, unknown or other
  misc_feature (224)..(226): n is a, c, g, or t
tcagagtatacatacacgaccggtgctcgatttagctctacgctcagggcacgaccggtgctcgatttagctctacgctcagggcacgaccggtgctcgatttagctcgatatagttgggtttgggaccaaggtggaagtcaaacgaactgtggctgcaccatctgtcttcatcttcccgccatctgatatgtatactctgagcgggctggcaaggcgcatagnnn

SEQ ID NO: 233106 - DNA, 518 bp, Homo sapiens
  misc_feature: GYAE6OF02GZXHH.48.73.G07.1.454.CMB.1.raw
  modified_base (396)..(396): a, c, t, g, unknown or other
  misc_feature (396)..(396): n is a, c, g, or t
  modified_base (416)..(416): a, c, t, g, unknown or other
  misc_feature (416)..(416): n is a, c, g, or t
tcagagtatacatacacgaccggtgctcgatttagctctacgctcagggcacgaccggtgctcgatttagtcacgcgagaaagggaaagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctgggctggatccgccagccccagggagggctggagtggagttgggagtatttaccacagtggagcactactacaacccgtcctacaaagtcgagcacatatccgtanacacgtcaagaaccattccncctagacgctgagctcgtcgtcgaccgccgacagaccgacggctgtactacttactggtgcggacggcccgagccgcgtaggtcggtcttttgagttgtccg

SEQ ID NO: 233107 - DNA, 552 bp, Homo sapiens
  misc_feature: GYAE6OF02FVPPM.48.73.G07.1.454.CMB.1.raw
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttctggggctggatccgccacgcccccgagggaagggctgggagtggagttgggagttatttaccacgaggtgggacgaccacctactaccaacccgtccctacaaacgtcgaggccaccatactccgtagacacgtaccaaacgaaccaattcctccctagaacgtctagacgtcctctgtcgacccgccgacacgaccacggctcgtctattacgtgtcgcgacgcccgagcgcagtgtcttttgattgccgtttgattagtggtcgggaccgtaagggactaagttcggtcctaccggtcttaccg

SEQ ID NO: 233108 - DNA, 718 bp, Homo sapiens
  misc_feature: GYAE6OF02JXVHN.48.73.G07.1.454.CMB.1.raw
tcagagtatacatacacgaccggtgctcgatttagctctacgctcagggggcgtttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtcgctccatcagcagcagtacttactcgtggggctggactccgccacgccccccgaggggaacgggctgggagtggagttgggagttagtttaccgacgtaggtcgggagccgaacctacgtaaccgaaccccgtccctacaaaacggtcgaacggaccaccatacgtccgtagaccacgtaccaacgaaacctacttacctacccgtagaacgtctacgaacgtccttcgtacggtacgacccggtaccgacgaacgaccgacggtcctacggttacctaagtttaccgtggttacggacccggtaaccgggtcccccggacggaccggtaccgtacggttacgggttacccgttttttaggaccgtttacggttacccgttttagggtaacgtttacggttacggggttaccggggggtaaccccgttaaaggggggtaacccttaaacgggttccgggggtttaacccgtaccccgggtttaccgtttaccccgg

SEQ ID NO: 233109 - DNA, 163 bp, Homo sapiens
  misc_feature: GYAE6OF02IQPD2.48.73.G07.1.454.CMB.1.raw
  modified_base (162)..(163): a, c, t, g, unknown or other
  misc_feature (162)..(163): n is a, c, g, or t
tcagagtatacatacacgaccggtgctcgatttagctctacgctcagggcacgaccggtgctcgatttagtcacgcgagaaagggaagggggctggccctgacgtgtttctgttcccaccctcctctatgtatactctgagcgggctggcaaggcgcatagnn

SEQ ID NO: 233110 - DNA, 284 bp, Homo sapiens
  misc_feature: GYAE6OF02HDDPT.48.73.G07.1.454.CMB.1.raw
  modified_base (282)..(284): a, c, t, g, unknown or other
  misc_feature (282)..(284): n is a, c, g, or t
tcagagtatacatacacgaccggtgctcgatttagctctacgctcagggcacgaccggtgctcgatttagatcgtctgtgttgggtttggggggtgtggtggtctccactcccgccttgacgaggctgattactactgtcagtcttttgataacaacaatcacgtggtcttcggcggagggaccagcctgaccgtcctaggtcagcccaaggctgccccctcggtcactctgttcccgccctcctctatgtatactctgagcgggctggcaaggcgcatagnnn

SEQ ID NO: 233111 - DNA, 542 bp, Homo sapiens
  misc_feature: GYAE6OF02G69XP.48.73.G07.1.454.CMB.1.raw
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttactctgggctggatccgccacgcccccagggaagggctggagtggagttgggagttatttaccacgagtggacgcacctactacaacccgtcctacaaaagtcgaggcacatactcgtagacacgtacaacgaaccaattcctccctagaacgctagacgctctgtcgaccgccgcacgaccacggctgtctattactgtcgcgacggcccgagcgcgagtcggtctttttgacgttgtcccgtttgacttagtcggtacgggaccgtaagggactaagttcggtacctaccgtcttaccg

SEQ ID NO: 233112 - DNA, 586 bp, Homo sapiens
  misc_feature: GYAE6OF02IEURF.48.73.G07.1.454.CMB.1.raw
  modified_base (246)..(246): a, c, t, g, unknown or other
  misc_feature (246)..(246): n is a, c, g, or t
  modified_base (376)..(376): a, c, t, g, unknown or other
  misc_feature (376)..(376): n is a, c, g, or t
tcagagtatacatacacgaccggtgctcgatttagctctacgctcagggcacgaccggtgctcgatttagtcacgcgagaaagggaaagggggctttctgagagtcatggatctcatgtgcaagaaaatgaagcacctgtggttcttcctcctgctggtgcggctcccagatgggtcctgtcccagctgcagctgcaggagtcgggcccaggactggtagagtccttggacgacccctgtcccctnacctgccactgtctcgtggtggctccatcagcagctagttacttacttcgtgggctggactccgccacgcccccgaaggggacgggcgtggagtggtagttgggagttatttaccgacgtagtacggganaccacctaactacctaacccgtacctacgaaacgtcgacgcaaccataacgtccgtagacgaccgtaccaaacgtaacctaactttcctaccctagaacgtctgaacgcttcgtagtcgaccgccgacacgacgacggctcgtactacttcgtggtcgcggaccggcccgtaggccgtacgacggttcggttcttttgacgttgttaccg

SEQ ID NO: 233113 - DNA, 130 bp, Homo sapiens; identical to SEQ ID NO: 232941
  misc_feature: GYAE6OF02F6FX8.48.73.G07.1.454.CMB.1.raw
  modified_base (130)..(130): a, c, t, g, unknown or other
  misc_feature (130)..(130): n is a, c, g, or t

SEQ ID NO: 233114 - DNA, 549 bp, Homo sapiens
  misc_feature: GYAE6OF02GVT34.48.73.G07.1.454.CMB.1.raw
  modified_base (466)..(466): a, c, t, g, unknown or other
  misc_feature (466)..(466): n is a, c, g, or t
tcagagtatacatacacgaccggtgctcgatttagctctacgctcagggggctttctgagagtcatggatctcatgtgcaagaaaaatgaagcacctgtggttcttcctcctgctggtggcggctcccagatgggtcctgtcccagctgcagctgcaggagtcggggcccaggactggtgaagccttcggagaccctgtccctcacctgcactgtctctggtggctccatcagcagcagtacttacttctggggctggatccgccacgccccccgaggggaacggggctgggagtggagttggggagttatttaccacgaggtgggagcacctactaccaacccgtcctacaaagtcgaggcaccatactccgtagacacgtaccaagaaccaacttcctccctagaacgctgacgctctcgtcgaccgccgcacgacacggctgtctattactgtgcgcgcccgngcgcagtcgtcttttgacttgtccgtttgagttagtggtcgggaccgaaggggtactaaggttcggtctaccggttcttaccg

SEQ ID NO: 233115 - DNA, 262 bp, Homo sapiens
  misc_feature: GYAE6OF02JCHXD.48.73.G07.1.454.CMB.1.raw
  modified_base (254)..(262): a, c, t, g, unknown or other
  misc_feature (254)..(262): n is a, c, g, or t
tcagagtatacatacacgaccggtgctcgatttagctctacgctcagggcacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggctacttcctctctcgactctgagcgggctggcaaggcgcatagnnnnnnnnn

SEQ ID NO: 233116 - DNA, 549 bp, Homo sapiens
  misc_feature: GYAE6OF02ICTPS.48.73.G07.1.454.CMB.1.raw
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagcctttcggagaccctgtccctcacctgcactgtctctggtgctccatcagcagcagtacttacttcgtgggctggatccgccacgcccccgagggaacggggctgggagtgggtagttggggagttatttaccacgaggtgggagcacctactacaacccgtcctacaaagtcgacggcaccatactacgtagacacgtccaaacgaacctaacttcctcctagaacgctagacgctctgtcgaccgccgacagacacggctgtctattacgtgtgcgacggcccgagcgcagtcgtcttttgattcgtcctttgattagtggtacggggaccaagggactaaggttcggtactacccggtcttaccg

SEQ ID NO: 233117 - DNA, 527 bp, Homo sapiens
  misc_feature: GYAE6OF02GGX4I.48.73.G07.1.454.CMB.1.raw
  modified_base (455)..(455): a, c, t, g, unknown or other
  misc_feature (455)..(455): n is a, c, g, or t
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttctggggctggatccgccagcccccagggaaggggctgggagtggattgggagtatttaccacgagtgggagcacctactacaacccgtcctcaaagtcgaggcacatactccgtagacacgtccaagaaccaattcctccctagaacgctagacgctctgtcgaccgccgacagacacgctgtctattactgtgcgacggcccgagcgcngtgtcttttgattgtccgtttgattagtggtcgggaccgaacgggactaacgtcggtacctaccggtctccg

SEQ ID NO: 233118 - DNA, 567 bp, Homo sapiens
  misc_feature: GYAE6OF02HONNT.48.73.G07.1.454.CMB.1.raw
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttctggggctggactccgccacgcccccgagggaacggggctggagtggagttgggagtatttaccacgagtgggacgctacctactacaaccccgtcctacgaaaagtcgaggcacatactccgtagacacgtaccaaagaaccaagttcctacctagaaacgctagaacgctctggtcgaaccgccgacagacacggctgtactattactcgtagcgacggccccgagccgacgagtcgttccgttttgacgttacgtccgtttgtacttagtcggtacggggaccaacgggtacaacgtcgggtacctaccggttctaccg

SEQ ID NO: 233119 - DNA, 282 bp, Homo sapiens; identical to SEQ ID NO: 232928
  misc_feature: GYAE6OF02FF561.48.73.G07.1.454.CMB.1.raw
  modified_base (281)..(282): a, c, t, g, unknown or other
  misc_feature (281)..(282): n is a, c, g, or t

SEQ ID NO: 233120 - DNA, 131 bp, Homo sapiens
  misc_feature: GYAE6OF02FR4BV.48.73.G07.1.454.CMB.1.raw
  modified_base (131)..(131): a, c, t, g, unknown or other
  misc_feature (131)..(131): n is a, c, g, or t
tcagagtatacatacacgaccggtgctcgatttagctctacgctcagggcacgaccggtgctcgatttagagctcacgtattgggtttgggggttttttaggtatctgagcgggctggcaaggcgcatagn

SEQ ID NO: 233121 - DNA, 745 bp, Homo sapiens
  misc_feature: GYAE6OF02JRMVV.48.73.G07.1.454.CMB.1.raw
tcagagtatacatacacgaccggtgctcgatttagctctacgctcaggggcgtttctgagagtcatggatctcatgtgcaagaaaatgaagcacctgtggttcttcctcctgctggtggcggctcccagatgggtcctgtcccagctgcagctgcaggagtcggcccaggctggtgaagccttcggagaccctgtccctcacctgcactgtctctggtcgactccatcagtcagcagtacttactgtgggctggactccgcctacgccccgagggacggctggacggtggagttgggagttacgtttaccacgtaggtagggagctaacctacgtaaccacccggttacccacgtaaacgtcggtacggaccaccgtaatacgtaccgtaacgacgtaaccgtaccgaaacgtaacccaactttcctacccgtaacgaacggtaccgtacggtacgtacgttaccgttacgggtaccgacccgggtacccgaccggaaaccggtacccgtacccggtacgttaccggtaccgttttaacgtttacccgtttacgggacccgttaacccggggaccccggtacggtaaaccggtccgttaaaccgggttcggtttaaccgttttttacgggtaaccgttcggttaacccgttttacggtaacgttaacggttcggggttaaccgggaaccgtaacggggtaacgttaacggtcggttacccgaccggtttccgtaccgttacccgg

SEQ ID NO: 233122 - DNA, 365 bp, Homo sapiens
  misc_feature: GYAE6OF02JQ3TZ.48.73.G07.1.454.CMB.1.raw
  modified_base (134)..(134): a, c, t, g, unknown or other
  misc_feature (134)..(134): n is a, c, g, or t
  modified_base (350)..(350): a, c, t, g, unknown or other
  misc_feature (350)..(350): n is a, c, g, or t
  modified_base (356)..(365): a, c, t, g, unknown or other
  misc_feature (356)..(365): n is a, c, g, or t
tcagagtatacatacacgaccggtgctcgatttagctctacgctcagggcacgaccggtgctcgatttagtgtgagtagttccgcgggcacgaccggtgctcgatttagagagagtgtgttgggtttgggggtntggtggtctccactcccgccttgacggaggtctgattactactgtcagttctttgataacaacaatcacgtgtctcggcggaggaccagtcctcgaccgtccgtaggtccacgcccgaaggtcctccgtcccccctcggtacaccttccgttcgttcccccgcccttccctacttagtgttaactcctctggacggccgggctggctaagggccanagtagnnnnnnnnnn

SEQ ID NO: 233123 - DNA, 559 bp, Homo sapiens
  misc_feature: GYAE6OF02H2GO6.48.73.G07.1.454.CMB.1.raw
tcagagtatacatacacgaccggtgctcgatttagctctacgctcagggggcttttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagacccctgtccctcacctgcactgtctctggtggctccatcagcagcagtacttacttctggggctggatccgccacgcccccgagggaacggggctgggagtggagttggggagttatttaccgacgaggtgggagcaccgtactaaccaaccccgtcctacaaaacgtcgagacaccaatactaccgtagacacgtaccaaacgaacctaatttcctaccctagaacgctagacgctctgtcgacccgcgacacgaccacggctgtctattactgtgcgacgcccgagcgcaggtgtcttttgacttcgtccgtttgattagtggttcgggaccgaagggtacaagtcggtctaccggttcttaccg

SEQ ID NO: 233124 - DNA, 581 bp, Homo sapiens
  misc_feature: GYAE6OF02HRX12.48.73.G07.1.454.CMB.1.raw
  modified_base (498)..(498): a, c, t, g, unknown or other
  misc_feature (498)..(498): n is a, c, g, or t
tcagagtatacatacacgaccggtgctcgatttagctctacgctcagggggctttctgagagtcatggatctcatgtgcaagaaaatgaagcacctgtggttcttcctcctgctggtggtggctcccagatgggtcctgtcccagctgcagctgcaggagtcgggcccaggactggtgaagccttcggagacccctgtccctcacctgcactgtctctggtggctccatcagcagcagtacttacttcgtggggctggactccgccacgccccgagggaacgggctggaggtggagttgggagttactttaccacgaggtgggacgccacctactaaccaaccccgtccctacgaaaacgtcgaacgcacatacaccgtagacctacgtaccaaacgaacctaacttcctaccctagaacgcgttagacgtctcgtacggtcgaccgccgacacgaccgacggctgtcttacttacgtgtcgcgacggcccgagccgngacgtcggttcttttagcttcggtacctttgacgttagtggtacgggaccgtaagggactaagtcggtactaccgtcttaccg

SEQ ID NO: 233125 - DNA, 282 bp, Homo sapiens
  misc_feature: GYAE6OF02GHEN7.48.73.G07.1.454.CMB.1.raw
  modified_base (282)..(282): a, c, t, g, unknown or other
  misc_feature (282)..(282): n is a, c, g, or t
tcagagtatacatacacgaccggtgctcgatttagctctacgctcagggcacgaccggtgctcgatttagatcgtctgtgttgggtttggagggtgtggtggtctccactcccgccttgacgaggctgattactactgtcagtcttttgataacaacaatcacgtggtcttcggcggagggaccagcctgaccgtcctaggtcagcccaaggctgccccctcggtcactctgttccccgccctcctctatgtatactctgagcggctggcaaggcgcatagn

SEQ ID NO: 233126 - DNA, 286 bp, Homo sapiens
  misc_feature: GYAE6OF02F6L3V.48.73.G07.1.454.CMB.1.raw
  modified_base (280)..(286): a, c, t, g, unknown or other
  misc_feature (280)..(286): n is a, c, g, or t
tcagagtatacatacacgaccggtgctcgatttagctctacgctcagggcacgaccggtgctcgatttagatcgtctgtgttgggtttgggggtgtggtggtctccactcccgccttgacgaggctgattactactgtcagtctttgataacaacaatcacgtggtcttcggcggagggaccagccctgaccgtcctaggtcagcccaaggctgccccctggtcactctgttcccaccctcctctatgtatactctgagcgggctggcaaggcgcatagnnnnnnn

SEQ ID NO: 233127 - DNA, 292 bp, Homo sapiens
  misc_feature: GYAE6OF02FRELW.48.73.G07.1.454.CMB.1.raw
  modified_base (280)..(280): a, c, t, g, unknown or other
  misc_feature (280)..(280): n is a, c, g, or t
  modified_base (287)..(292): a, c, t, g, unknown or other
  misc_feature (287)..(292): n is a, c, g, or t
tcagagtatacatacacgaccggtgctcgatttagctctacgctcagggcacgaccggtgctcgatttagatcgtctgtgttgggtttggggggtgtggtggtctccactcccgccttgacgaggctgattactactgtcagtcttttgataacaacaatcacgtggtcttcggcggagggaccagcctgaccgtcctaggtcagcccaaggctgccccctcggtcactctcgtcccaccctcctctatgtatactctgacggcggctggacaagggccncaatagnnnnnn

SEQ ID NO: 233128 - DNA, 560 bp, Homo sapiens
  misc_feature: GYAE6OF02IZ529.48.73.G07.1.454.CMB.1.raw
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccgagggaacgggctggagtggagttgggagtatttaccacgagtgggagcacctactacaacccgtcctacaaagtcgagcaccatactccgtagaccacgtaccaaagaaccaacttcctaccctagaacgctagacgtctctagtacgacccgccgacacgacaccggctcgtctattacgtgtcgcgacggccccgagccgcgacgtggtctttttgagttcgtccgtttgacgttagtggttcgggaccgtaacgggactaagtcggtacctacccggttcttaccg

SEQ ID NO: 233129 - DNA, 281 bp, Homo sapiens
  misc_feature: GYAE6OF02I1N3N.48.73.G07.1.454.CMB.1.raw
tcagagtatacatacacgaccggtgctcgatttagctctacgctcagggcacgaccggtgctcgatttagatcgtctgtgttgggtttggggggtgtggtggtctccactcccgccttgacgaggctgattactactgtcagtcttttgataacaacaatcacgtggtcttcggcggagggaccagcctgaccgtcctaggtcagcccaaggctgccccctcggtcactctgttcccgccctcctctatgtatactctgagcgggctggcaaggcgcatag

SEQ ID NO: 233130 - DNA, 572 bp, Homo sapiens
  misc_feature: GYAE6OF02IXBDA.48.73.G07.1.454.CMB.1.raw
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttctgggctggatccgccagcccccgagggaacgggctggagtggattggggagtatttaccacagtgggacgcacctactaccaacccgtcctcaaaagtcgaggcaccatactccgtagacacgtaccaaagaaccctaattcctccctagaacgctagagctctcgtcgaccgccgcagaccgacggtctgtcctattactgtcgacgacggcccgagccgacgaggttaggtcctttttagacttggtacccgtttggtaacttagttgggtacggggtaccgtaaacgggaccgtaagtcgggtacctacccggttcttacccg

SEQ ID NO: 233131 - DNA, 539 bp, Homo sapiens
  misc_feature: GYAE6OF02ITTJW.48.73.G07.1.454.CMB.1.raw
  modified_base (159)..(159): a, c, t, g, unknown or other
  misc_feature (159)..(159): n is a, c, g, or t
  modified_base (347)..(347): a, c, t, g, unknown or other
  misc_feature (347)..(347): n is a, c, g, or t
  modified_base (369)..(369): a, c, t, g, unknown or other
  misc_feature (369)..(369): n is a, c, g, or t
  modified_base (374)..(374): a, c, t, g, unknown or other
  misc_feature (374)..(374): n is a, c, g, or t
  modified_base (409)..(409): a, c, t, g, unknown or other
  misc_feature (409)..(409): n is a, c, g, or t
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggngtcgggcccaggctggtgaagccttcggagaccctgtccctcacctgcactgtctctggtgctccatcagcagcagtacttactctgggctggatccgcagcccccagggaagggctggagtggattgggagtagtttaccacagtgggagcactactacaacccgtcctcaaaagtcgagcacatanctagacacgtcaagacaattcncctanagctgagctctgtcgaccgcgacacgacacggtcngtactacgttactgtgaccgaggccccgaaggcgccgagtcggtcgtttttgattgtccgttttagataacgttgtacgggggtacctaacggggtacgaacgtttgggtaccctaccggttacttcccg

SEQ ID NO: 233132 - DNA, 628 bp, Homo sapiens
  misc_feature: GYAE6OF02GDX3Y.48.73.G07.1.454.CMB.1.raw
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggacgaccctgtccctcacctgcactgtctctggtgctccatcagcagcagtacttacttgtgggctggactccgccacgcccccgaggggacggggctggagtggagttgggagttacttaccgagaggtgggagccacctacaccacccgtcctacaaagtcgagcacatactcgagacacgtaccaaagtaacctaattcctcccgtaagaacgtctacgacgtcttcgtacgtccgacccggccgtacaacgaccgtaccggcttacgtaccttacgttacgtcggtcgaccggtaccggaccccgtagccgtacgtaggttcggttccgttttagacgtttcggttaccgttttggaagtttacggttcgggtaccggggtaaccgtaaagggtaccgtaacggttcggttaccccgtaccgggtttccttacccgg

SEQ ID NO: 233133 - DNA, 543 bp, Homo sapiens
  misc_feature: GYAE6OF02IVDSF.48.73.G07.1.454.CMB.1.raw
  modified_base (459)..(459): a, c, t, g, unknown or other
  misc_feature (459)..(459): n is a, c, g, or t
  modified_base (527)..(527): a, c, t, g, unknown or other
  misc_feature (527)..(527): n is a, c, g, or t
  modified_base (534)..(534): a, c, t, g, unknown or other
  misc_feature (534)..(534): n is a, c, g, or t
  modified_base (539)..(539): a, c, t, g, unknown or other
  misc_feature (539)..(539): n is a, c, g, or t
tcagagtatacatacacgaccggtgctcgatttagctctacgctcagggggctttctgagagtcatggatctcatgtgcaagaaaaatgaagcacctgtggttcttcctcctgctggtggcggctcccagatgggtcctgtcccagctgcagctgcaggagtcgggcccaggactggtgaagccttcggagacccctgtcccctcacctgcactgtctctggtggctccatcagcagcagtacttacttctggggctggatccgcccagccccccgagggaaggggctggaggtggattggggagtatttaccgacaggtgggagcacctactaccaacccgtccctacaaaagtcgaaggccaccatactccgtaagaccacgtccaaagaacccaattcctccctagaacgctgagtcctcgtgtcgacccgccgcagaccacggctgtctattacngtcgcgacgcccgagccgacagtgtcttttgattgtcctttgattatggtgggaccgaagggctaagnggtaccnccgtntccg

SEQ ID NO: 233134 - DNA, 614 bp, Homo sapiens
  misc_feature: GYAE6OF02H568P.48.73.G07.1.454.CMB.1.raw
  modified_base (330)..(330): a, c, t, g, unknown or other
  misc_feature (330)..(330): n is a, c, g, or t
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttcgtgggctggactccgccacgcccccgaggggaacggggcgtgggaggtggagttgggagttactttaccgacgaggtgggacnctacctactaaccgaacccgtccacaaagtcgagcacatatcgagacacgtaccaaagaaccaattcctcctagaacgctagacgtctcgtgtacgaccgccgacagaccgacggctagtctacttacgtgtcgccgacggcccgagccgtcgacggttcggttcgtttttacggacgtttcggttacccgttttggtacgtttaggttcgggttacgggggtaacccgtaaacgggggtaaccttaaggttaccgggtacccttacccggtttaccttacccg

SEQ ID NO: 233135 - DNA, 326 bp, Homo sapiens
  misc_feature: GYAE6OF02JAMM1.48.73.G07.1.454.CMB.1.raw
  modified_base (323)..(326): a, c, t, g, unknown or other
  misc_feature (323)..(326): n is a, c, g, or t
tcagagtatacatacacgaccggtgctcgatttagctctacgctcagggcacgaccggtgctcgatttagtgtgagtagttccgcgggcacgaccggtgctcgatttagagagagtgtgttgggtttggggggtgtggtggtctccactcccgccttgacgaggctgattactactgtcagtcttttgataacaacaatcacgtggtcttcggcggagggaccagcctgaccgtcctaggtcagcccaaggctcgccccctcggtcactctgttccccaccctcctctatgtatactctgagcgggctggcaaggcgcatagnnnn

SEQ ID NO: 233136 - DNA, 599 bp, Homo sapiens
  misc_feature: GYAE6OF02HQZQX.48.73.G07.1.454.CMB.1.raw
tcagagtatacatacacgaccggtgctcgatttagctctacgctcagggggcgtttctgagagtcatcggatctcatgtgcaagaaaatgaagcacctgtggttcttcctcctgctggtggcgctcccagatgggtcctgtcccagctgcagctgcaggagtcgggcccaggactggtgaagccttcggagaccctgtccctcacctgcactgtctctggtgctccatcagcagcagttacttacttcgtgggctggactccgccacgcccccgaggggaacgggctggacgtggagttgggattactttaccagagtggacgcacctactaccaaccgtcctacaaagtcgagcacatactccgtagacacgtacaaacgtaaccaattccacctagaacgtctgagctcgtcgtcgaccgcgcacgaccacggtctgtctattacgtgtacgccgacggcccgagtcccgacgtacggttcggttctttttaggacgtttcggttacccgttttaggaacgtttacggtcgggttaccggggacccgaaaggggtacctaaaggttccgggttaacctacccggttcttaaccccgg

SEQ ID NO: 233137 - DNA, 262 bp, Homo sapiens
  misc_feature: GYAE6OF02I1XMS.48.73.G07.1.454.CMB.1.raw
  modified_base (256)..(262): a, c, t, g, unknown or other
  misc_feature (256)..(262): n is a, c, g, or t
tcagagtatacatacacgaccggtgctcgatttagctctacgctcagggcacgaccggtgctcgatttagtagcatactgttgggtttggggccaagggacaacggtcaccgtctcttcagcctccaccaagggcccatcggtcttccccctggcgccctgctccaggagcacctccgagagcacagcggccctgggctgcctggtcaaggactacttcctatgtatactctgagcgggctggcaaggcgcatagnnnnnnn

SEQ ID NO: 233138 - DNA, 532 bp, Homo sapiens
  misc_feature: GYAE6OF02F6R10.48.73.G07.1.454.CMB.1.raw
  modified_base (406)..(406): a, c, t, g, unknown or other
  misc_feature (406)..(406): n is a, c, g, or t
  modified_base (510)..(510): a, c, t, g, unknown or other
  misc_feature (510)..(510): n is a, c, g, or t
  modified_base (515)..(515): a, c, t, g, unknown or other
  misc_feature (515)..(515): n is a, c, g, or t
tcagagtatacatacacgaccggtgctcgatttagctctacgctcagggcacgaccggtgctcgatttagtcacgcgagaaagggaaagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagttacttacttcgtggggctggatccgccacgccccgagggagggctggagtggagttgggagtatttaccataggtgggacgcactactaccacccgtcctacaaagtcgagcaccatacgtccgtanacaccgtaccaaacgaacctaattccaccctagaacgtctagacgccttctgtcgaccgccgcagaccgacggtctgtacttattcgtgtcgcgaccggcccgngcgcnggtcgttctttgatgtc

SEQ ID NO: 233139 - DNA, 554 bp, Homo sapiens
  misc_feature: GYAE6OF02F9T1H.48.73.G07.1.454.CMB.1.raw
  modified_base (461)..(461): a, c, t, g, unknown or other
  misc_feature (461)..(461): n is a, c, g, or t
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggactccgccagccccccgagggaacggggctgggagtgggattggggagtagtttaccacaggtgggagcacctactacaacccgtccctacaaaagtcgaggccacatactccgtaagacacgtccaaagaaccaattctaccctagaagctgacgtcctctcggtcgaccgtccgacaacgaccacggctgtctattactgtcncgacgccccgagccgcgtagtcgtcttttgattgtcctttggattacgtggtcgggacctaaggggctaagttggtccaccggttcttacccg

SEQ ID NO: 233140 - DNA, 258 bp, Homo sapiens
  misc_feature: GYAE6OF02JJ855.48.73.G07.1.454.CMB.1.raw
  modified_base (252)..(258): a, c, t, g, unknown or other
  misc_feature (252)..(258): n is a, c, g, or t
tcagagtatacatacacgaccggtgctcgatttagctctacgctcagggcacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggctacttcctatgtatactctgagcgggctggcaggcgcatgnnnnnnn

SEQ ID NO: 233141 - DNA, 371 bp, Homo sapiens
  misc_feature: GYAE6OF02FFRF2.48.73.G07.1.454.CMB.1.raw
  modified_base (346)..(346): a, c, t, g, unknown or other
  misc_feature (346)..(346): n is a, c, g, or t
  modified_base (349)..(371): a, c, t, g, unknown or other
  misc_feature (349)..(371): n is a, c, g, or t
tcagagtatacatacacgaccggtgctcgatttagctctacgctcagggcacgaccggtgctcgatttagcgagacgcgcagggcacgaccggtgctcgatttagatcgtctgtggttgggttgggggtgtggtgtcctccactcccgcttgacgaggctgattactactgtctagttctttagaactaacaacaatcgacgtggtcctcggcggtacggaccagcctcgacccgtctacggtcacgcccaacggcctccgtcccccgtcggtcctaccgttccgttccggtcccctcctcctatacgtcgtactcgtcgtacggcggtcggcgtacgacgagcanagnnnnnnnnnnnnnnnnnnnnnnn

SEQ ID NO: 233142 - DNA, 280 bp, Homo sapiens
  misc_feature: GYAE6OF02I0448.48.73.G07.1.454.CMB.1.raw
tcagagtatacatacacgaccggtgctcgatttagctctacgctcagggcacgaccggtgctcgatttagatcgtctgtgttgggtttgggggtgtggtggtctccactcccgccttgacgaggctgattactactgtcagtcttttgataacaacaatcacgtggtcttcggcggagggaccagcctgaccgtcctaggtcagcccaaggctgccccctggtcactctgttccccaccctcctctatgtatactctgagcgggctggcaaggcgcatag

SEQ ID NO: 233143 - DNA, 843 bp, Homo sapiens
  misc_feature: GYAE6OF02IA8EE.48.73.G07.1.454.CMB.1.raw
tcagagtatacatacacgaccggtgctcgatttagctctacgctcagggcacgaccggtgctcgatttagtcacgcgagaaagggaaaggggctttctgagagtcatggatctcatgtgacaagaaaatgaagcaccgtgttcggttccttcctccgtgcgtgggtcggccggcctcccgagtagtcgggtcctcgtcccagctgcagctggacgacgggcggtccgggacccgaggtacgtggtacgaacgtccgttacggaccgtaccccgttcgtcccctacgtaccgtgtacctacgttccgttccgttcggttcgggtccggtacccttacccgaacgttaccgaacgtaccgtaacggtaccgttaacgtttacccgttttaccggttccgggttaccgggggtccgttaccggtacccgtcccccggaacccggtaaccccgggtacccccggggaagggggtaaccggggtacgttacggggacgggttacgggttaagggttacggtaacgttttaaccgtaacccgaggtaacggtacgggtaacctacccgtacccgtaaacctaacccgtaaccccgtaccgtaaagtaaccggtcgacgtacctaacctacgtacgtacccgtaagacccgtaaccgtaaccaaacgtaacctacgttcccgtaccgtaagaccgtgtacgcctcgttccgacgtacccgaccgtaccgacgtaccgaccgtacggtacctttcgtaaccttacgttacggtccggccggtacccggacccggtccccggtagtccggtacgtacggttcggttttacgtttacgtccgttcgtttacgg

SEQ ID NO: 233144 - DNA, 767 bp, Homo sapiens
  misc_feature: GYAE6OF02FYPG2.48.73.G07.1.454.CMB.1.raw
tcagagtatacatacacgaccggtgctcgatttagctctacgctcaggtgggtctttctgagagtcatggatctcatgtgcaaagaaaatgaagcacctgtggttcttcctcctgcgtggtggcggcctcccagagtcgggttcctcgtcccagctgcagctgcgaggacggtccgggcccaggacgtgggtagaacgtcccgttacgggacgaccctcgtcccctccaccgtcgccacgtgtctcgtgggtcggcctccatccgagcagcagttacttacttcgtgggctggactcccgccaccgacccccgaggggaacgggcgtgggagtggtagttgggagtttactttaccgacgtaggtgggacgcctaacctactaacccgaaccccgtccctaaacgaaacgtcggaacgaccaccaagttacgtaccgtaacgaacctaccgtaccgaaaacgtaaacctaacttccctacccgtaggaacgtcgtacggtacgtccgttacgttcggtacccgaccccggtccgtacgaaccgtaaccgacccgggtccttacggttacctttaaacgttaccgttgggttaccggaccggacccggggtacccccgaggtcccgaccggttagggttccggttttaccgtttttaggacgtttccggttcccgttttaggttaacgttacggttcgggttacccgggggtaaccgtaacggggtaaacctaaggtttcccggggtacccttaccccgggtttaccc

SEQ ID NO: 233145 - DNA, 638 bp, Homo sapiens
  misc_feature: GYAE6OF02HNRKT.48.73.G07.1.454.CMB.1.raw
  modified_base (159)..(159): a, c, t, g, unknown or other
  misc_feature (159)..(159): n is a, c, g, or t
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggngtcggcccaggactggtgaagccttcggagaccctgtccctcacctgcactgtctcgtggtgcctccatcagcagctacgttacttacttcgtggggctggactccgccacgcccccgagggacgggcgtggaggtggagttgggacttatttaccacgtaggtggagccaacctacctaaccgacccgtcctaacgaaacgtcgagccaactatactaccgtaagaccgtacgtaccaaacgaaccctaacttcctacccgtagaaacgtccgtagacgtcttacgtcgtaccggacccgccgaccgacggaacccgtacggtaccttcgtaccgtttaattcgtacggtacgccggaccggaccccgaggtccgtacgtaggttcgtttacgttttgacgttcgttcgtttgaacgttggtcggtaccgggacgtaacggggtactaagggttcggtaccgtacccgttcgttaccg

SEQ ID NO: 233146 - DNA, 585 bp, Homo sapiens
  misc_feature: GYAE6OF02JAJPV.48.73.G07.1.454.CMB.1.raw
  modified_base (427)..(427): a, c, t, g, unknown or other
  misc_feature (427)..(427): n is a, c, g, or t
  modified_base (479)..(479): a, c, t, g, unknown or other
  misc_feature (479)..(479): n is a, c, g, or t
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgcctccatcagcagcagtacttacttcgtgggctggactccgccacgcccccgagggacgggctggagtggagttgggagtactttacgacgaggtcgggagacacctactaccgaaccccgtcctacgaaagtccggaggaccaaccattactaccgtaacgaaccgtaccgtaccaaacgaaccctaacttcctaccctagaacnctggacgtcttcgtcgtcgacccgccacacgacgacgctgtactattacgtntcggacgccggcccgacgtcgcgtacggttcgttacgttttgacgttcgtcgtttgacttaggtggtacggacgtaacggactagtcggtcgtacccgttgttacc

SEQ ID NO: 233147 - DNA, 132 bp, Homo sapiens
  misc_feature: GYAE6OF02IOH89.48.73.G07.1.454.CMB.1.raw
  modified_base (129)..(132): a, c, t, g, unknown or other
  misc_feature (129)..(132): n is a, c, g, or t
tcagagtatacatacacgaccggtgctcgatttagctctacgctcagggcacgaccggtgctcgatttagagctcacgtattgggtttgggggtttttagtatctgagcgggctggcaaggcgcatagnnnn

SEQ ID NO: 233148 - DNA, 162 bp, Homo sapiens
  misc_feature: GYAE6OF02HX85Y.48.73.G07.1.454.CMB.1.raw
  modified_base (162)..(162): a, c, t, g, unknown or other
  misc_feature (162)..(162): n is a, c, g, or t
tcagagtatacatacacgaccggtgctcgatttagctctacgctcagggcacgaccggtgctcgatttagtcacgcgagaaagggaaagggggctggccctgacgtgttctgttcccgccttcctctatgtatactctgagcgggctggcaaggcgcatagn

SEQ ID NO: 233149 - DNA, 190 bp, Homo sapiens; identical to SEQ ID NO: 232922
  misc_feature: GYAE6OF02F65ON.48.73.G07.1.454.CMB.1.raw
  modified_base (189)..(190): a, c, t, g, unknown or other
  misc_feature (189)..(190): n is a, c, g, or t

SEQ ID NO: 233150 - DNA, 695 bp, Homo sapiens
  misc_feature: GYAE6OF02F2B8N.48.73.G07.1.454.CMB.1.raw
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccgttcggagaccctgtccctcacctgcactgtctctggtcgctccatcagcagcagttacttacttcgtgggctggactccgccacgccccgagggacgggcgtggagtggagttgggagttacgttaccgacgaggtcgggagccgaaccttacctaccaaccccggtaccctacgtaaaacgtcgaacgccgaacctataacgtacccggtaagaccgtaaccgtaaccaaacggtaaaccctaacgtttaccccgttacccgtaacggtaaacgtccgttacggtacgtccgttacgtacgggttaccgacccgcccgaaccgtacgaaccgtaccgggtccgttacgttaccttaacgtttaccgtcggttacggaccggaccggtacccccggaaggtcccgacgtacggttcgttacgtttttacgacgttcgtaccgttttagatttacggtggtaccgggaacgtaagggtacctaacggtcggtaccgtaccgttccttacccg

SEQ ID NO: 233151 - DNA, 543 bp, Homo sapiens
  misc_feature: GYAE6OF02FU4P7.48.73.G07.1.454.CMB.1.raw
  modified_base (441)..(441): a, c, t, g, unknown or other
  misc_feature (441)..(441): n is a, c, g, or t
  modified_base (539)..(539): a, c, t, g, unknown or other
  misc_feature (539)..(539): n is a, c, g, or t
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactgggtgaagccttcggacgaccctgtccctcacctgcactgtctcgtggtcgctcatcagcagcagttacttacttctggggctggatccgccacgcccccgaggggacggctgggagtggagttgggaagtatttaccgacgacgtgggacgcacctactaccgaacccgtccctacaaagtcgacggcacatatccgagacacgtaccaagaaccaattctaccctagaacgctagacgtctcgtcgtcgtacccgccgcacgacncggctgtctatctgcgcgacggcccgagcgctacggtgttcgttttcgattcgtctttgattcgtggtcgggacagggactaggtcggtctaccgttntccg

SEQ ID NO: 233152 - DNA, 651 bp, Homo sapiens
  misc_feature: GYAE6OF02JFYZB.48.73.G07.1.454.CMB.1.raw
  modified_base (397)..(397): a, c, t, g, unknown or other
  misc_feature (397)..(397): n is a, c, g, or t
tcagagtatacatacacgaccggtgctcgatttagctctacgctcaggggcgtttctgagagtcatggatctcatgtgcaagaaaatagaagcacctgtggttcttcctcctgctggtggcggctcccagatgggtcctgtcccagctgcagctgcaggagtcgggcccaggactggtgaagccgttcggagaccctgtccctcacctgcactgtctcgtggtgctccatcagcagcagtacttacttctggggctggatccgccacgcccccgagggaacgggctgggagtcggagttggggaagttacgtttaccaacgtaggtgggacgactacccgtactaaccgtaaccccgtccctaacaaaacggtcgaacggcaaccatagtcccgtanaaccacgaccaaacgacctaattcctaccctagacgacttcggaactacgtcgtaggtcgacccgtcccgacacgaccgacgcgtagtacctagttacgtgcgaccggtacgccccggagccgacgtaggtacggttcgtttttacgcgtttacggtcccgtttaaggtacttagggttaaccgggttccgggggaaccgttaacggggaccgtttaaacggtcgggttacctacccgggttactttaacccgg

SEQ ID NO: 233153 - DNA, 619 bp, Homo sapiens
  misc_feature: GYAE6OF02F25ZC.48.73.G07.1.454.CMB.1.raw
  modified_base (351)..(351): a, c, t, g, unknown or other
  misc_feature (351)..(351): n is a, c, g, or t
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtcgctccatcagcagcagttacttacttcgtgggctggactcccgccacggcccccgagggaagggctggagtggagttgggagttacttaccacgtaggtggacgctacctactaccaaccccgtccctanaaacgtcgacgaccaccatactccgtacgaacaccgtaccaaacgtaaccacttcctacctagaacgctacggacgtctcgtcgtcgacccggccgacgacggacctacgggtccttcgtacttacgttacgtcgtacggccggtaccggcccgaggccgtacgtacggttcggtttcttttcgacgttcgttaccgtttgtaagttcggtacgggtacgggaaccgtaagggtacctacggttccgggtacctaccgttccttaccg

SEQ ID NO: 233154 - DNA, 710 bp, Homo sapiens
  misc_feature: GYAE6OF02IUSG5.48.73.G07.1.454.CMB.1.raw
  modified_base (268)..(268): a, c, t, g, unknown or other
  misc_feature (268)..(268): n is a, c, g, or t
  modified_base (345)..(345): a, c, t, g, unknown or other
  misc_feature (345)..(345): n is a, c, g, or t
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggacgtcgggcccaggactggtagaagtccgttcggagaccctgtcccctcaccgtgaccacttggtcctcgtgggtacggcctccatcaggcaagcagtacttacttcggngggtctggactccgccacggccccgaggggacgggctgggagtcggtagtttgggacttacgttaccacggtacggngggacgcctaaccgtaacctaaccgtaacccgtacccgtagtaaaacggtccggaagcctaaaccgattaacgtccggtaacaaccgtaaccgtaccgaaaacgtaacccgtaattcccttaaccgtacgtaacgtccgttacggacgtcttaccgtcgttaccgacccggacgtcgtaacggtacctacggtaccttagttactacgttacgttcgggtaccgttaccggaaccggaccccggtagtcccggtacgtacggttacgttccgtttttacggacgttcggttaccgttgtaacgttacggtcggtaccgggtaaccgaaggttactaacggttcggtaccttaccgttccgttacg

SEQ ID NO: 233155 - DNA, 688 bp, Homo sapiens
  misc_feature: GYAE6OF02FVAQT.48.73.G07.1.454.CMB.1.raw
  modified_base (679)..(679): a, c, t, g, unknown or other
  misc_feature (679)..(679): n is a, c, g, or t
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggccaggactgggtgaagccttcggagacccttgtccctcacctgctactgtcctcgtggtcgcctaccatccagcagcagtacttacttcgtggggctggactccgccacgcccccggaggggaacgggctgggacggtggagttgggattactttaccgacgtaggtgggacgaccgtacctacgtaacccgtaaccccgtaccctaacgaaaacgtccgaacggaccaccgtaatacgtccgtaagaacctacgtaccaaacgtaaccctaattcctaccgtagaacgtctacgacgtacttcgtacggtccgacccgtccgtacaacggacctaccgggtaccttcgtaacctttattacgtcgtacggacccggacgggaccccgaggaccgtcgtaacggttggttacgttttttaggacgttccggttaccgttttaggaacggtttagtcgggttaccggggaacccgtaagggtaacgttacggttacccggtaccgttacccggtntttacccgg

SEQ ID NO: 233156 - DNA, 549 bp, Homo sapiens
  misc_feature: GYAE6OF02HDDP5.48.73.G07.1.454.CMB.1.raw
  modified_base (502)..(502): a, c, t, g, unknown or other
  misc_feature (502)..(502): n is a, c, g, or t
tcagagtatacatacacgaccggtgctcgatttagctctacgctcagggggctttctgagagtcatggatctcatgtgcaagaaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtaccttacttcgtggggctggactccgccacgcccccgaggggaagggctgggaggtggagttgggagttactttaaccacgaggtgggacgccaacctactaaccaacccgtccctacgaaaacgtcgaggccaccatactccgtagaccacgtaccaaagaaccaacttcctaccctgaacgctagacgctctgtcgaccgccgcacgacgacggctcgtctacttactgtcgcgacggcccgagcgctacggtgtcttttgnttcgtccgttgattgtggtggacgagggactagtcggtcacgtctcg

SEQ ID NO: 233157 - DNA, 685 bp, Homo sapiens
  misc_feature: GYAE6OF02HXF7T.48.73.G07.1.454.CMB.1.raw
  modified_base (334)..(334): a, c, t, g, unknown or other
  misc_feature (334)..(334): n is a, c, g, or t
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtccgggcccagggactggtgaagccgtttcgggacgaccctgtccctcaccctgccatgtctctggtggcctccatcagcagcagtacttacttcgtgggctggactccgacacgcccccgagggacgggctgggagtggtagttgggagttactttaccacgtaggtgggacncgtaacctacctaacaaccccgtcctaacgaaacgtcgacggaccaaccgtaagtaacgtaccggttaagaaccgtaaccgtaacccgaaaacgaacctaacgtttccctaccgtagaaacgtccgtagacgtcttacgtacgtacgacccggtcgacaacggaccgacggtcctacgttactaacttaccgtggtacgaccgggtacccggtaccccggagccggtccgtaaaggttcggttacctttttagacgttcgttacccgtttaggaccgtttaggtccgggtacgggtaaccgtaacgggtaacctaaggttaccggtaccctaccggttaccgttaacccgg

SEQ ID NO: 233158 - DNA, 746 bp, Homo sapiens
  misc_feature: GYAE6OF02G5YWV.48.73.G07.1.454.CMB.1.raw
tcagagtatacatacacgaccggtgctcgatttagctctacgctcagggggctttctgagagtcatggatctcatgtgcaagaaaatgaagcacctgtggttcttcctcctgctggtggcgctccagatgggtcctgtcccagctgcagctgcaggagtcgggcccaggactggtgaagccttcggagaccctgtccctcaccgtgcactgtctcgtggtgctccatcagcagctacgttacttacgtcgtcggggctaggactccgccacgacccccgaggggaacgggctgggacggtggtacgttagggtacgttacgtttaccgacgtaggtcgggacgtccgtaaccgtaacctaacccgaaccccgttacccgtaaccgtaaaaggtccggaacgggaccaaccgtaatacgtaccggtaagaaccctaaccgtaaccaaaacgtaaccctaacgtttacccgtacccgtacggaacgtccttaggaacgtccgttacgtacggtaccggtaacccccggtcccggtaacctaacggtaacccgtaaccggggtccctttaggttaccctttaaagtttaccgtcggttaccggaccggtaccgggccccgtacggcccgtacgtaacgggttcggttcgtttttacggacgttcggttaccgttttggaacgttacggttgggtaccgggtaccgtaacgggactaacggttacggttaccgtacccgttacgttaccg

SEQ ID NO: 233159 - DNA, 627 bp, Homo sapiens
  misc_feature: GYAE6OF02HGQ8D.48.73.G07.1.454.CMB.1.raw
  modified_base (255)..(255): a, c, t, g, unknown or other
  misc_feature (255)..(255): n is a, c, g, or t
tcagagtatacatacacgaccggtgctcgatttagctctacgctcagggggctttctgagagtcatggatctcatgtgcaagaaaatgaagcacctgtggttcttcctcctgctggtggcgctcccagatgggtcctgtcccagctgcagctgcaggacgtcggcccaggactggtgaacgtccttcggacgtaccctgtccctcacctgctactgtctcgtggtgcctccatcagcagctagtacttacttcgngggctggactccgcaccgcccgaagggaggcgtggagtggtagttgggaattacttaccagtggtaggactcgaacctactacctaacccgtcaacgaaacgcgagacacatactacgtacgacacgtacaaacgtaactacgtctaccaggtaactcgtagtctcctgtacggtccgaaccgtccgacgtaacgacgtaccgtgttacgtacttaacgttcgtaggtacgacccggtaccggcccgtaaggccgtacgtacggttcgttactttcggacttcgtccgtttaatacgttacggtggggtaacccgggtaacgaaccggggttactaacggttcccggttacctaccccggttacttacccgg

SEQ ID NO: 233160 - DNA, 612 bp, Homo sapiens
  misc_feature: GYAE6OF02IUM9U.48.73.G07.1.454.CMB.1.raw
  modified_base (296)..(296): a, c, t, g, unknown or other
  misc_feature (296)..(296): n is a, c, g, or t
  modified_base (317)..(317): a, c, t, g, unknown or other
  misc_feature (317)..(317): n is a, c, g, or t
  modified_base (324)..(324): a, c, t, g, unknown or other
  misc_feature (324)..(324): n is a, c, g, or t
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtccgggcccaggactgggtgaagtccgttcggagaccatcgtccctcacctgcactgtctcgtggtcgctccatcagcagctagttacttacttcgtgggctcggactccgccgacgccccgagggacgggctggngtggagtgggtatattacagnggtgganccactactaccacccgtacctaacgaaacgtcgaggaccaacatacgtacgtagacacgtaccaagaacctattacctccgtagaacgtctagactctcgtcgtcgaccgccgacgacgacgacggtctacgtacttagttacgtcggtcggaccggaccggtcccggacgtccgacgtacgggttgtttccgttttacgacgtttcggtccttttagagtttacgtacggggttaccggtaacggtaaacgggtacctaagggttccggtaccgtaccggtttaccg

SEQ ID NO: 233161 - DNA, 324 bp, Homo sapiens
  misc_feature: GYAE6OF02IWRQB.48.73.G07.1.454.CMB.1.raw
  modified_base (320)..(324): a, c, t, g, unknown or other
  misc_feature (320)..(324): n is a, c, g, or t
tcagagtatacatacacgaccggtgctcgatttagctctacgctcagggcacgaccggtgctcgatttagtgtgagtagttccgcgggcacgaccggtgctcgatttagatcgtctgtgttgggtttgggggtgtggtggtctccactcccgccttgacgaggctgattactactgtcagtcttttgataacaacaatcacgtggtcttcggcggagggaccagcctgaccgtcctaggtcagcccaaggctgccccctggtcactctgttccccgccctcctctatgtatactctgagcgggctggcaaggcgcatagnnnnn

SEQ ID NO: 233162 - DNA, 704 bp, Homo sapiens
  misc_feature: GYAE6OF02HCJY9.48.73.G07.1.454.CMB.1.raw
tcagagtatacatacacgaccggtgctcgatttagctctacgctcagggggctttctgagagtcatggatctcatgtgcaagaaaatgaagcacctgtggttcttcctcctgctggtggcgctcccagatgggtcctgtcccagctgcagctgcaggacgtccgggcccaggactggtagaacgtccgttcggacgaccccttgtcccctcacctgcctactgtctcgtggtcgcctccatcagcagctagttacttacttcgtgggctggactccgccaccggcccccggagggacgggtctgggaggtcggtaggttgggtagttacgtttaccgacgtagggtcgggacaccgtacctaacctacccgtaaccccggttaccctaacgtaaaaccggtccggaacggtacctaaccgtaagttaccgttaccggtaacgaaccgtaccgtaacccgaaacgtaacccttaacgtttacctacccgtagtaacgcgtacgacgtctcgtcggtaccgacccgccgacgaacgaccgtacgtcttacgtacttacgttacgtggtacggaccggaccggtcccgacgcgtcgtacggttcgtttactttcgtacgttcgttaccgtttggaacttcgggtcgggtacgggaaccgtaacgggtacctacggttaccggttacccgttaccgttccgttacccg

SEQ ID NO: 233163 - DNA, 633 bp, Homo sapiens
  misc_feature: GYAE6OF02H1CR0.48.73.G07.1.454.CMB.1.raw
  modified_base (327)..(327): a, c, t, g, unknown or other
  misc_feature (327)..(327): n is a, c, g, or t
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctcgtggtgcctccatcagcagctagtacttactcgtgggctggactccgccacgccccgagggaacgggctggaggtggtagttagggagttactttaccgacgaggtggacnctacctactaccaacccgtcctacgaaacgtcgacgacacatacgtaccgtacgacgacgtaccaaagaacctaactttacctacccgttagaacgtcgtacgacgtccttacgtacgtaccggacccgaccgacgaaccggaccgtacggtcttcgtacctttagttacgttcggacggtaccggtacccggcccggagcccgtacgtaggttcggttcttttcgagttcgttacgtttgtacgttacggtgggttacgggaccgtaacgggactaacggttcgggttacctaccggttcttacg

SEQ ID NO: 233164 - DNA, 661 bp, Homo sapiens
  misc_feature: GYAE6OF02HQYPI.48.73.G07.1.454.CMB.1.raw
tcagagtatacatacacgaccggtgctcgatttagctctacgctcagggggctttctgagagtcatggatctcatgtgcaagaaaaatgaagcacctgtggttcttcctcctgctggtggcggctcccagatgggtcctgtcccagctgcagctgcaggagtcgggcccaggtactggtgaagcctttcggacgacccctgtccctcacctgcacttgtcctcgtggtgcctcatcagcagcagttacttacgtcgtgggcttcggactccgcacgccccgagggagggctggacggtggtagttagggagttactttaaccgacgtaggtagggacgctaaccgttactaaccgaaccccgttcctaacgaaacgtcgaacggcaacctatacgaccgtagaaccacgtaccaaacgtaacctaacgttacctaccgtacgtaacgtcctaggtaaccgcttacgtcggtacgacccggcccgtacgacggtaccaacgggtccttacgttactttacttacgttcgtacgggacccggaccggcccggtagcccgtacggtacggttcggtttacgtttgacgttacgttccggttagtacggttaggtacgggtacgggaactaagggtactaaggttcggtaccgtccgtcttaccg

SEQ ID NO: 233165 - DNA, 901 bp, Homo sapiens
  misc_feature: GYAE6OF02HJ31K.48.73.G07.1.454.CMB.1.raw
tcagagtatacatacacgaccggtgctcgatttagctctacgctcagggggctttctgagagtcatggatctcatgtgcaaagaaaatgaagcacctgtggttcttcctcctgctggtggcgctccagagtgggtcctgtcccagctgcagctgcgagggacggtccgggcccagggtactgggtagaacgtccgttcgggacgtacccttcgtccctcacctgccacttcgtcttcgtggtcgcctccatcgacgcacgactaacgtttaccttacgttcggtcgggtactggaccgtccccgacccgacccggacccccgggaagggggtacggggtccgtaggggtacggttagggtaaggtttacggggttaacgtttaaccgtttaaccgacggtaagggttacgggtacgtaacccgtaaccgttaacccgtaacccgtaaccccggttacctaaacggtaaacggtaccggaacgaacctaaccgtagttaaccgtaccgtaacgtaacccgtaacccggtaaaccgtaaaccgtaaacccgtttaaccgttttacccgacccgtaaggtaaccgtaccgttaacggaccgttccgttacgtaccgggtaccgaacccggtacccgacgttaaccgacccggttacgttccgttaacgtttaccgtttaaacgtttccgggtacgggtacccgggtacccgggtacccggggccccggtaacggtcccggttaacgggtttacggtttccgggtttttacttttaacggacggttttaccggttttaccgtttaaggtaccgggtttgggttaacgggggtaccggggtaaacccgtaaggggtacccttaaacgggttcccgggtttaaccttacccggttccctttacccgg

SEQ ID NO: 233166 - DNA, 261 bp, Homo sapiens
  misc_feature: GYAE6OF02H1W6F.48.73.G07.1.454.CMB.1.raw
  modified_base (256)..(261): a, c, t, g, unknown or other
  misc_feature (256)..(261): n is a, c, g, or t
tcagagtatacatacacgaccggtgctcgatttagctctacgctcagggcacgaccggtgctcgatttagtagcatactgttgggtttggggccaagggacaacggtcaccgtctcttcagcctccaccaagggcccatcggtcttccccctggcgccctgctccaggagcacctccgagagcacagcggccctgggctgcctggtccaggactacttcctatgtatactctgagcgggctggcaaggcgcatagnnnnnn

SEQ ID NO: 233167 - DNA, 675 bp, Homo sapiens
  misc_feature: GYAE6OF02H1DJC.48.73.G07.1.454.CMB.1.raw
  modified_base (331)..(331): a, c, t, g, unknown or other
  misc_feature (331)..(331): n is a, c, g, or t
  modified_base (607)..(607): a, c, t, g, unknown or other
  misc_feature (607)..(607): n is a, c, g, or t
tcagagtatacatacacgaccggtgctcgatttagctctacgctcagggggctttctgagagtcatggatctcatgtgcaagaaaatgaagcacctgtggttcttcctcctcctggtgcacgttcccagatgggtcctgtctcaggtgcagttacagcaggtgggcgacgaggactgttgaagccttcggactaccctgtcctcacctgcgctggcgctggtagacttcctcagtcgtctatccaatcggacgtgactccgccacgcccccgagcggaaaggtccgtagggagtggtagttaggggaaacttcgaaatcgagtggaggtanacaacgaactacaccctccgccaaaggcgacgacaccgaactatacttaggtacggacgtcggaaacgaaagaacctaacgttcctccgaagtaaacgcgtacccgtagtccgtacggtacccgccggacggaaccacggtcgtacggttgtaacttcgtacgtcgtacggtaaccgaaggtaagtccgggggacgggttcggcttaaccgtacggtgttaaaccggttttcgggggactaacggggtaaaccgtcggtccaacccggttaccccncccgttaacgccgttaccccgaaccggttaaccggacccctacggttccccggttacttccccccggg

SEQ ID NO: 233168 - DNA, 727 bp, Homo sapiens
  misc_feature: GYAE6OF02HXROE.48.73.G07.1.454.CMB.1.raw
tcagagtatacatacacgaccggtgctcgatttagctctacgctcagggggctttctgagagtcatggatctcatgtgcaaagaaaatgaagcacctgtggttcttcctcctgctggtggcggctcccagatgggtcctgtcccagctgcagctgcaggagtccgggcccaggactgggtagaacgtccgttacggacgtacccctcgtcccctcaccctgactaccttcggtcctcgtggtcggcctccgatcagcagctagttacttacgttcgtggggctaggactcccgacccgtaccggcccccggaaggggtaacggggccgtaggggtacggttagggtaggttaggggtaagtttaacgtttaacccgaacggtagggtacgggtacgacctaacctaaccgtaacccgaaaccccgttacccgtaaacgtaaaaccggtcgaacggaccaaccgtaacgttacgtaaccggtaacgaacctaaccgtaaccgaaacgtaaaccctaactttcccgtaccgtaaggaacgtcgtacggacgtccttacgtcggtccgacccgcgacaacgaccgtacggtcttcgtacttacgtacgtggtacgccggaccggcccgaggtccgacgtaggttcggttacctttggtactcggttccttagacgttaggtcggtacggacgtaacggtacgtagttcccggtacgtacccgtcttaccg

SEQ ID NO: 233169 - DNA, 733 bp, Homo sapiens
  misc_feature: GYAE6OF02FS61O.48.73.G07.1.454.CMB.1.raw
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctcgtggtgctccatcagcagcagtacttacttcgtgggctggactccgccacgcccccgaggggaacgggctgggaggtggagttggggagttactttaccgaagtaggtggggacgtccgtaaccgtacctaaccgaaccccgttacccctaacgaaaacggttccggaacggaccaaccgtaagttacttacccggtaacggaacccgaccggttaacccaaacggtaaaccctaactttacccgtacccgtaaggaaacgtccgttaggacgttccttccgttacggtaccggaccccggtcccgacgaaccggaaccgtaccgggtacttacggttacctttaagtttaccgttcggtacggacccgggtaccgggacccccggagtacccggcgtacgggttcggttacgttttttacggacgttccggtccgttttaggaagtttacggtcggggttaccgggaccggtaagggtaccgtaaggttccgggtacccgtaccgttcttacccgg

SEQ ID NO: 233170 - DNA, 1029 bp, Homo sapiens
  misc_feature: GYAE6OF02IC67A.48.73.G07.1.454.CMB.1.raw
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgctactgtctctggtgctccatcagcagcagtacttacttcgtggggctggactcccgccgacgccccccgaggggaacggggctgggacggttgggagtttggggacgttagtttaaccgaacgtaggttaggggacgacctaacccgttaactaacccgtaaaccccggtacccgttaaccgaaaaacggttccggaaacgggtccgaaaccctacgtttaaacgtacccggtttaaacggaacccgtaacccggttaaccccgtaaaacggaaaaaccccttaaaaccgttttttaacccgttaacccccgttacgggtaaaaccggtacccgttaacggtaaaccggttccccgttttaccggttccgggtttaaaccgggtaccccccgggtaaccccgggtaaccccggaaaaccgggtaaacccgttacccgggggtacccgtttacgggttttaaaccgttttaaacccggtttttaaaccggttttcgggttacccggggttaccccgggttaaacccgggggaaccccccccgggtaaccggggttaccccgggtaaccggtaaacccggggtttttccgggggtttttaaccgggtttttttttttaaccgggaaccggttttttccgggttttaacccccggtttttttgggttaaacccggtttttaaaacgggtttcgggggggttttaacccgggggggtaaacccccggttaaaaaggggggggtaacccgttttaaaaacggggtttccccgggggtttttacccgttaaaccccccggggtttaccctttttttaacccccgggg

SEQ ID NO: 233171 - DNA, 401 bp, Homo sapiens
  misc_feature: GYAE6OF02I2S1Y.48.73.G07.1.454.CMB.1.raw
  modified_base (108)..(108): a, c, t, g, unknown or other
  misc_feature (108)..(108): n is a, c, g, or t
  modified_base (113)..(113): a, c, t, g, unknown or other
  misc_feature (113)..(113): n is a, c, g, or t
  modified_base (151)..(151): a, c, t, g, unknown or other
  misc_feature (151)..(151): n is a, c, g, or t
  modified_base (344)..(344): a, c, t, g, unknown or other
  misc_feature (344)..(344): n is a, c, g, or t
  modified_base (346)..(346): a, c, t, g, unknown or other
  misc_feature (346)..(346): n is a, c, g, or t
  modified_base (369)..(401): a, c, t, g, unknown or other
  misc_feature (369)..(401): n is a, c, g, or t
tcagagtatacatacacgaccggtgctcgatttagctctacgctcagggcacgaccggtgctcgatttagctctacgctcagggcacgaccggtgctcgatttagctntacgntcagggtcacgaccggtgctcgaatttacgctgtacgngtctaggggtcgaccgacgggttgacgtcgtaacgtttacgccgtaggtaccgtggacgtttaggggtttgggacctaagggttcgtaaggtacctaaaaccgggttcctcgggtacggtacgtcggacctaaccgtagttcttcggttcttacgagttcccgtacccgcgtaatcgtggatatagatctcgngngcggtctggacaggctacagtannnnnnnnnnnnnnnnnnnnnnnnnnnnnnnnn

SEQ ID NO: 233172 - DNA, 761 bp, Homo sapiens
  misc_feature: GYAE6OF02I9MSY.48.73.G07.1.454.CMB.1.raw
  modified_base (159)..(159): a, c, t, g, unknown or other
  misc_feature (159)..(159): n is a, c, g, or t
  modified_base (520)..(520): a, c, t, g, unknown or other
  misc_feature (520)..(520): n is a, c, g, or t
tcagagtatacatacacgaccggtgctcgatttagctctacgctcagggggctttctgagagtcatggatctcatgtgcaagaaatgaagcacctgtggttcttcctcctgctggtcggcgctccagatggtcctgtcccagctcgcagcctgcgaggnggtccgggcccaggacgtggagacgtccgttacggacgtaccctcgtccctctaccgtgacctacgtcgttcctcggtacggtcgtacctaccatccagcctagactacgttacttacgtcggtggtctcgacgtccgccgaccggaccccggtaaggggacgggtcgtagggagtacggtacgttacggtaacgttactttaccgacggttaggtacgggaacctaccgtaaccctacgtaacccgtaacccgtaccgtaaactaaacggttcggaaacgtcaacctaagttaccgtacgtaacaaccgtaccgaacgtaaaactaccgtactaccgtcccgaagtaacgtcgtaacgtntacgtcgtacgaccgtaccggaccacgtaaaccggtccaaccggttcttaccggtttaaacttacggttttaccgtccggaccgttaccccggaacccggtagccgttaacgttcgggttttaagtccgtttttacgccggtttacgttaccgtttagtacgggttaacgttcgggtaaaccggttaccgaaaggttccgttacggttacccgttaggaccccggtttatcccgggtaccc

SEQ ID NO: 233173 - DNA, 791 bp, Homo sapiens
  misc_feature: GYAE6OF02H2I2O.48.73.G07.1.454.CMB.1.raw
tcagagtatacatacacgaccggtgctcgatttagctctacgctcagggggctttctgagagtcatggatctcatgtgcaagaaaatgaagcacctgtggttcttcctcctgctggtggcggctcccagagtgggtcctgtcccagctgcagctgcaggcggtccgggcccaggactgggtagaacgtccgttcggaacgccctgtccctcacctgcactcgtcctcgtggtcggcctaccatcgagcagctagttaccttacgttcggtgggcgtcggactcccggcgaccggcccccggaaggggtacggcgtgggacgtaggtagttacggggtaattccgtttaaccgacggtacggggttacggactaaccgtaccctaaaccgtaacccgtaaccccgttacccgtaaacgtaaaacgggtccgaacggacctaacccgtaaagtacgttacccgtaacgaacccgttaaaccggtaacccgaaacgtaaaccctaacgtttccccgtaaccgttacgaaccgtcgtacggtacgtaccgttacgttcggaacccggacccgacccggaaccgtacgaacccgtacgggtaccttacggttctaaaccgttcggtcggtaccggtaccggaaccccgggtcccggacgtaccggtcgtacggtttacgggtttcttacgggactttccggttccgttagtaaccggttcgggtcgggttaacccggaaccgggtaacggtaccgtaacggttcccggtacccgttccccgtttaccgttccccgg

SEQ ID NO: 233174 - DNA, 953 bp, Homo sapiens
  misc_feature: GYAE6OF02HRWVQ.48.73.G07.1.454.CMB.1.raw
tcagagtatacatacacgaccggtgctcgatttagctctacgctcagggggctttctgagagtcatggatctcatgtgcaaagaaaatgaagcacctgtggttcttcctcctgctggtggcggctcccagatgggtcctgtcccagctgcagctgcaggagtccgggacccaggactggtgaacgtccttcggacgtacccctgtcccctccacctcgactacgtgttcctcgtggtcggcctccatcagccaagtctagttaccttacgtttcgtgggtcgtcggactccccggacccaccggaccccccggaggggaacgggggtcgtagggtaggttagggtaacggtttaggggtaacgtttaacttttaaccccgaacggtacgggttaggggaccgtaccgtaaaccccttaacccgtaaacccgtaaaccccccggttaccccgttaaaaccgtaaaaaccgggttaccggaaaccgggtacctaaaccccgtaagttaaacccggtaacccggttaaaccggtaaaccctaaacccggttaaccccgaaaaccggttaaaacccctaaacgttttaccccttaacccgttaaccggtaaacgtaccgttacgtaacccggttacgttaccgttcggttacccgggaaccccggtacccggaaccgtaaccggaaccccgtaacgggtaccgtttacggttaccttaaacgtttacccgttcggttaccgggtaccccggtaacccgggtacccccggaacggtcccggacggttaaccgggtttacggttttccggttttttaacggtacgtttccggtttacccggtttttaaggtaaccttggggtttaaccgggaccgggggttaaccggtaaacccgggggttaactaacccgggttaccgggggttaacccttacccggtttaccccgtttaaccccggg

SEQ ID NO: 233175 - DNA, 590 bp, Homo sapiens
  misc_feature: GYAE6OF02G5AFC.48.73.G07.1.454.CMB.1.raw
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttctggggctggatccgccacgcccccgagggaacggggctggaggtggagttgggagtatttaccgacgagtgggacgcacctactaccacccgtcctacaaacgtcgagcacatatccgtagacacgtaccaacgaaccaacgttcctacccgtagaacgctacgacgtcttcgtagttcgacccgccgacgaacgaccgacggtctcggttactacttacgtggtacgccggtaccggccccgaagccgacgtacggtggttcttttaggacttcggtcccttttggacttaggttgggtacggggtaccaaggggtacaaggttcggtactaccgttcttccg

SEQ ID NO: 233176 - DNA, 616 bp, Homo sapiens
  misc_feature: GYAE6OF02J0E6L.48.73.G07.1.454.CMB.1.raw
  modified_base (514)..(514): a, c, t, g, unknown or other
  misc_feature (514)..(514): n is a, c, g, or t
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggacaccctgtccctcacctgcactgtctcgtggtgctccatcagcagctagtacttacttcgtcgggctggactccgaccacgcccccggaaggggaacgggcgtagggaggtcggagttagggtacgttacgtttaccgagtagggtagggacgtaccgaacctactaaccgaaccccgttacccgtaacgtaaaacggtcgacggaccaccgtaatacgtaccgtacgaaccgtacgtacccaaacgtaacctaacgttcctacccgtagaacgcgtagacgtcttcgtacgtcgacccgcgacacgacgcgtctgtctattcgngtcgcgacggcccgagcgcgaggtcgtgtttcgagtcgtcgttgacttcggtaggtacggacggtaacggtacgtaagtccggttacgtacccgtgttaccg

SEQ ID NO: 233177 - DNA, 727 bp, Homo sapiens
  misc_feature: GYAE6OF02IIWS6.48.73.G07.1.454.CMB.1.raw
  modified_base (256)..(256): a, c, t, g, unknown or other
  misc_feature (256)..(256): n is a, c, g, or t
  modified_base (289)..(289): a, c, t, g, unknown or other
  misc_feature (289)..(289): n is a, c, g, or t
  modified_base (327)..(327): a, c, t, g, unknown or other
  misc_feature (327)..(327): n is a, c, g, or t
tcagagtatacatacacgaccggtgctcgatttagctctacgctcagggggctttctgagagtcatggatctcatgtgcaagaaaatgaagcacctgtggttcttcctcctgctggtggcgctcccagatgggtcctgtcccagctgcagctgcaggagtccgggcccaggactggtgaaggccttcgggacgacccctgtcccctcacctgcactgtcctctggtgcctccatcagcagctagtacttacttcgngggctggactccgcacgcccccgagggacgggntggagtggattgggagttactttaccgagtggtggacncacctactaccaacccgtcctacaaacgtcgaacggaccactaatacgtaccgtaagacctaacgtaccaaacgtaaaccctaacgttcctaccctaggtaacgtcgtacggtaacgtccttacgtcggtaccggacccggtacccgaccgtaacgacccgtacggtcttacgttaccttaacgtttacgttcgtaccggtaccggtacccgggaccccggtaggacccggtaccgtaacgggtttccgggtttacgttttttaccggagttttcccggtttaccgtttttggaacggtttacggttcgggggttaacccggggtaacccgggtaaaggggttaccgttaaacgggtttcccgggttacccggttacccccggtttccgtttaaccccgg

SEQ ID NO: 233178 - DNA, 733 bp, Homo sapiens
  misc_feature: GYAE6OF02I6HYD.48.73.G07.1.454.CMB.1.raw
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcggcccaggactggtgacgccttcggacgaccctgtccctcacctgctactgtctctggtgcctccatcagcagctacgttaccttacgttcgtggggtctggtactcccggccacgccccccggagggaacgggtcgtaggtacggtggagttagggacttacgtttaaccgagtaggttgggacgaccgtacccgttacgtaacccgtaacccgttaacccgtaactaaaacggtccgtaacggcctaaccgtaactacgtaccggtaacacgtaacccgtaccgtaaaacgtaaacccgtaactttccgaacccgttacgaacggtcctaacggtacgtaccttacgtcggttaccggtacccggcccgtacggaaacggcccgtaaccggcttaaccgttacgtactttaccgttaggtaccggtacccggcccggtacggtccggacgtacgggtttacgttcgttttagtacgttccgttacgttctaacggttcggttcgggtacggtaccggtaagggtcgtaaacggttccggtacccgttaaccggtccggttacttaccgg

SEQ ID NO: 233179 - DNA, 607 bp, Homo sapiens
  misc_feature: GYAE6OF02HQ8X3.48.73.G07.1.454.CMB.1.raw
  modified_base (250)..(250): a, c, t, g, unknown or other
  misc_feature (250)..(250): n is a, c, g, or t
  modified_base (304)..(304): a, c, t, g, unknown or other
  misc_feature (304)..(304): n is a, c, g, or t
  modified_base (311)..(311): a, c, t, g, unknown or other
  misc_feature (311)..(311): n is a, c, g, or t
  modified_base (353)..(353): a, c, t, g, unknown or other
  misc_feature (353)..(353): n is a, c, g, or t
  modified_base (388)..(388): a, c, t, g, unknown or other
  misc_feature (388)..(388): n is a, c, g, or t
  modified_base (394)..(394): a, c, t, g, unknown or other
  misc_feature (394)..(394): n is a, c, g, or t
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtccgggcccaggactgggtgaagccttcggagacccctgtccctcacctgcactgtctctggtgcctcatcagcagcagtacttacttcngggctgatccgcacgccccgagggagggctggagtgagtgggatattaccacgngtgggancacctactacacccctctacaaacgtcgagcacatactcganacgacaccaaagaacctaattcctcctagacgtcngagctntgtacgaccgtcgactaacgaccgaacggtctacgttactaacgttactcgggtacgtccgggaccggtaccccggacggtaccgtacggacggtttcgggttccttttttaggacgttccggttaccgttttagacttacggttgggttaccggggtaccgtaaacgggtaacgaaccggtttacgggacccttaccggtccgtttaacccg

SEQ ID NO: 233180 - DNA, 614 bp, Homo sapiens
  misc_feature: GYAE6OF02IK9CQ.48.73.G07.1.454.CMB.1.raw
  modified_base (218)..(218): a, c, t, g, unknown or other
  misc_feature (218)..(218): n is a, c, g, or t
tcagagtatacatacacgaccggtgctcgatttagctctacgctcagggggctttctgagagtcatggatctcatgtgcaaagaaaaatgaagcacctgtggttcttcctcctgctggtggcggctcccagatgggtcctgtcccagctgcagctgcaggagtcgggcccaggactggtgaagccttcggagaccctgtccctcacctgcactgtctntggtgctcatcagcagcagtacttacttcgtgggctggatccgccacgccccgagggacggggctggagtggagttgggagttactttaccacgaggtgggacgctaacctactacctaaccgtcctaacaaacgtcgaggacacatacgtaccgtagaaccacgtaccaaagtaaaccctaatttacctacccgtagaaacgtcttagactctcgtacgtcggacccgccgacaacgaccacggtcttacgtaccttagttaactggtacgccgaccggtccccgagtaccgcgtaggttacggttcttttagacgttcgtaccgttttgaacgttaggtcgggttacgggaacgtaagggtactaaaggttcggaccgttaccgtacgttaccg

SEQ ID NO: 233181 - DNA, 657 bp, Homo sapiens
  misc_feature: GYAE6OF02GE7Q5.48.73.G07.1.454.CMB.1.raw
tcagagtatacatacacgaccggtgctcgatttagctctacgctcagggggctttctgagagtcatggatctcatgtgcaagaaaatgaagcacctgtggttcttcctcctgctggtggcgctcccagatgggtcctgtcccagctgcagctgcaggagtcgggcccaggactggtgaagccttcggagaccctcgtccctcaccgtgcctactgtcctacgtggtcgctccagtcagcagctagtacttacttcgtgggctggactccgccacgccccgagggaagggcgtacggaggtggtagttgggacgttaacttaccgacgaggtcggacgaccgtaccgtacgtaaccaaccccgtccacgaaacgtcgacggtaccaccacttacgtaccgtacgaccgaccgtaccgaaacgtaaccctaattaccgtacccgtagacgtcgttagacgtcgtcgtcggtacgacccgccgtcgaaccgacgaccgtcgtagtaccttaacgtttacgcggtcgaccggtaccggccccggtagccgacgtacggttccgtttcgttttagacgttcgtaccgtttaggaacttcggttacgggtaacgggtaccgaagggtactaaaccggttcggtacgtacccgttcgtttaccg

SEQ ID NO: 233182 - DNA, 698 bp, Homo sapiens
  misc_feature: GYAE6OF02ICS5F.48.73.G07.1.454.CMB.1.raw
  modified_base (597)..(597): a, c, t, g, unknown or other
  misc_feature (597)..(597): n is a, c, g, or t
tcagagtatacatacacgaccggtgctcgatttagctctacgctcagggggctttctgagagtcatggatctcatgtgcaagaaatgaagcacctgtggttcttcctcctgctggtggcggctcccagatgggtcctgtcccagctgcagctgcaggacgtccgggcccaggactgggtgaacgtccgtttacggacgaccccttgtcccctctacctgccacgttcgttcctcgtggtcgcctcctatccgagccagctaacgttactttacgttcggtggggtcctcgggacctccggaccgaccccggacccggggaaggggacggcggtagggtggttaggttagggttacggtaagtttaccgttaccgaggtacgggtacggacgacccgttaacctaaacccgtaccgtaaccccgtaaccaaacgtaacgcgaacgaccactacgtactaccgacgaacctaccgtaacaaccgtaaacttcctacccgtatacggcgttacgagtcctcgtcgtagtcccgacgcgaactaccggcccgtaaggtcttacgtacgttacgttcggcggtacgcccgggacccggccgngttacctcgggttagtcgtttttacgtatcgttcgtttcgtaggtacgtgggtcgggtaaccgaggaacgtcggtaccgtccggtacctcgttcttaccgg

SEQ ID NO: 233183 - DNA, 198 bp, Homo sapiens
  misc_feature: GYAE6OF02FSHZH.48.73.G07.1.454.CMB.1.raw
  modified_base (190)..(198): a, c, t, g, unknown or other
  misc_feature (190)..(198): n is a, c, g, or t
tcagagtatacatacacgaccggtgctcgatttagctctacgctcagggcacgaccggtgctcgatttagcacacgatagttgggtttgggaccaaggtggaagtcaaacgaactgtggctgcaccatctgtcttcatcttcccgccatctgatatgtatactctgaggcgggctggcaaggcgcatagnnnnnnnnn

SEQ ID NO: 233184 - DNA, 764 bp, Homo sapiens
  misc_feature: GYAE6OF02HGKOB.48.73.G07.1.454.CMB.1.raw
  modified_base (214)..(214): a, c, t, g, unknown or other
  misc_feature (214)..(214): n is a, c, g, or t
  modified_base (280)..(280): a, c, t, g, unknown or other
  misc_feature (280)..(280): n is a, c, g, or t
  modified_base (546)..(546): a, c, t, g, unknown or other
  misc_feature (546)..(546): n is a, c, g, or t
tcagagtatacatacacgaccggtgctcgatttagctctacgctcagggggctttctgagagtcatggatctcatgtgacaagaaaatgaagcactgtgttcttcctcctgctggtggcgctaccagagtggtcctgtcccagctgcagctgacagggacgtccgggcccaggtacgtggtagaacgtccgttacgggacgacccctgtccccncaccgtgcctacttgccttcgtgggtcgacctccatcgagcacgactacgttacttacgtttcggnggtcgtacgacgtccccgaccgtaccggacccccggaagggaacggggtcgtaggggtaacgtacgggttaaggtttcgggtaaccgtttaccgtttaaccgacggttaaggggtcgggtaaaccgtacccgtaaacccgttaacccgtaacccgtaaaccccccggttactaaaacccggtaaaaggtaccgacgtaccaaacctacgtaacgtccgtaacgaacgaaccgtaaccaaacgaaccttaactccgtactaacgtancgtacgacgtacgttctacggtccgtacccgacgacgacgtaccgaacgtctacgttacacgtttacgcggttaccgccggaacccgtccggacgacgtcgtaacgggttctttaaccgtttcggtacgttccggttacgtttagtacgttacggttcggggaccggtaacggaggttaaccgtccggtacggtttaccctaccgtaccgtttaccgg

SEQ ID NO: 233185 - DNA, 838 bp, Homo sapiens
  misc_feature: GYAE6OF02FGRHU.48.73.G07.1.454.CMB.1.raw
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtagaagtccttcggacgaccctgtccctcacctgcctactgtccttcgtggtacgcttcatcagcagctacgttacttacttcgtcggggtctggtactcccgaccgtaccggacccccggagggggaacgggtccgtagggaggttacggtacggtttaggggtaacgtttaacgtttaacccgaacggtaacggggttacggggaacgtacccgtaacccgttaacccgtaacccgtaaacccccggttaacccgtaacggtaaaaacggtaccgggtaacggtacccgtaaccctaagttaaccgttaccggtaaacgtaacccgtaaccgtaacccgaaacgtaaaccctaaccgtttacccgttaccccgtaagaaccgtcgtaacggtaccctacggttaccgttacgggttacccggaaccccggcccggtaaccgtaacggaacccgtaccgggtaccttacgttaccgtttaactttacggttacggtacgggtacccgggtaacccgggaccccggtaggtcccggacgttacgggtttcgtttacgtttttacggtacgttcgttcccgttttagaacgttcggttacggggtacgggtaaccgaacgggttactaacggttccggtacccgttaccggttctttacccgg

SEQ ID NO: 233186 - DNA, 828 bp, Homo sapiens
  misc_feature: GYAE6OF02J2P48.48.73.G07.1.454.CMB.1.raw
  modified_base (481)..(481): a, c, t, g, unknown or other
  misc_feature (481)..(481): n is a, c, g, or t
  modified_base (548)..(548): a, c, t, g, unknown or other
  misc_feature (548)..(548): n is a, c, g, or t
tcagagtatacatacacgaccggtgctcgatttagctctacgctcagggcacgaccggtgctcgatttagtcacgcgagaaagggaaaggggctttctgagagtcatggatctcatgtgacaagaaatgaacgcaccttggttggttccttcctcctgtcgttgggtggccggcctcccgagagttcgggtcctcgtcccagtcctgccagtcgtagcgaggtacgtccgggccacggactggtagacgtccttacgggactacccttcgtcccctacgccgtcgtcctaacgttcgtaccgttcggttcgggtaacggtccttacccgtattaccgagacgtaaccggtcttaacgttacccgtttacgttccggtagggtccgtacggtccgttacccccggaccgtacccgggaccccggggtaaggggtaccgggtcgtaacgggtagttcgggtagtacggttactacgttaccgnggaggtcggaccactaccgtaacctacccgaacccgtacgtaaggtaaccgtcgacgtcccagtacnccgtacgtacgaccgtaccgtaaccgtaaacgtcctaacgttccgtacgtaggtaacccgttcgaccgacttcgtttacggtaccctacccgggtacccaccggtaccttaacccgggaacccgttcgggtttaaccctcgttttaaacccgggttacttccgggtttaccggacccgggtaccccggtaacccggggtccccgaacgggtttacccgttacggttcgggttttaacccccgtttggttttaacccgccccggttttaggtttaacccgg

SEQ ID NO: 233187 - DNA, 206 bp, Homo sapiens
  misc_feature: GYAE6OF02JZRIE.48.73.G07.1.454.CMB.1.raw
  modified_base (163)..(163): a, c, t, g, unknown or other
  misc_feature (163)..(163): n is a, c, g, or t
  modified_base (188)..(206): a, c, t, g, unknown or other
  misc_feature (188)..(206): n is a, c, g, or t
tcagagtatacatacacgaccggtgctcgatttagctctacgctcagggcacgaccggtgctcgatttagcacacgatagttgggtttgggaccaaggtggaagtcaaacgaactgtgctgcaccatctgtcttcatctcccgcatctgtatatgtatacctntgagcggactggacaggcgcatagnnnnnnnnnnnnnnnnnnn

SEQ ID NO: 233188 - DNA, 603 bp, Homo sapiens
  misc_feature: GYAE6OF02IHJ2G.48.73.G07.1.454.CMB.1.raw
  modified_base (272)..(272): a, c, t, g, unknown or other
  misc_feature (272)..(272): n is a, c, g, or t
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactcgtctctggtcggcctccatcagcagctagttacttacttcgtggggctggactccgaccncgaccccgagggacggggcgtggacgtggtacgttagggacgttactttaaccagaggtgggacgtacctaacctaacctaccgtaacccgtaccctacaaaacgtcgacggacaccatactccgagaccacgtaccaaacgtaacctacttacctacctagaacgtcgtacgacgtcttcgtacggtccgaccgaccgacacgaccgacggtcttgtactattcgtgtacggacgaccggcccgagcgcgtagttcggtattttcgacttcgtccgtttagacgttcgtggtacggacgtaaggtacgagttacggtcctaccgtactcg

SEQ ID NO: 233189 - DNA, 697 bp, Homo sapiens
  misc_feature: GYAE6OF02GX7NW.48.73.G07.1.454.CMB.1.raw
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtccgggcccagggactggtgaagccttcggacgtacccctgtcccctcacctgcctactgtctctggtgcctccatcagcagcagttacttacttcgtggggctcggactccgccacgcccccgaggggaacgggcgtgggagtggtagttgggagttacgtttaaccacgaggtcgggacgacctaccgtaacctaaccgaccccgttaccccgtactaaaacggttcggacgggaccaacctacgttacgtccggtaacgacctaccgtaacccgaaacgtaaaccctaacttcctacccgttagacgtacgtgacgtacgtcgttcgtcggacccgcccgacgaccgaccgacggtcttacggtactagttcgtcgtcgccggaccgggccccgaggccgtacgacggttcgtttcgtttttacggagttccggttaccttttaggtacgtttacggttacggggtaccggggtaacccggtaacggggaccgttaacggttccgggtacccgttaccggttcctttaccccgg

SEQ ID NO: 233190 - DNA, 723 bp, Homo sapiens
  misc_feature: GYAE6OF02ILSY5.48.73.G07.1.454.CMB.1.raw
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcgaggacggtccgggacccaggactgggtagaacgccgttcggacgacccctgtccctaccacctggcctacgttcgttccttcgttcgggtcggtcctaccgactcgagcgacgcctacgttaccttacgttcggtcgggtctcggacctcccgaccgaccggaccccggagggacgggcgtagggaggtacggtagttgggtacgttaacgtttaccgacgtaggtacgggacaccgtaaccgttaaccgtaacccgtaaccccgtacctaaacgtaaacgtccgaacggaccaaccgtacttacgtaccgtacgaaccgtaccgtaaccaaacgtaacctaacgttcctacccgtagtaacgcgtacgactaccgttcgtacgtaccggacccgaccgacgacggaccgtcgtcgttacgtactacgtcgtggacggaccgaccggcccgagccgtacgtcggtttacgttcgtttagacgttcgtacgtttgtaacgttcggtacgggtaccggggaaccgtacgggtaacgtaccggttaccggtaccgtaccgttaccgtccg

SEQ ID NO: 233191 - DNA, 889 bp, Homo sapiens
  misc_feature: GYAE6OF02GKON2.48.73.G07.1.454.CMB.1.raw
  modified_base (624)..(624): a, c, t, g, unknown or other
  misc_feature (624)..(624): n is a, c, g, or t
tcagagtatacatacacgaccggtgctcgatttagctctacgctcagggggctttctgagagtcatggatctcatgtgcaagaaaatgaagcacctgtggttcttcctcctgctggtggcgctcccagatgggtcctgtcccagctgcagctgcgaggacgtccgggcccagggactgggtagaacgtcccgttacggacgtacccgtcgtcccctcaccgtcgctacgtgtcctcgtggtcggcctccatcgagcacgactacgttacttaccgttcggtcgggtacgtggacctccccgcccgaaccggacccccggaagggggaacgggtcgtacgggacggttgggtaggttagggtaacgtttaaccgtttaaccgaggtaacgggttgggaacgtacccgtaacccgttaaccttaaacccgtaacccccggttaccctaaacggtaaaacggtaccggaaccgaaccgtaacccgtaagttaaccgttaaccggtaacgtaaccccgtaaccggtaaacccgaaaccgtaaacccgtttaacctttcccgtaaccccgttaggtaaacccgtcggttacggaccgttccgtttacggtaccggttaccgggaacccncccggtaacgaaaccggtacccggtaccggttcgttaacgggttactttacggttaccggttacggttccgggacccggaacccgggtaccccggtacggtcccgtacggtttaaccggtttcgggtttaccgttttacgtacggtttaccgtttaaccggtttggtaacggtttaccggggtaccgggtaaccggggtaaaccgtaacgggttaacccgggttaacgttcccgggttacccgttacccggttacgttaccccgg

SEQ ID NO: 233192 - DNA, 129 bp, Homo sapiens
  misc_feature: GYAE6OF02IXPFF.48.73.G07.1.454.CMB.1.raw
tcagagtatacatacacgaccggtgctcgatttagctctacgctcagggcacgaccggtgctcgatttagagctcacgtattgggtttgggggtttttaggtatctgagcgggctggcaaggcgcatag

SEQ ID NO: 233193 - DNA, 669 bp, Homo sapiens
  misc_feature: GYAE6OF02GN79F.48.73.G07.1.454.CMB.1.raw
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccagggactgggtgaagcccttcgggacaccctgtccctcacctgcactgtctcgtggtgcctccatcagcagcagttacttacttcgtgggctcggactccggcccacgacccccggaggggaacggggcgtagggaggtggtacgttagggtacgttacgtttaccgacgtaggtgggacgcgtaaccctaacgtaaccgaaccccgtaccctaacgtaaaacggtcggtaacggaccaaccgtaattacgtaccgtaacgaaccgtaaccgtaccgaaaacgtaaaccctaacttcccgtacccgtaagacgtctacggacgtcctgtacgtacggacccgccgacaacgtaccgacgccttagtaccttaacgtttcgtcggtacgccggaccggcccgagccgcgtacgttcgttctttgacgttcgtcttcggtattacggtcgggttaccgggacgtaacgggtactaacggtccggtacctaccgttcttacccg

SEQ ID NO: 233194 - DNA, 1034 bp, Homo sapiens
  misc_feature: GYAE6OF02FT5XY.48.73.G07.1.454.CMB.1.raw
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcgaggagtcgggccaggactggtagaacgtccgttacgggacgtacccttcggttcccctaccgtaccgttcggcctaacgttcggttccgttaccgttcggggttcggtcccttacccgtacgttaccgacggaccgtacggtacttaacggtttaaccttttaccggttccggttacgggggtacgttacgggtaccgttcccggaccccggtacccggtaccccccgggtaaagggggggacgggtccggtaggggtacggttacggggtagttacgggggtaactttaacgtttaaccggtaacgtaaggggttcgggtaacgtacccgtaaccgttacccggttaaaccccgtaaaccccggttacccgtaaaccgttaaaacggttaccgggtacggtaaccgtaacccgtaacgttaccggttaaccgggttaaacgaaccccggtaaacccgttaaccccgtaaaacgggttaaaaccctttaccggttacccttaaacccggtagggtaaccgtacggtttaacccgggacgtttaaccgttccggtttaaccgggtacccggtaacccccggcccgggtaaacgtaccggtaacccgggttaccggttccgtttaaccggtttaacccgttaccgttttacggttaccggggtacgtaccccggggtacccggggtaacccgtacggttacccgggtccgtttaaacgggtttacgggtttaccgtttttccgggtacgttttacccgggtttaaccgtttgggtaagtttacccggggttaggggttaaccccggggtaaagttaacgggggtttaccggtaccggttttacccggggtaccctttaccccggtttaggttaaccccgg

SEQ ID NO: 233195 - DNA, 757 bp, Homo sapiens
  misc_feature: GYAE6OF02FMGUR.48.73.G07.1.454.CMB.1.raw
tcagagtatacatacacgaccggtgctcgatttagctctacgctcagggggctttctgagagtcatggatctcatgtgcaagaaaatgaagcacctgtggttcttcctcctgcgtggtggcggctcccagagtgggtcctgtcccagctgcagctgcaggagtccggccaggactggtagaacgccgttcggacgtaccctcgtcccctcacctgccacttggtcctcgtgggtcgctcatcgagcagcagttacttacgttcgtgggctgactccgcacgcccccgagggacggggcgtggaggtcggagtgggtacgtacgtttaccgaacgtaggtagggacgacctaaccgttaaccgtaacccgtaaccccgttaaccctaaccgtaaaaacggtccggaacggtaccaaacgtaacttacgtaccggtaaacgtaaccgtaccggtaacccaaaacggtaaaccctaactttacctaccccgtaggaaacggtctacggtagtccctggttacgtccggacccggtaccgacgtaacggtaccgacggtccgtacgttactttaacgttacgttcgtacgggtcccggaccggggtaccccgacgacccggtcgtaacggttcggttttccgttttacgtacgttccgggtaccgtttttacggtagtttacggttccggggtacgggggtacccggtaaacgggtaccggtaacggtttaccggtacccgtacccggttaccttacccgg

SEQ ID NO: 233196 - DNA, 687 bp, Homo sapiens
  misc_feature: GYAE6OF02FZKNO.48.73.G07.1.454.CMB.1.raw
  modified_base (368)..(368): a, c, t, g, unknown or other
  misc_feature (368)..(368): n is a, c, g, or t
tcagagtatacatacacgaccggtgctcgatttagctctacgctcagggggctttctgagagtcatggatctcatcgtgcaagaaaatgaagcacctgtggttcttcctcctgctggtggcgctcccagatgggtcctgtcccagctgcagctgctaggagtcgggccaggacgtggtagaacgtccgttcggacgtacccgttgtccccgtcacctggcctacgttcggtccttcgtagggtcggcctccgtatcacgcagtctagttacttacttcgtcgggtctggactcccgcgaccgaccccggaggggacgggtcgtgggtagtggtagttgggacttacgttaccgaagtaggtgggtacnccgtaaccgtactacccgaacccgtacctaacgaaacggtcgaacggcctaacatacgtccgtaacgacctacgtaccaacgaacctaacttccaccgtagaacgtctacgacgtcctcgtagaccgaccgtcgacgaacgacgacggtctacgtacttacgtactcggacggacgtaccggcccgagccgtacgtacggttcgtttcgttttacggacttcggttaccgtttagtaacgtttacgggtacgggtacccgggtaaccggtaaggtaaccgttaacgggttcgttacccgtaccggtttaccttacccgg

SEQ ID NO: 233197 - DNA, 869 bp, Homo sapiens
  misc_feature: GYAE6OF02IUM25.48.73.G07.1.454.CMB.1.raw
tcagagtatacatacacgaccggtgctcgatttagctctacgctcagggggctttctgagagtcatggatctcatgtgacaagaaaatgaagcacctgtggttcttcctctgctggtgcgctcccagagtcggtcctcgtcccagtctgcagctgcgaggacgtcgggcccaggtacgtggtagaacgtccgttacggacgtaccctcgtccctcacctgccactcgttctcgtaggtcggtcctaccgatacgacgacgtacggactaacgttaccgtttaacgttccggtaggggtcgttaacggtaccgtaccccggacccgtaccgggacccccccgggtaaggggtaaccggggtcgttacgggggtaacggttagggttaacgggtttaccggggtaaagtttaacccgtttaaccggacggtacggggttacgggaaccgtaaccttacccgtaaaccgtaacccgtaaaccccggttacccaaacggtaaacggtccggaaccgacctaaaccgtagttaactaccggtaataacccgacctaaccgaaaacgtaacctaacgtttccgtaccctaggtaaacgtacgtaacgtaacgtccttacggtacggtacccggaccgtaccgaaccggtaacgaaccgtacccggtaccgttacgtaactttaacggttacgttacgggtaaccggacccgggttaccccggacccggtaacgtccgggtaacgtttcggtaacggtttttcctttaggtaccgtttacggtcccgtttaaaggacttttcgggaacgggttaccgggtaaccgggtacgtaaacgtaccgggttaccggtaacccgttcccgttccgttaccgg

SEQ ID NO: 233198 - DNA, 818 bp, Homo sapiens
  misc_feature: GYAE6OF02H363Z.48.73.G07.1.454.CMB.1.raw
tcagagtatacatacacgaccggtgctcgatttagctctacgctcagggggctttctgagagtcatggatctcatgtgcaaagaaaatgaagcacctgtggttcttcctcctgctggtggcgctccagatgggtcctgtcccagctgcagctgcaggacggtcgggcccagggactggtagacgtccgttcgggacgaccccttgtcccctcacctgctactcgtctcgtggtcgcctccatcagcagctagttaaccttcttcggtggggctggacctccggaccgaccggcccccggaagggggaacgggcgtagggtcggtgggtaaggttcgggaacgtttactttaccgacgtagggttacgggaacgtaccgtaaccctaaccgtaacccggtaaccccgttacccgtaaacgaaacggtccggtacggtaccaaccgtagttaaccgtaccggtacgaaacccgtaaccgtaccgtaaaccgaaaccttaccgtttacccgtacccgtaaggtaacccgtcgtaacggtactccggttacgtcgggttacccggacccggccgtaaccgaaaccggtaccgtacgggtcctttaacgttaccgtaacggttttccgtacggtaccgggtacccggacccgggaccccggtaacgggtcctccggggtaacgtttccgggttttacgttttgtaccggttttccgttaccgggttgttaaccgttagggttcccgggggttaacgggaccggttaaggggtaacccttaaggggttcccggttaccggttaccccgttccgtttaccccggg

SEQ ID NO: 233199 - DNA, 644 bp, Homo sapiens
  misc_feature: GYAE6OF02FUN26.48.73.G07.1.454.CMB.1.raw
  modified_base (332)..(332): a, c, t, g, unknown or other
  misc_feature (332)..(332): n is a, c, g, or t
  modified_base (636)..(636): a, c, t, g, unknown or other
  misc_feature (636)..(636): n is a, c, g, or t
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccgttcggagaccctgtccctcacctgcctactgtctctggtcgcctcatcagcagctagtacttactcgtggggctggactccgccacgccccgaggggacgggcgtggaggtggtagttgggagttactttaccgacgtaggtgggacnctactacctaccgaaccccgtcctacaaacgtcgacggacacctatacgtaccgtagactaccgtaaccaagtaacctacttcctacccgtagaacgtcgtgactctacgtcgtccgacccgtccgacgacgaccgtacgcgtcgttacttacgttacggtcggttacggaccggtaccggaccccggtggcccgtcgtaacgggttcgtttacgttttacgacttccggttaccgtttggaccgttagggtcgggtacgggtacccgtaagggaccttaacgggttcggtaccttcccgggtnttacccgg

SEQ ID NO: 233200 - DNA, 690 bp, Homo sapiens
  misc_feature: GYAE6OF02H39MX.48.73.G07.1.454.CMB.1.raw
  modified_base (221)..(221): a, c, t, g, unknown or other
  misc_feature (221)..(221): n is a, c, g, or t
  modified_base (411)..(411): a, c, t, g, unknown or other
  misc_feature (411)..(411): n is a, c, g, or t
tcagagtatacatacacgaccggtgctcgatttagctctacgctcagggggctttctgagagtcatggatctcatgtgcaagaaaatgaagcacctgtggttcttcctcctgctggtggcgctccagatgggtcctgtcccagctgcagctgcaggagtcgggcccaggactggtagaagccgttcggacgaccctgtccctcacctgcactgtctgtggngcctccatcagcagctagttacttacgttcgtcgggcgtcggacgtccgaccgaccgccccggacgggaacgggtcgtgggaggtgggtagttagggtacgttacgtttaccgacgtacggtaggacgacctaacctaccgtaaccgtaacccgtacccgtaacgtaaacggtagaaccccccccccganaccgtatacgtaccgtacgtaaccgaaccgtaccgaaacgtaacctaacttacctaccgtacgtaacgtacgtacgtacgtcgttacgtcgtacgaccggccgacgacgacgaccggtctcgtacttacgttacgtcgtacggacgtaccggacccgcggccgacgtacggttcggttcgttttcgtacgttcggttcgtttggtacgttacggttacgggtacgggtaacggtaacgggtacggtacggtacggttaccggttaccgttccgttaccg

SEQ ID NO: 233201 - DNA, 196 bp, Homo sapiens
  misc_feature: GYAE6OF02I5093.48.73.G07.1.454.CMB.1.raw
  modified_base (190)..(196): a, c, t, g, unknown or other
  misc_feature (190)..(196): n is a, c, g, or t
tcagagtatacatacacgaccggtgctcgatttagctctacgctcagggcacgaccggtgctcgatttagcacacgatagttgggtttgggaccaaggtggaagtcaaacgaactgtggctgcaccatctgtcttcatcttcccgccatctgatatgtatactctgagcgggctggcaaggcgcatagcnnnnnnn

SEQ ID NO: 233202 - DNA, 588 bp, Homo sapiens
  misc_feature: GYAE6OF02I7O49.48.73.G07.1.454.CMB.1.raw
  modified_base (543)..(543): a, c, t, g, unknown or other
  misc_feature (543)..(543): n is a, c, g, or t
  modified_base (550)..(550): a, c, t, g, unknown or other
  misc_feature (550)..(550): n is a, c, g, or t
  modified_base (552)..(555): a, c, t, g, unknown or other
  misc_feature (552)..(555): n is a, c, g, or t
  modified_base (559)..(559): a, c, t, g, unknown or other
  misc_feature (559)..(559): n is a, c, g, or t
  modified_base (561)..(561): a, c, t, g, unknown or other
  misc_feature (561)..(561): n is a, c, g, or t
  modified_base (568)..(568): a, c, t, g, unknown or other
  misc_feature (568)..(568): n is a, c, g, or t
  modified_base (570)..(573): a, c, t, g, unknown or other
  misc_feature (570)..(573): n is a, c, g, or t
  modified_base (576)..(576): a, c, t, g, unknown or other
  misc_feature (576)..(576): n is a, c, g, or t
  modified_base (578)..(578): a, c, t, g, unknown or other
  misc_feature (578)..(578): n is a, c, g, or t
  modified_base (580)..(580): a, c, t, g, unknown or other
  misc_feature (580)..(580): n is a, c, g, or t
  modified_base (582)..(582): a, c, t, g, unknown or other
  misc_feature (582)..(582): n is a, c, g, or t
  modified_base (585)..(588): a, c, t, g, unknown or other
  misc_feature (585)..(588): n is a, c, g, or t
tcagagtatacatacacgaccggtgctcgatttagctctacgctcagggcacgaccggtgctcgatttagtacacacacttagggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgacggcccgagccgcagtgtcttttgatcgcgtttgatagtgtcgggccaaggacagtggtcaccgtctcgttcagtcctccaccgtaacggcccacgtccggttccttccccgtgaccctacccgttcctaccgaagacgccaaccgtccggtcggggccacgtacgcccggtcccgtcgggtctacggtcctacgggtcgaaacgggtacctttacccgtttaccctaagtcgttaaacttccgttaccgttacggagggtacccgggtcggtacggaccggaacggtccggtacaagttcgatgacgtnagtcgcncnnnncagngngtctagngnnnncgnancncncgnnnn

SEQ ID NO: 233203 - DNA, 736 bp, Homo sapiens
  misc_feature: GYAE6OF02GYZX3.48.73.G07.1.454.CMB.1.raw
  modified_base (595)..(595): a, c, t, g, unknown or other
  misc_feature (595)..(595): n is a, c, g, or t
  modified_base (610)..(610): a, c, t, g, unknown or other
  misc_feature (610)..(610): n is a, c, g, or t
tcagagtatacatacacgaccggtgctcgatttagctctacgctcagggggctttctgagagtcatggatctcatgtgcaagaaaaatgaagcacctgtggttcttcctcctgctggtggcggctcccagatgggtcctgtcccagctgcagctgcaggagtcgggcccaggctggtgaagccttcggagtaccctcgtccctcacctgccacttcgtctcgtggtgcctcctatcagcacgctacgttacttacgttcgtcggggctggactcccgaccgaccggacccccggagggggaacggggcgtacgggaggtagggtaggtttaggggtaagttaaccgttttaaccgaacggtgggtacggggaacgtacccgtaaccttaacccgtaaacccgtaaccccgttacccgtaaaccgtaaaacgggttccggaacggacccgtaaaccgtaacgttaacgtacccggttaaacggaacccgtaacccgttaacccgaaaacgtaacccttaacgtttacccctacccgttaaggacgtccgtacgacgttccgtcgtacgacggtaccccgccgacacgacgtaccgnttcgtactattacgnggtcgacgccggcccgagccgcgtaggttccgttctttagacgttcgttacgtttagaacggtttcgtggggtacgggtaccgtaagggacttaacggtcggtaccgttacccggttacttacccg

SEQ ID NO: 233204 - DNA, 702 bp, Homo sapiens
  misc_feature: GYAE6OF02GMTQJ.48.73.G07.1.454.CMB.1.raw
  modified_base (489)..(489): a, c, t, g, unknown or other
  misc_feature (489)..(489): n is a, c, g, or t
tcagagtatacatacacgaccggtgctcgatttagctctacgctcagggggctttctgagagtcatggatctcatgtgcaagaaaatgaagcacctgtggttcttcctctgctggtggcggctcccagagtgggtcctgtcccagctgcagctgcaggaggtccgggcccaggtacgtgggtagaacgtccgttcgggacgaccctcgtcccctcacctgcactgtctcgtggtcgctccatcagcagctattacttacgttcgtgggctggtctcccgccgaccggaccccggaggggagggcgtaggaggtggtaggttagggtagttacgttaaccgaggtagggtaggacgacctacctaaccgtaacccgaacccccgtacccgtaacgaaacggtaccgacgacctaacctacgtacgtaccggaacgaaccgtaccgtaaccgaaaaccgtaacctaacttaccgtacccgtaagacgtcgngaccgtctcgtcggtaccgacccgaccgcgaaccggcgtacggtcttaccgttactaacgttaccggtggtaccggacccgggacccggaccccggaggccgtacttagggttcgtttacgttttgacgtttccgtacgtttaggtactttcgggtacgggtacgggaaccgtaaggtaccgtacgttaccggtacccgtacgttcccttacg

SEQ ID NO: 233205 - DNA, 262 bp, Homo sapiens
  misc_feature: GYAE6OF02HPGBH.48.73.G07.1.454.CMB.1.raw
  modified_base (151)..(151): a, c, t, g, unknown or other
  misc_feature (151)..(151): n is a, c, g, or t
  modified_base (155)..(155): a, c, t, g, unknown or other
  misc_feature (155)..(155): n is a, c, g, or t
  modified_base (228)..(228): a, c, t, g, unknown or other
  misc_feature (228)..(228): n is a, c, g, or t
  modified_base (248)..(248): a, c, t, g, unknown or other
  misc_feature (248)..(248): n is a, c, g, or t
  modified_base (254)..(262): a, c, t, g, unknown or other
  misc_feature (254)..(262): n is a, c, g, or t
tcagagtatacatacacgaccggtgctcgatttagctctacgctcagggcacgaccggtgctcgatttagtagcatactgttgggtttggggccaagggacaacggtcaccgtctcttcagcctccaccaagggcccatcggtcttccccnggcnccctgctccaggagcacctccgagagcacagcgccctgggctgcctggtcaaggactacttctatgtatactntgagcgggtctggcaaggcncatagnnnnnnnnn

SEQ ID NO: 233206 - DNA, 741 bp, Homo sapiens
  misc_feature: GYAE6OF02HIO3P.48.73.G07.1.454.CMB.1.raw
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggacgaccctgtccctcacctgcactgtctcgtggtgctccatcagcagcagtacttacgttcgtgggtctggtctcccgccgacgcccccgaggggaagggcgtgggagtggtagttggggtagttaactttaccgacgtaggtgggagaccgtaccgtactaacccgtaacccgtacctaacgaaaacgtcgacggactatacaactaacgtaccgtaacgactaaccgtacgaaacgtaacctaactttcccgtacccgtagtaaccgtacgtacgtaacgtcgtacgttcggaccggtacccggtaccgaacgaccggaacccgtaccggtacgttacgtttaccgtttaacgtttaacgttcgggtaccggtacccgggtaaacccgggcccccggtaacggaccggtaccggtacgggtttacggtttccggttttttaggacggtttccggtttccgtttacggtaagtttcgggttacggggtacggggtaaccggtaacgggggtaaccttaacgggtttccggtaacccgttaccggtttacccg

SEQ ID NO: 233207 - DNA, 570 bp, Homo sapiens
  misc_feature: GYAE6OF02G299H.48.73.G07.1.454.CMB.1.raw
  modified_base (372)..(372): a, c, t, g, unknown or other
  misc_feature (372)..(372): n is a, c, g, or t
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagttacttacttcgtggggctggactccgccacgcccccgagggagggctgggagtggagttgggagttactttaccgacaggtgggacgcacctactaaccaacccgtcctacaaacgtcgaggcacatactcgtanacacgtaccaaacgtaaccaacttcctaccctagaaacgtccgtagacgtccttactcggtacggacccgccgacacggaccaccggcttgtactattacgtgtacggccgacggcccgagccgcgtagtgttcgttttgattcgtcgttgattgtggtcgggaccaagggactagtcggtacctaccggttcttccg

SEQ ID NO: 233208 - DNA, 336 bp, Homo sapiens
  misc_feature: GYAE6OF02GG51Z.48.73.G07.1.454.CMB.1.raw
  modified_base (325)..(336): a, c, t, g, unknown or other
  misc_feature (325)..(336): n is a, c, g, or t
tcagagtatacatacacgaccggtgctcgatttagctctacgctcagggcacgaccggtgctcgatttagtgtgagtagttccgcgggcacgaccggtgctcgatttagagagagtgtgttgggtttggggggtgtggtggtctccactcccgccttgacgaggctgattactactgtcagtcttttgataacaacaatcacgtggtcttcggcggagggaccagcctgaccgtcctaggtcagccaagctcgccccctcggtcactctcgttccccgccctcctctatcgtatactctgaggcgggtctgcgaaggcgcatagnnnnnnnnnnnn

SEQ ID NO: 233209 - DNA, 831 bp, Homo sapiens
  misc_feature: GYAE6OF02JXG50.48.73.G07.1.454.CMB.1.raw
  modified_base (731)..(731): a, c, t, g, unknown or other
  misc_feature (731)..(731): n is a, c, g, or t
tcagagtatacatacacgaccggtgctcgatttagctctacgctcagggggctttctgagagtcatggatctcatgtgcaagaaaatgaagcacctgtgttcttcctctgctggtggcgctcccagagtcggtcctcgtcccagctgcagctgcgaggacgtccgggcccgaggactggtagacgtccgttcggaccgtacccgttcgtcccctcacccgtgacctacgttcgtcgtcggttcgggtacggccttaccgacttccgaacggcaacgaccgtacgttaccgtttacgtcggttgggtactcggtaaccgtcccgaccgtacccggaccccgggtaagggggaacggtcggtcgggtaggtggttacgttacgggttattaacctttaccgaacggtgggtagggtaacctacccgaacctttaacccgaacccgttaacccccggtaccgtaaacgaaaacggtcggaacggaccctaaccggaccttacccgtaaacgtaaccggtaaacgtaaccgaaacccgtttaaccccttaaaacccgttaccgtttaacccgtttaccccgttaaacccccgttaactcccggtttaaaccccgttcgtttacggaccccggacccggttccgtaacgtaaccggacccggttaacccggttaccgttagtttaccgttaacgccgtacggaccgtacgtactactttaagtactttctaaagtntaacacgttcgtacgttcgaccttccgaacggttcccggacggtccggtaaccggtccgtacgttacccgaccgtttcgacgttacccgaccgtaccccg

SEQ ID NO: 233210 - DNA, 668 bp, Homo sapiens
  misc_feature: GYAE6OF02HQ9DB.48.73.G07.1.454.CMB.1.raw
  modified_base (243)..(243): a, c, t, g, unknown or other
  misc_feature (243)..(243): n is a, c, g, or t
  modified_base (301)..(301): a, c, t, g, unknown or other
  misc_feature (301)..(301): n is a, c, g, or t
  modified_base (335)..(335): a, c, t, g, unknown or other
  misc_feature (335)..(335): n is a, c, g, or t
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcggcccaggactgggtagaacgcctttcggacgacccctgtcccctcacctgccacttcgtctcgtggtgcctccatcagcngctagttacttacgtcgtgggctggactccgccgaccgccccgagggacggcgtaggnggtggtagtggagttacttaccgagaggtggacnctacctactaccgaccgtcctaacgaaacgtcgacgaccacatacgtaccgtagacctacgtaccaaacgaacctacgttcctaccgtagaacgtctagacgtcttcgtcggtaccgaccggtccgacgtaaccggtacgacccgtcgttacgttaccttaacgtttaccgtaacggtccggtaccggaacccgggtccccgaagggtcccgtaaccgggttacggttacggttttcttttaggacgttcggtttaccgtttaggtaacgttaggtcgggttacgggacgtaacgggtatacggttcgggtacccttaccgttcgttacccgg

SEQ ID NO: 233211 - DNA, 728 bp, Homo sapiens
  misc_feature: GYAE6OF02JVE63.48.73.G07.1.454.CMB.1.raw
  modified_base (237)..(237): a, c, t, g, unknown or other
  misc_feature (237)..(237): n is a, c, g, or t
  modified_base (527)..(527): a, c, t, g, unknown or other
  misc_feature (527)..(527): n is a, c, g, or t
tcagagtatacatacacgaccggtgctcgatttagctctacgctcagggggctttcgtgagagtcatggatctcatgtgcaagaaaatgaagcacctgtggttcttcctcctgctggtggcggctcccgagagtcgggtccctggtcccagctgcacgctgaccagggcggtccgggacccaggtactgggtagaacgcccgtttcgggacgaccccgtggtcccctccgtaccgtnacctcttcggtcctcggtgggtcggccttccattccgagccgtagccgtaagttaacctttcgtcggttcggggtccttcgggactccccgaccgtacccggacccccggaacgggggaacggggtccggtggggaacggttcgggtaaggtttcggggaaggtttacctttaacccggaacggtacggggttacgggaacgtcccgtaaccgttaaacccggaccctaaccccgttacccgaacgtaaaacgtccggaacgtacccgaaccgtaacgtgaccgtaaacncgtaaaccgtacgaaaacgtacctaaccgtccgtaccacgtacgcgtacgtacgtctacgtcgtacgccgaccggcacgcacggctgtactacgtagtcgtagccgtaccgccggagccgtcgcgttgtacgttagtctagtcgttcgtatcggtacggtcggaaggacggtacgaacgttccggacgtccgtacgttccg

SEQ ID NO: 233212 - DNA, 632 bp, Homo sapiens
  misc_feature: GYAE6OF02JZGBG.48.73.G07.1.454.CMB.1.raw
  modified_base (336)..(336): a, c, t, g, unknown or other
  misc_feature (336)..(336): n is a, c, g, or t
  modified_base (343)..(343): a, c, t, g, unknown or other
  misc_feature (343)..(343): n is a, c, g, or t
tcagagtatacatacacgaccggtgctcgatttagctctacgctcagggggctttctgagagtcatggatctcatgtgcaagaaatgaagcacctagtggttcttcctcctgctggtggcggctacccagactgggtcctgtcccagctgcagctgcaggagtcgggaccaggctggtagaacgccgtttacggactaccccgtgtaccccctcgaccctggacctacgttcgttcctcgtagggtcggaccttccatacgagcagctagtcttactcggtggctggactccgcacgccggagggacgctaggagtgagtggactacgttaccagngcggacnccacttacacgacccctcaacgaacgtcgaacggtcaactagtacgtacgtagaacccttcggaacctaacgaaccttagttcccacgtagaacgcttacggacgtcctacgtcgacgacccgcgacgtagaccgtccgtctattaccgtcttacggtccgacggccggaaccggtcccgagtcgtaaccgtggttcgtcgtttagcgttcttacggttcgagtttcggacggtaccgggtactaaacgggtcgtacgggttcggaacccgttcccgttagtttacccg

SEQ ID NO: 233213 - DNA, 908 bp, Homo sapiens
  misc_feature: GYAE6OF02HJU2V.48.73.G07.1.454.CMB.1.raw
tcagagtatacatacacgaccggtgctcgatttagctctacgctcagggggctttctgagagtcatggatctcatgtgcaagaaaatgaagcacctgtggttcttcctcctgctggtggcgctcccagatgggtcctgtcccagctgcagctgcagggcggtccgggcccaggacgtgggtagaacgtcccgtttcggaacgtaccccgttcgtcccctcgacccgtgcctactcgttcctcgtgggtcgtccctccgtactcgacgccagtaccgtacgtttaccgtttaccgttcggtaggggccttacggaccgttccccgacccggacccggacccccgggtaagggggtaaccgggggtcggtacggggtacgggttagggttaacgggtttacgggggtaaccgttttaaccgtttaacccgaacggtaacggggtacggggacgtacccgtaaacccgttaacctaaccccggtaaacccccgttacccgttaaaacggtaaaccgggttccgaacggtaccctaaccggtaacttaaccggttaccgtaaacgaccctaaaccgttaacccgaaaaccgtaaaccctttacctttacccgtacccgtaaggtaacggtaccgttaggtacccgtcgttacgtacggtaacccggacccggtacccgaccggaaccggtaacccgtacgggttaccttcgttaccgtttacgttacggtcggtaccggtaccgggaccccgtccggtaacggcgtaacgggtcgtttaccgggtttctttaggtaccgttcggtttaccgttttaaggacgtttaacgggttaccgggggtacccgggtaaccgttaacgggggtaacttaccgggttccggttaaccccgttacggtttccttaacccgg

SEQ ID NO: 233214 - DNA, 806 bp, Homo sapiens
  misc_feature: GYAE6OF02IVCU3.48.73.G07.1.454.CMB.1.raw
tcagagtatacatacacgaccggtgctcgatttagctctacgctcagggggctttctgagagtcatggatctcatgtgcaaagaaaatgaagcacctgtggttcttcctcctgctggtggcggctcccagatgggtcctgtcccagctgcagctgcgaggacggtccgggacccagggacctggtacgaacgtccgtttcggaacgaccccgttcggtcccctacgacctggacctacgttcggttcctccgttgggtcgcctaccatcgacgcaagacagtaccgttacttcgtcgggtcgtggtacgtccgaccgaccgaccccggaggggacggtcgtggaggtcgggtagttagggtacgttaacgttaaccgaacgtaggtagggaacgtaccgtaaccgtaaccgtaaccgtaacccccgttaacccgtaagtaaaaaccccccccccgggtagaaacggtacccgtaacctaacgttaacccgttaccggtaacgaacccgtaacccggttaaacccaaaccggtaaacccttaaaccgttaccctaacccgttaacgaaaccggtaccgtacgtacggcctttaccgtacggtcccgaacccggaccgaaccgtaaccggaaccgtaccggtaccgttaccgtacttaacgttacgttcgtacggtaccggaccggcccgacggaccgtcgtacggttacgttccgttttagtaccgttcgttacgtttacggattacggtcggtacgggtaccgaacggttacgtaacggttccggtaccgtaccgttattacccgg

SEQ ID NO: 233215 - DNA, 688 bp, Homo sapiens
  misc_feature: GYAE6OF02H15IW.48.73.G07.1.454.CMB.1.raw
  modified_base (160)..(160): a, c, t, g, unknown or other
  misc_feature (160)..(160): n is a, c, g, or t
  modified_base (276)..(276): a, c, t, g, unknown or other
  misc_feature (276)..(276): n is a, c, g, or t
  modified_base (440)..(440): a, c, t, g, unknown or other
  misc_feature (440)..(440): n is a, c, g, or t
  modified_base (491)..(491): a, c, t, g, unknown or other
  misc_feature (491)..(491): n is a, c, g, or t
  modified_base (518)..(518): a, c, t, g, unknown or other
  misc_feature (518)..(518): n is a, c, g, or t
  modified_base (594)..(594): a, c, t, g, unknown or other
  misc_feature (594)..(594): n is a, c, g, or t
  modified_base (617)..(617): a, c, t, g, unknown or other
  misc_feature (617)..(617): n is a, c, g, or t
tcagagtatacatacacgaccggtgctcgatttagctctacgctcagggggctttctgagagtcatggatctcatgtgcaaagaaaatgaagcacctgtggttcttcctcctgctggtggcggctccagagtgggttctgtcccagctgcagctgcaggngtcggccaggactggtagaacgtccttcggacgtaccctgtccctcacctgcactgtctcgtggtcgacctacatcagcagactaacgttacttacgttcgtggggcctaggaacncccgtaccgaccggaccccgaaggggaacggcggtacggtacgtaggtaaggtgggtaagttaacgtttaaccacggtagggtcggtaacgacctacctaacaacccgtaaccccgtaccttaaacgaaacggtacgaacgcctaacgtaactacgtaccgtanaacctaacccggtaacaacgtaaacctaacttccgtaccgaagtacgtacncgtaacgtcttacgtacgtcggacccncgtaacgacgacaccggtcttcgtatacgttacgtgtacggacgtcccggaaccgtcgaaccgtggtcgttagttntttacggacgttcgtaccgtttnaagtaggttccggtaacgggaacccgtaaaggtaccctaagggttcccgtaacgtacccgtcgtttaaccg

SEQ ID NO: 233216 - DNA, 290 bp, Homo sapiens
  misc_feature: GYAE6OF02GJ2S9.48.73.G07.1.454.CMB.1.raw
  modified_base (281)..(290): a, c, t, g, unknown or other
  misc_feature (281)..(290): n is a, c, g, or t
tcagagtatacatacacgaccggtgctcgatttagctctacgctcagggcacgaccggtgctcgatttagatcgtctgtgttgggtttgggggtgtggtggtctccactcccgccttgacgaggctgattactactgtcagtcttttgataacaacaatcacgtggtcttcggcggagggaccagcctgaccgtcctaggtcagcccaaggctgccccctggtcactctgttcccaccctcctctatgtactactctgagcggctggcaaggccgcatagnnnnnnnnnn

SEQ ID NO: 233217 - DNA, 709 bp, Homo sapiens
  misc_feature: GYAE6OF02HOZQJ.48.73.G07.1.454.CMB.1.raw
  modified_base (170)..(170): a, c, t, g, unknown or other
  misc_feature (170)..(170): n is a, c, g, or t
  modified_base (607)..(607): a, c, t, g, unknown or other
  misc_feature (607)..(607): n is a, c, g, or t
tcagagtatacatacacgaccggtgctcgatttagctctacgctcagggcacgaccggtgctcgatttagtcacgcgagaaagggaaagggggctttctgagagtcatggatctcatgtgcaagaaatgaagcacctgtgttcttcctcctgctggtggcggctcccagngtgggtcctgtcccagctgcgagctgcagggacgtccgggcccaggtacgtggtagaacgtccgttacggacgtaccccttcgtcccctcaccgtgcctactggtccttcggtggtcggtcctccaactcgacgcacgtcgtacgttaccgtttccgttcggtgggtactcggtactcccgaccggaccggtaccccggaagggggtacgggcgtacggggtacgttacgggtaggttagggtacgttaacgtttaccggacggtagggtacggaacgtaccgttaaccccgtacctaaacccgttaacccccgtccgtaaacgtaaccggttaccggaaccgtacccaacgtaccgttaccggtacggtaaccaaccgtaacccggtaccaaacgtaccttacgttccgaacccgttagactcgtacgactttccncgtcgtacccggcccgcgacgacgaccggtcgtctgtaccgttagtcgtcggtcggaccgacggtccagtcggacttaggtgttctttaggcgttcgttacg

SEQ ID NO: 233218 - DNA, 863 bp, Homo sapiens
  misc_feature: GYAE6OF02F8XTT.48.73.G07.1.454.CMB.1.raw
  modified_base (150)..(150): a, c, t, g, unknown or other
  misc_feature (150)..(150): n is a, c, g, or t
tcagagtatacatacacgaccggtgctcgatttagctctacgctcagggggctttctgagagtcatggatctcatgtgcaagaaaatgaagcacctgtgttcttcctcctgctggtggcgctccagatggtcctgtcccagctgcagtcngcaggtagtccgggcccaggacgtgggtagaagtccgttacgggacacccgttgtcccctcaccgttgcctacttcgtctccgtggtacgccttaccatcaggactgaccgttaacgttaacctttaccgttcgggtggggtcctagggtaccttccccggaccgtacccggacccccgggtaacggggggaacgggggtcttacgggggaacggttcgggtaaggtttacggggtagttaaccgtttaacaccggtagggtcgggacgtaccgtaacccgttaaccgtaaccctaaaccccggtaccgaaaaccggtaaaacggttccgaaccggcctaaacccgttataccggttaacccggtaactaaccgtacccgtaacctaaaaccgtaaccgttaaacgttcccgtacccgtaagtaaaccgtcgttaaaccggcgtacgttccgtacggtaccggtaccggaccgccgttaagacccgttacggtccttacgtttaccgttaacgttaccgtacgacggggttaccccgaccgggtaccccggtacggacgttacccacgggtttttccggttacgtttttcgtaccggtttaacggtcccggttttttaagtacggtttacgggtacggggttaacgggaacccgggttaacggttaaacggttaacgggttcccggtaccgtttaccggttacggtttacccc

SEQ ID NO: 233219 - DNA, 700 bp, Homo sapiens
  misc_feature: GYAE6OF02FOJ2G.48.73.G07.1.454.CMB.1.raw
tcagagtatacatacacgaccggtgctcgatttagctctacgctcagggcacgaccggtgctcgatttagtgacatctcgcagttctttggggggatctcatgtgcaagaaaatgaagcacctgtggttcttcctcctgctggtggcggctcccagatgggtcctgtcccagctgcagctgcaggagtcgggcccaggactggtgaagccgttcggacgaccctgtcccctcacctgcactgtctcgtggtcggctccatcagccagctagtacttacttcgtgggctggactccgccgacgcccccgtaggggaacgggctagggacggttggtagttaggggagttaacgtttaaccgaagtaggttacggggaacgtccgtaaccgttaaccgtaacccgtaaccccggttacccgtaacgtaaaaacggtccggaacggaccaacccgtaagtacgtacccggttacgaacgtaacccggttaccaaaaacggtaaaccctaacgtttacctacccgtaagtaaccgcgttagaacgtcgtacgttgtaccggaccgtccgacgtaacggaccgtacgtcgttacgtaccttagttaccgtgtacggccgacggtcccgacggacgtccaaggttcggttcgtttttacggacgtttacggttccgtttaggacgttacggttaggtaaccggggg

SEQ ID NO: 233220 - DNA, 734 bp, Homo sapiens
  misc_feature: GYAE6OF02IP6UQ.48.73.G07.1.454.CMB.1.raw
  modified_base (458)..(458): a, c, t, g, unknown or other
  misc_feature (458)..(458): n is a, c, g, or t
  modified_base (693)..(693): a, c, t, g, unknown or other
  misc_feature (693)..(693): n is a, c, g, or t
tcagagtatacatacacgaccggtgctcgatttagctctacgctcagggcacgaccggtgctcgatttagtcacgcgagaaaagggaaaggggctttctgagagtcatggatctcatgtgcaaagaaatgaacgcacctgtgttctcctcctgctggtggcgcctcccagtagtcgggtcctgtcccagtcctagcagcgtacggcgaacggcggtcccggaccgtaaggtcgtggtacgaacgtccgttaacggccgtaccgttcctcccgtctacgtcgtactcgttgttacccgtgtccggtcgtacctccacgctacgcgaacgtaacttaccggttttaacgttacttcggggggtccggttacggtggtaccccgtccggacccgaccccggaaccgggaggggtaaccggtgggacggtaggtaggttacggacggttattacgttaccgngtaagggacgtctaaccctacgtacgacccgtaacccgtcaaccgggtaactacggacgtaccgtaacaccgtaacgaccgtaacgaccgaaccgtaacgaaacccgtaactaccgttacgtaccgtacgtaccgtacgtacgagtccttacgtcgtaacgcccgtacgaaacggcgttaacggacgtaccgttgttaccgttatttccggacggtcgaacccggtaccggccgnggtacccgcgtttggttcgtttcgttacttcggtcttacgg

SEQ ID NO: 233221 - DNA, 1002 bp, Homo sapiens
  misc_feature: GYAE6OF02H98DJ.48.73.G07.1.454.CMB.1.raw
tcagagtatacatacacgaccggtgctcgatttagctctacgctcagggggctttctgagagtcatggatctcatgtgcaagaaaatgaagcacctgtggttcttcctcctgcgtggtcggcggctcccagatcgggtcctgtacccgagcgtgacacgtctcggaccgagggacggtccgggacccgagggtaacgtgggtaggaacgtccgtttacggaccgtaccccgttcgttccctacctacccgtgcctaaccgttgttccttccggtacgggtcggtcccttaccctagtaccgtaacggccgtacggtaactaacggtttactttacgtttccggtcggggtacggttacggaccgttacccggacccgacccgggtaacccccgggaagggggtaaccggggtccggttagggggtacgggttagggttaagggttacggggtaacgtttaaccggtttaaccgaacgggtacgggtacgggaaccgtaccttaaacccgtaacccgttaaacccgtaacccccggtacctaaaccgtaaacggtacggaacgtacccgtaacgtaaccgttacgtaaccggttaacgaccgtaaaccgtacccgaaaacgtaaacctacgttacctacccgtagaacgttcgtaggaccgtcgttcgtacgtaaccggaccgtaccgaccgacggtaaccgtacgggtaccttacggtacctttacggttaccgtacggtaccgggtacccgggtaacccggggtacccccggaaggtcccgggttaaccgggttacgttttacccgggggttttacgtttttaccgggttacccgtttaacccgggtttacccgggtttttaaagtaccggggttttaaccgggtttaccgggggggtaaccgggggtttaaaaccccgggttagggttaaaaaccccggttacggggtttaccccgggttaaccccccggttaccggttttaccggttttaaccccccgg

SEQ ID NO: 233222 - DNA, 324 bp, Homo sapiens
  misc_feature: GYAE6OF02HNSNW.48.73.G07.1.454.CMB.1.raw
  modified_base (274)..(274): a, c, t, g, unknown or other
  misc_feature (274)..(274): n is a, c, g, or t
  modified_base (297)..(297): a, c, t, g, unknown or other
  misc_feature (297)..(297): n is a, c, g, or t
  modified_base (299)..(324): a, c, t, g, unknown or other
  misc_feature (299)..(324): n is a, c, g, or t
tcagagtatacatacacgaccggtgctcgatttagctctacgctcagggcacgaccggtgctcgatttagatcgtctgtgttgggtttgggggtgtggtggtctccactcccgccttgacgaggctgattactactgtcagttcttttgataacaacaatcgacgtggtcttcggcggagggaccagcctgaccgtcctaggtcacgcccgaaggctccgccccccgtacggtccaccttccttcgttccccgcccttcctctatgtactctcnggagcggccgtggacgacggcanannnnnnnnnnnnnnnnnnnnnnnnnn

SEQ ID NO: 233223 - DNA, 331 bp, Homo sapiens
  misc_feature: GYAE6OF02H5D2R.48.73.G07.1.454.CMB.1.raw
  modified_base (294)..(331): a, c, t, g, unknown or other
  misc_feature (294)..(331): n is a, c, g, or t
tcagagtatacatacacgaccggtgctcgatttagctctacgctcagggcacgaccggtgctcgatttagatcgtctgtgttgggtttggggggtgtggtggtctccactcccgccttgacgaggctgattactactgtcagttcttttgataacaacaatcacgtggtcttcggcggaggaccagcctgaccgtcctaggtcagcccgaaggcctcgccccctcggtccactctgttccccacccctcctctatgtatacctgtgcgcgggtcgtggacgacggcgatagagnnnnnnnnnnnnnnnnnnnnnnnnnnnnnnnnnnnnnn

SEQ ID NO: 233224 - DNA, 276 bp, Homo sapiens
  misc_feature: GYAE6OF02JH3V3.48.73.G07.1.454.CMB.1.raw
  modified_base (161)..(161): a, c, t, g, unknown or other
  misc_feature (161)..(161): n is a, c, g, or t
  modified_base (194)..(195): a, c, t, g, unknown or other
  misc_feature (194)..(195): n is a, c, g, or t
  modified_base (197)..(199): a, c, t, g, unknown or other
  misc_feature (197)..(199): n is a, c, g, or t
  modified_base (201)..(202): a, c, t, g, unknown or other
  misc_feature (201)..(202): n is a, c, g, or t
  modified_base (204)..(204): a, c, t, g, unknown or other
  misc_feature (204)..(204): n is a, c, g, or t
  modified_base (207)..(276): a, c, t, g, unknown or other
  misc_feature (207)..(276): n is a, c, g, or t
tcagagtatacatacacgaccggtgctcgatttagctctacgctcagggcacgaccgtgctcgatttagcacacgatagttgggtttgggacccaaggtggaagtcaaacgaactgtggctgcaccatcctgtcttcatcttccccgcatctgatatgtanacgtctgagcgggactggacaaggtcgcatcgnntnnntnnancgnnnnnnnnnnnnnnnnnnnnnnnnnnnnnnnnnnnnnnnnnnnnnnnnnnnnnnnnnnnnnnnnnnnnnn

SEQ ID NO: 233225 - DNA, 683 bp, Homo sapiens
  misc_feature: GYAE6OF02JRZG1.48.73.G07.1.454.CMB.1.raw
  modified_base (632)..(632): a, c, t, g, unknown or other
  misc_feature (632)..(632): n is a, c, g, or t
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcgaggtacgtccgggcccaggactgggtagaacgtccgttcggacgtaccctcgtccctccacctgctacttcgtctcgtggtcgcttccatcagcgagctagttacttacgtcgtgggctggacctccgaccgaccgtccccggaaggggtacgggcgtagggtacggtggtagttcgggtaacgttacgtttaaccgacgtggtacgggacgtacctacccgtaacctaaccgtaaccccgtacccgtaacgtaaacgtcgacgaccaaccgtaatacgtaccgtaggaaccctaacgtacgaaacgtaaccttaacgttcccgtaccgtaacggaacgtccgtaggaaccgtcgttacgtaccggaccgacccgccgtacgaaccggtaccgtacggtccgttacgttactaactcgtacgtccggacgaccgtcccgagtccgcgtagttcggttactttgacgtcgtacgttntacggttgtacggtacggtaacaacggttacaggtcgtaccgtcgcgttcg

SEQ ID NO: 233226 - DNA, 700 bp, Homo sapiens
  misc_feature: GYAE6OF02FPCHA.48.73.G07.1.454.CMB.1.raw
  modified_base (464)..(464): a, c, t, g, unknown or other
  misc_feature (464)..(464): n is a, c, g, or t
  modified_base (524)..(524): a, c, t, g, unknown or other
  misc_feature (524)..(524): n is a, c, g, or t
  modified_base (540)..(540): a, c, t, g, unknown or other
  misc_feature (540)..(540): n is a, c, g, or t
  modified_base (642)..(642): a, c, t, g, unknown or other
  misc_feature (642)..(642): n is a, c, g, or t
tcagagtatacatacacgaccggtgctcgatttagctctacgctcagggggctttctgagagtcatggatctcatgtgacaagaaaatgaagcacctgttggttcttcctcctgcgtggtggcgctcccagagtgggtcctgtcccagctgcagctgcaggtcgtcgggcccaggtactggtgagtccgttcgacgcccttttttgccctcacctgctacgtgtctcggtaggtcggcctctagtccgagtcagacgttaagttacttacgttcggtgggactgtactccgacccgaccggccccccgaagggggaccggttccgagggtagtggaggttcgggttaatttaaccgtttacgaccggtagggtaggactcctaaccgttaaccctaaccaacccccggttcccaaaggtaaaacgtcggaaccgaccaccggtaatacttacccggataaaccnccggtaaccaaacggtaaaaccctgttaccctccgtagtacggctacggctccttacgtntccggaaccggtaccncgacgtaaccgcggtccttagtccttaacgttcgttcggacgtccgacccggtccggtacgcgtacgtggttcgtttacttttacgacgttcgttaccgttntaggtacgtagggttcccgaaggtaacggctaacggtcgttcctaccggtattacccg

SEQ ID NO: 233227 - DNA, 288 bp, Homo sapiens
  misc_feature: GYAE6OF02H7Y85.48.73.G07.1.454.CMB.1.raw
  modified_base (281)..(288): a, c, t, g, unknown or other
  misc_feature (281)..(288): n is a, c, g, or t
tcagagtatacatacacgaccggtgctcgatttagctctacgctcagggcacgaccggtgctcgatttagatcgtctgtgttgggtttggggggtgtggtggtctccactcccgccttgacgaggctgattactactgtcagtcttttgataacaacaatcacgtggtcttcggcggagggaccagcctgaccgtcctaggtcagcccaaggctgccccctcggtcactctgttcccaccctcctctatgtatactctgagcggctggcaaggcgcatagnnnnnnnn

SEQ ID NO: 233228 - DNA, 705 bp, Homo sapiens
  misc_feature: GYAE6OF02IAM3S.48.73.G07.1.454.CMB.1.raw
  modified_base (136)..(136): a, c, t, g, unknown or other
  misc_feature (136)..(136): n is a, c, g, or t
  modified_base (149)..(149): a, c, t, g, unknown or other
  misc_feature (149)..(149): n is a, c, g, or t
  modified_base (175)..(175): a, c, t, g, unknown or other
  misc_feature (175)..(175): n is a, c, g, or t
  modified_base (206)..(206): a, c, t, g, unknown or other
  misc_feature (206)..(206): n is a, c, g, or t
tcagagtatacatacacgaccggtgctcgatttagctctacgctcgagggggctttctgagagtcatggatctcatgtgacaagaaaatgaagcacctgtggttctcctcctgctggtgcgctccagatcggtccngtcccagctgcanctgcaggtcgtcgggccaggctaggngacgccgttacggacgtaccccgtgtccccnacctgactacgtagtctcgtggtcgtcctccagtcagtcagtctacgttaacttcgttcggggcctggacctccgccacggcccgaagggtacggctagggagtacggtagttagggtacttacgtaaccgaggtaacgggttggaaccgtacctaacgtaccgtaacccgtaccgttaaccaaacggtaaacggtcgtaacgcgtaacctaagtaccggtaccgtaacgtaacctaacgtaaccgaacgtaaacctacgtttccctaacgacgtacgtctaggaacgtcgttagtccggaacgtaccggcaacgagacccgtcgacttagttactacgttcacggtcgtccgacgggtacccgagtaccgtcggtacggtacgtttacgttgtacggttaccgtttcgtaaggtaaccgttgggttaaccggtaccgggaaacggtccggttaaacggacggtttaccggaacccgtttaccgggcctttaacccggg

SEQ ID NO: 233229 - DNA, 943 bp, Homo sapiens
  misc_feature: GYAE6OF02HX9WY.48.73.G07.1.454.CMB.1.raw
tcagagtatacatacacgaccggtgctcgatttagctctacgctcagggggctttctgagagtcatggatctcatgtgcaagaaaatgaagcacctgtggttcttcctcctgctggtggcggctccagatgggtcctgtcccagctgcagctgcaggagtcgggccagggactgggtgaagccgtttacgggacgaccccgttcggtcccctccgaccgttgacctacttcggtccttacgttcgggttcgggccttacccgaagttccgacggtaccgtaggactacggtttaaccttttacggtttccgtgggggtcctgggacgttccccggacccgaccggtcccccggaagggggtaacggggcgttagggacggttaggggtaggttcggggtaacgtttaaccgtttaacccgacggtacgggttacgggaacgttaacccgtaacccgttaaaccggtaacccgtaaacccccgtttccccggtaaaacgtaaaaacgggttcccggaaacgggtcccaaaccgttaagtttaaccgtacccgggttaaacgtaaccctaaacccggttaacccgaaaaccggtttaaaaacccttaacgtttaccccgttaacccttacggggtaaaccgtccggtttaacggtaacccggtactttccgttaccgggtaccgacccccgggtacccgaccggaaaccggtaaccggtaacccgggttcccgttaacggttacccttttaaacggtttaacccgttcgggttaaccgtacccggggtaacccgggtccccggtaacggacccgggtaaccggtttacggttccggtttaaccgttttttgacgtttcggtacccgttttaggtaacgtttaggtcgggtacggggtaacccggtaagggtaccgttagtccggtaacctccgtttacgtacccg

SEQ ID NO: 233230 - DNA, 786 bp, Homo sapiens
  misc_feature: GYAE6OF02FXPV7.48.73.G07.1.454.CMB.1.raw
  modified_base (130)..(130): a, c, t, g, unknown or other
  misc_feature (130)..(130): n is a, c, g, or t
tcagagtatacatacacgaccggtgctcgatttagctctacgctcagggggctttctgagagtcatggatctcatgtgcaaagaaaatgaagcacctgtggttcttcctcctgctggtggcgctcccagntggtcctgtcccagctgcagctgcaggagtccggccaggactgggtagaacgtccttcggactacccttgtcccctacgaccgttagcctacgttcgtccttcgtagggtccgccttacgattaccgacggtccaggtccttacgttacttaccgttcggtacgggtcgttacggtaccgtccccgtaccggacccgtacccccgggaaggggtaccggggttcgtaacggggtcgggttaggtacggtttaggggtaacctttaacgttaacccggaggttacgggtacgggtacgtacccttaacccgtaaccgtaacccgtaaccccgttacctaacggtaaaacggtcggaacgtacctaaaccgtagttacgtaccggtaacgaccgtaaccggtaccaaacgtaaccctacttaccgaccttaggactcgtagacgtctcgtggtaccgtaccgccgtagacgtcgacgttctagtaccttaggttcgcggtacgtccggaccgtccgagtaccgtacgtcggtttacggtttactttcggtaccttccggttaacgtttacggtacggttcggttaccgggtaaccggtaacggtaaccggtaacggttaacggtccggtttaacccttacccggttacgtttaacccg

SEQ ID NO: 233231 - DNA, 649 bp, Homo sapiens
  misc_feature: GYAE6OF02FQG8X.48.73.G07.1.454.CMB.1.raw
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggacgaccctgtccctcacctgccactgtctctggtgctccatcagcagcagtacttactcgtgggctggatccgccacgccccccgaggggaacggggctagggacggttggacgttcggggagttacttttaccacgtaggtagggacgctaccgtactaaccgaaccccgtccctacgaaacggttcgaggaccaactatactaccgtaagacctacgtaccaaagaaccctatcccgtcctagaacgctaggacgtctcgtgtacgcccgaccgacgtacgacgacggtcctagtacttacttacgtgtcgtacggacccggtcccgacgccgacgtcggtcgttcgtttttacgacttcgtcccgttttaagacgtttaggttacgggttaccggggtacccgtaaacgggggtactaaccgggttacgggtttaccgacccggttcctttaacccgg

SEQ ID NO: 233232 - DNA, 823 bp, Homo sapiens
  misc_feature: GYAE6OF02I4DDS.48.73.G07.1.454.CMB.1.raw
tcagagtatacatacacgaccggtgctcgatttagctctacgctcagggggctttcttagagtcatggatctcatgtgcaagaaaatgaagcacctgtggttcttcctcctgctggtggcggctcccgagagtcgggtcctgtcccagctgcagctaggcagggtacgtccgggcccagggtacctgggtacgaacggtcccgtttacggaacgtacccccgttcgtccccctacgtacccgtgcctacgttcgttcctcggttacgggtccggtaccttaccgtactacgacgtaccgacgtacctaagtttacctttacgttcggtacggggtctcggaccgtcccgaccgacccggaccccgggaggggtaacgggtcggtaggagggtcgggtaggttacgggtaacgtttaccgttaccgacggtagggtaccggtaacgaccctaaccgttaaccgttaaccccgtaacccgttacccgtaaacgtaaacggtccggaacgtaccaaccgtaacgtaccgtacggtaacgaaccgtaaccgtaacccaaacggtaaacccttactttacccgtaccgtacgaacgtacgtacggtacgtaccgttcggtacggtaccggaccgtccgacgtaaccgaccgtacgtcgttacgtacttacgttacgtcggtacgtaccggcccggaccgtcgtccgtacggtacgttcggtttagtacgtcttccggttgttacgtcgggttacggttcggggtaacggtaaccggtaacggtaacggttcggtaaccgttccgtaccgtttccgtaaccgttcccgg

SEQ ID NO: 233233 - DNA, 804 bp, Homo sapiens
  misc_feature: GYAE6OF02HB46B.48.73.G07.1.454.CMB.1.raw
tcagagtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcgaggacgtcgggcccaggactggtgaacgccgttcggacgtaccctcgtccctcacctgctactgtctcgtgggtcgcctccatcgagcagctagttaccttacgttcggtgggctggacgtcccgccgaccggacccccggaggggaacggggtcgtagggtaggtacgggtaggttacggggtacgtttaacgtttaccgaacggtagggtacgggacgaccgtacccgttaaccgtaacccgtaaccccgttacctaaacgtaaacggtccgaaccggtacctaaccgtaacgttaaccgtaccggtaacgtaacccgtaacccgttaacccgaaaacgtaaacccttaacctttacccgtacccgtaacggtaacgtcgtacggcgttacctcggtacggtaccggaccccggccggtacgaacggtacctaccgggtacttcgttacttaccgttacgtgggtaccggccggtaacccgggtccccggaaggtccgtaacggttcggtttacggtttacgttttacgacgtttaccggttcggtttaaacggtacgttacggggttacggggtaaccggggtaacggtaaacgggtacggttaaccggttccgggtaacccgttacccgtttcccgtttaacgg

SEQ ID NO: 233234 - DNA, 826 bp, Homo sapiens
  misc_feature: GYAE6OF02F83KG.48.73.G07.1.454.CMB.1.raw
  modified_base (191)..(191): a, c, t, g, unknown or other
  misc_feature (191)..(191): n is a, c, g, or t
tcagagtatacatacacgaccggtgctcgatttagctctacgctcagggggctttctgagagtcatggatctcatggtgacaaagaaaatgaagcacctgtggttcttcctctgctggtggcggctcccagatcgggtccttacgcccagtctgcagcttgcgaggacggtccgggaccaggtatgggtanaacgtccgttggacgacccttcgtccccttcaccgtcgacctacgttggtccttcgtacgggtcggccttaccatccaggtccacgtcgtaacgttacccttacgtttccggtcgggtactcggtaccgtacccggacccgaccgggtaccccgggaaggggggaacggggtcgttagggtacgggttaggtaacggtttaggggaacgttaaccgtttaaccgacgtacgggggtacgggaaactccctaaaccgtaaccgttaacccgaaaccccggtacctaacgaaaacgtcgggacgaacctacgtaacgtacgttaacccggtaataccgtaaaccgaacccgtaaaagaacctaagttcccgtaaccgtacgacgtaccaggtacgacgtacgtggtaccggacccgacggacgtaacggaccgtacgtaccgtcgttaacctattaacgtcggtacgaccggtaacggcccggaacggaccgtacggtacggttacgttttaccggtttacgtacgtttcggttaccgtttaagggttaacgttcgggttaacggtaccgggtaaacccgtaaaggggttaccttaaaacgggttccggtttaacgttaacccggttccgttaaccg

SEQ ID NO: 233235 - DNA, 209 bp, Homo sapiens
  misc_feature: GYAE6OF01CXY91.48.40.D07.1.454.CMB.1.raw
  modified_base (209)..(209): a, c, t, g, unknown or other
  misc_feature (209)..(209): n is a, c, g, or t
tcagagtatacatacacgaccggtgctcgatttagtgatagagcgtaacaacagagggagggagtagagtcctgaggactgtaggacagcccatcggtcttcccctggcaccctcctccaagagcacctctggggcacagcggccctgggctgcctggtcaaggactacttcctatgtatactctgagcgggctggcaaggcgcatagn

SEQ ID NO: 233236 - DNA, 211 bp, Homo sapiens
  misc_feature: GYAE6OF01B5QW4.48.40.D07.1.454.CMB.1.raw
  modified_base (210)..(211): a, c, t, g, unknown or other
  misc_feature (210)..(211): n is a, c, g, or t
tcagagtatacatacacgaccggtgctcgatttagtgatagagcgtaacaacagaggggagggagtagagtcctgaggactgtaggacagcccatcggtcttcccctggcaccctcctccaagagcacctctggggcacagcggccctgggctgcctggtcaaggactacttcctatgtatactctgagcgggctggcaaggcgcatagnn

SEQ ID NO: 233237 - DNA, 212 bp, Homo sapiens
  misc_feature: GYAE6OF01B7I5K.48.40.D07.1.454.CMB.1.raw
  modified_base (211)..(212): a, c, t, g, unknown or other
  misc_feature (211)..(212): n is a, c, g, or t
tcagagtatacatacacgaccggtgctcgatttagtgatagagcgtaacaacagaggggagggagtagagtcctgaggactgtaggacagcccatcggtcttcccctggcaccctcctccaagagcacctctgggggcacagcggccctgggctgcctggtcaaggactacttcctctctcgactctgagcgggctggcaaggcgcatagnn

SEQ ID NO: 233238 - DNA, 138 bp, Homo sapiens
  misc_feature: GYAE6OF01AILCZ.48.40.D07.1.454.CMB.1.raw
  modified_base (136)..(138): a, c, t, g, unknown or other
  misc_feature (136)..(138): n is a, c, g, or t
tcagagtatacatacacgaccggtgctcgatttagtgatagagcgtaacaacagagggcacgaccggtgctcgatttagtgatagagcgtaacaacagagggcctatcccctgagcgggctggcaaggcgcatagnnn

SEQ ID NO: 233239 - DNA, 213 bp, Homo sapiens
  misc_feature: GYAE6OF02IHFP1.48.40.D07.1.454.CMB.1.raw
  modified_base (210)..(213): a, c, t, g, unknown or other
  misc_feature (210)..(213): n is a, c, g, or t
tcagagtatacatacacgaccggtgctcgatttagtgatagagcgtaacaacagaggggagggagtagagtcctgaggactgtaggacagcccatcggtcttcccctggcaccctcctccaagagcacctctggggcacagcggccctgggctgcctggtcaaggactacttcctatgtatactctgagcgggctggcaaggcgcatagnnnn

SEQ ID NO: 233240 - DNA, 216 bp, Homo sapiens
  misc_feature: GYAE6OF02H8C1R.48.40.D07.1.454.CMB.1.raw
  modified_base (210)..(216): a, c, t, g, unknown or other
  misc_feature (210)..(216): n is a, c, g, or t
tcagagtatacatacacgaccggtgctcgatttagtgatagagcgtaacaacagaggggagggagtagagtcctgaggactgtaggacagcccatcggtcttcccctggcaccctcctccaagagcacctctggggcacagcggccctgggctgcctggtcaaggactacttcctctctcgactctgagcgggctggcaaggcgcatagnnnnnnn

SEQ ID NO: 233241 - DNA, 218 bp, Homo sapiens
  misc_feature: GYAE6OF02I8K9S.48.40.D07.1.454.CMB.1.raw
  modified_base (211)..(218): a, c, t, g, unknown or other
  misc_feature (211)..(218): n is a, c, g, or t
tcagagtatacatacacgaccggtgctcgatttagtgatagagcgtaacgaacagaggggagggagtagagtcctgaggactgtaggacagcccatcggtcttcccctggcaccctcctccaagagcacctctggggcacagcggccctgggctgcctggtcaaggactacttcctatgtatactctgagcgggctggcaaggcgcatagnnnnnnnn

SEQ ID NO: 233242 - DNA, 212 bp, Homo sapiens
  misc_feature: GYAE6OF02FITR7.48.40.D07.1.454.CMB.1.raw
  modified_base (210)..(212): a, c, t, g, unknown or other
  misc_feature (210)..(212): n is a, c, g, or t
tcagagtatacatacacgaccggtgctcgatttagtgatagagcgtaacaacagaggggagggagtagagtcctgaggactgtaggacagcccatcggtcttcccctggcaccctcctccaagagcacctctggggcacagcggccctgggctgcctggtcaaggactacttcctatgtatactctgagcgggctggcaaggcgcatagnnn

SEQ ID NO: 233243 - DNA, 212 bp, Homo sapiens; identical to SEQ ID NO: 233242
  misc_feature: GYAE6OF02HG5SE.48.40.D07.1.454.CMB.1.raw
  modified_base (210)..(212): a, c, t, g, unknown or other
  misc_feature (210)..(212): n is a, c, g, or t

SEQ ID NO: 233244 - DNA, 227 bp, Homo sapiens
  misc_feature: GYAE6OF02GVX68.48.40.D07.1.454.CMB.1.raw
  modified_base (211)..(227): a, c, t, g, unknown or other
  misc_feature (211)..(227): n is a, c, g, or t
tcagagtatacatacacgaccggtgctcgatttagtgatagagcgtaacaacagaggggagggagtagagtcctgaggactgtaggacagcccatcggtcttcccctggcaccctcctccaagagcacctctggggcacagcggccctgggctgcctggtcaaggactacttcctatgtatactctgagcgggctggcaaggcgcagtagnnnnnnnnnnnnnnnnn

SEQ ID NO: 233245 - DNA, 247 bp, Homo sapiens
  misc_feature: GYAE6OF01CCEBB.39.86.H09.1.454.CMB.1.raw
  modified_base (244)..(247): a, c, t, g, unknown or other
  misc_feature (244)..(247): n is a, c, g, or t
tcagtcgcactagtcacgaccggtgctcgatttagtgctatagacttgggtttgggggtttggtggtctccactcccgccttgacgaggctgattattactgcagctcatttgcaatcagtgaggcttatgtcttcggaagtggaccaaggtcatcgtcctaggtcagcccaaggccaaccccactgtcactctgttcccgcctcctcactagtgcgactgagcgggctggcaaggcgcatagnnnn

SEQ ID NO: 233246 - DNA, 248 bp, Homo sapiens
  misc_feature: GYAE6OF01BW6Z1.39.86.H09.1.454.CMB.1.raw
  modified_base (246)..(248): a, c, t, g, unknown or other
  misc_feature (246)..(248): n is a, c, g, or t
tcagtcgcactagtcacgaccggtgctcgatttagtgctatagacttgggtttgggggtttggtggtctccactcccgccttgacgaggctgattattactgcagctcatttgcaatcagtgaggcttatgtcttcggaagtgggaccaaggtcatcgtcctaggtcagcccaaggccaaccccactgtcactctgttcccgccctcctcactagtgcgactgagcgggctggcaaggcgcatagnnn

SEQ ID NO: 233247 - DNA, 249 bp, Homo sapiens
  misc_feature: GYAE6OF01B54Y7.39.86.H09.1.454.CMB.1.raw
  modified_base (246)..(249): a, c, t, g, unknown or other
  misc_feature (246)..(249): n is a, c, g, or t
tcagtcgcactagtcacgaccggtgctcgatttagtgctatagacttgggtttgggggtttggtggtctccactcccgccttgacgaggctgattattactgcagctcatttgcaatcagtgaggcttatgtcttcggaagtgggaccaaggtcatcgtcctaggtcagcccaaggccaaccccactgtcactctgttcccgccctcctcactagtgcgactgagcgggctggcaaggcgcatagnnnn

SEQ ID NO: 233248 - DNA, 246 bp, Homo sapiens
  misc_feature: GYAE6OF01BX8RL.39.86.H09.1.454.CMB.1.raw
  modified_base (245)..(246): a, c, t, g, unknown or other
  misc_feature (245)..(246): n is a, c, g, or t
tcagtcgcactagtcacgaccggtgctcgatttagtgctatagacttgggtttggggtttggtggtctccactcccgccttgacgaggctgattattactgcagctcatttgcaatcagtgaggcttatgtcttcggaagtgggaccaaggtcatcgtcctaggtcagcccaaggccaaccccactgtcactctgttcccgccctcctcactagtgcgactgagcgggctggcaaggcgcatagnn

SEQ ID NO: 233249 - DNA, 245 bp, Homo sapiens
  misc_feature: GYAE6OF01D6I3Z.39.86.H09.1.454.CMB.1.raw
  modified_base (244)..(245): a, c, t, g, unknown or other
  misc_feature (244)..(245): n is a, c, g, or t
tcagtcgcactagtcacgaccggtgctcgatttagtgctatagacttgggtttggggtttggtggtctccactcccgccttgacgaggctgattattactgcagctcatttgcaatcagtgaggcttatgtcttcggaagtgggaccaaggtcatcgtcctaggtcagcccaaggccaacccactgtcactctgttcccgccctcctcactagtgcgactgagcgggctggcaaggcgcatagnn

SEQ ID NO: 233250 - DNA, 249 bp, Homo sapiens
  misc_feature: GYAE6OF01CVJ62.39.86.H09.1.454.CMB.1.raw
  modified_base (246)..(249): a, c, t, g, unknown or other
  misc_feature (246)..(249): n is a, c, g, or t
tcagtcgcactagtcacgaccggtgctcgatttagtgctatagacttgggtttgggggtttggtggtctccactcccgccttgacgaggctgattattactgcagctcatttgcaatcagtgaggcttatgtcttcggaagtgggaccaaggtcatcgtcctaggtcagcccaaggccaaccccactgtcactctgttcccaccctcctcactagtgcgactgagcgggctggcaaggcgcatagnnnn

SEQ ID NO: 233251 - DNA, 248 bp, Homo sapiens
  misc_feature: GYAE6OF01EYNNR.39.86.H09.1.454.CMB.1.raw
  modified_base (246)..(248): a, c, t, g, unknown or other
  misc_feature (246)..(248): n is a, c, g, or t
tcagtcgcactagtcacgaccggtgctcgatttagtgctatagacttgggtttgggggtttggtggtctccactcccgccttgacgaggctgattattactgcagctcatttgcaatcagtgaggcttatgtcttcggaagtgggaccaaggtcatcgtcctaggtcagcccaaggccaaccccactgtcactctgttcccaccctcctcactagtgcgactgagcgggctggcaaggcgcatagnnn

SEQ ID NO: 233252 - DNA, 248 bp, Homo sapiens; identical to SEQ ID NO: 233251
  misc_feature: GYAE6OF01DORXL.39.86.H09.1.454.CMB.1.raw
  modified_base (246)..(248): a, c, t, g, unknown or other
  misc_feature (246)..(248): n is a, c, g, or t

SEQ ID NO: 233253 - DNA, 248 bp, Homo sapiens
  misc_feature: GYAE6OF01CCO3S.39.86.H09.1.454.CMB.1.raw
  modified_base (245)..(248): a, c, t, g, unknown or other
  misc_feature (245)..(248): n is a, c, g, or t
tcagtcgcactagtcacgaccggtgctcgatttagtgctatagacttgggtttggggtttggtggtctccactcccgccttgacgaggctgattattactgcagctcatttgcaatcagtgaggcttatgtcttcggaagtgggaccaaggtcatcgtcctaggtcagcccaaggccaaccccactgtcactctgttcccaccctcctcactagtgcgactgagcgggctggcaaggcgcatagnnnn

SEQ ID NO: 233254 - DNA, 245 bp, Homo sapiens; identical to SEQ ID NO: 233249
  misc_feature: GYAE6OF01ED5P9.39.86.H09.1.454.CMB.1.raw
  modified_base (244)..(245): a, c, t, g, unknown or other
  misc_feature (244)..(245): n is a, c, g, or t

SEQ ID NO: 233255 - DNA, 247 bp, Homo sapiens
  misc_feature: GYAE6OF01CV5N8.39.86.H09.1.454.CMB.1.raw
  modified_base (245)..(247): a, c, t, g, unknown or other
  misc_feature (245)..(247): n is a, c, g, or t
tcagtcgcactagtcacgaccggtgctcgatttagtgctatagacttgggtttgggggtttggtggtctccactcccgccttgacgaggctgattattactgcagctcatttgcaatcagtgaggcttatgtcttcggaagtgggaccaaggtcatcgtcctaggtcagcccaaggccaaccccactgtcactctgttcccgcctcctcactagtgcgactgagcgggctggcaaggcgcatagnnn

SEQ ID NO: 233256 - DNA, 157 bp, Homo sapiens
  misc_feature: GYAE6OF01CS2ZR.39.86.H09.1.454.CMB.1.raw
  modified_base (155)..(157): a, c, t, g, unknown or other
  misc_feature (155)..(157): n is a, c, g, or t
tcagtcgcactagtcacgaccggtgctcgatttagtgctatagacttgggtttgggggaagaggaagactgacggtcctgccacagcggccctgggctgcctggtcaaggactacttccactagtgcgactgagcgggctggcaaggcgcatagnnn

SEQ ID NO: 233257 - DNA, 252 bp, Homo sapiens
  misc_feature: GYAE6OF01CTRSI.39.86.H09.1.454.CMB.1.raw
  modified_base (246)..(252): a, c, t, g, unknown or other
  misc_feature (246)..(252): n is a, c, g, or t
tcagtcgcactagtcacgaccggtgctcgatttagtgctatagacttgggtttgggggtttggtggtctccactcccgccttgacgaggctgattattactgcagctcatttgcaatcagtgaggcttatgtcttcggaagtgggaccaaggtcatcgtcctaggtcagcccaaggccaaccccactgtcactctgttcccaccctcctcactagtgcgactgagcgggctggcaaggcgcatagnnnnnnn

SEQ ID NO: 233258 - DNA, 250 bp, Homo sapiens
  misc_feature: GYAE6OF01DNRLT.39.86.H09.1.454.CMB.1.raw
  modified_base (246)..(250): a, c, t, g, unknown or other
  misc_feature (246)..(250): n is a, c, g, or t
tcagtcgcactagtcacgaccggtgctcgatttagtgctatagacttgggtttgggggtttggtggtctccactcccgccttgacgaggctgattattactgcagctcatttgcaatcagtgaggcttatgtcttcggaagtgggaccaaggtcatcgtcctaggtcagcccaaggccaaccccactgtcactctgttcccaccctcctcactagtgcgactgagcgggctggcaaggcgcatagnnnnn

SEQ ID NO: 233259 - DNA, 495 bp, Homo sapiens
  misc_feature: GYAE6OF01DNXLP.39.86.H09.1.454.CMB.1.raw
  modified_base (485)..(485): a, c, t, g, unknown or other
  misc_feature (485)..(485): n is a, c, g, or t
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaactcatcatttatgaggtcagtaatcggccctcaggggtttctaaatcgcttctctggctccaagtctggcaacacggcctcctgaccatctctgggctcaggctgagacgaggctgattattactgcagctcatttgctaatcagtgaggtcttatgtcttggaagtgggaccaaggtcatcgtactaggtcngcccaaacgg

SEQ ID NO: 233260 - DNA, 249 bp, Homo sapiens; identical to SEQ ID NO: 233247
  misc_feature: GYAE6OF01AQDR3.39.86.H09.1.454.CMB.1.raw
  modified_base (246)..(249): a, c, t, g, unknown or other
  misc_feature (246)..(249): n is a, c, g, or t

SEQ ID NO: 233261 - DNA, 156 bp, Homo sapiens
  misc_feature: GYAE6OF01DI9WT.39.86.H09.1.454.CMB.1.raw
  modified_base (155)..(156): a, c, t, g, unknown or other
  misc_feature (155)..(156): n is a, c, g, or t
tcagtcgcactagtcacgaccggtgctcgatttagtgctatagacttgggtttgggggaagaggaagactgacggtcctgccacagcggccctgggctgcctggtcaaggactacttccactagtgcgactgagcgggctggcaaggcgcatagnn

SEQ ID NO: 233262 - DNA, 252 bp, Homo sapiens
  misc_feature: GYAE6OF01BGILY.39.86.H09.1.454.CMB.1.raw
  modified_base (246)..(252): a, c, t, g, unknown or other
  misc_feature (246)..(252): n is a, c, g, or t
tcagtcgcactagtcacgaccggtgctcgatttagtgctatagacttgggtttgggggtttggtggtctccactcccgccttgacgaggctgattattactgcagctcatttgcaatcagtgaggcttatgtcttcggaagtgggaccaaggtcatcgtcctaggtcagcccaaggccaaccccactgtcactctgttcccgccctcctcactagtgcgactgagcgggctggcaaggcgcatagnnnnnnn

SEQ ID NO: 233263 - DNA, 249 bp, Homo sapiens; identical to SEQ ID NO: 233247
  misc_feature: GYAE6OF01EROQG.39.86.H09.1.454.CMB.1.raw
  modified_base (246)..(249): a, c, t, g, unknown or other
  misc_feature (246)..(249): n is a, c, g, or t

SEQ ID NO: 233264 - DNA, 522 bp, Homo sapiens
  misc_feature: GYAE6OF01DPJ9U.39.86.H09.1.454.CMB.1.raw
  modified_base (307)..(307): a, c, t, g, unknown or other
  misc_feature (307)..(307): n is a, c, g, or t
tcagtcgcactagtcacgaccggtgctcgatttagtgctatagacttgggtttgggggctggggtctcaggaggcagcgctctcaggacatctccaccatggcctgggctctgctgctcctcacctcctcactcagggcacagggtcctgggcccagtctgccctgactcaggctgcctccgtgtctgggtctctaggacagtcgatcaccatctcctgcactggaaccagcagtgacgttggggttatgactatgtctcctggtaccagcaatatccaggcacacgcccccaaactcatcatttangagtcagtaatcggccctgagggtttctaagtcgtcttctctggctcaagtctggcaacacggcctcccgtgaccatctcgtcggctccgaggctggaggacgaggtctagtatttattactgactaggtccttctatttcgactaagtcgagtgaggtcttagtgttcgttacggaaggtcgggaactaggtcagttccgtctaggtcaaccgg

SEQ ID NO: 233265 - DNA, 251 bp, Homo sapiens
  misc_feature: GYAE6OF01B3ML8.39.86.H09.1.454.CMB.1.raw
  modified_base (246)..(251): a, c, t, g, unknown or other
  misc_feature (246)..(251): n is a, c, g, or t
tcagtcgcactagtcacgaccggtgctcgatttagtgctatagacttgggtttgggggtttggtggtctccactcccgccttgacgaggctgattattactgcagctcatttgcaatcagtgaggcttatgtcttcggaagtgggaccaaggtcatcgtcctaggtcagcccaaggccaaccccactgtcactctgttcccaccctcctcactagtgcgactgagcgggctggcaaggcgcatagnnnnnn

SEQ ID NO: 233266 - DNA, 251 bp, Homo sapiens
  misc_feature: GYAE6OF01BRH0F.39.86.H09.1.454.CMB.1.raw
  modified_base (247)..(251): a, c, t, g, unknown or other
  misc_feature (247)..(251): n is a, c, g, or t
tcagtcgcactagtcacgaccggtgctcgatttagtgctatagacttgggtttagggggtttggtggtctccactcccgccttgacgaggctgattattactgcagctcatttgcaatcagtgaggcttatgtcttcggaagtgggaccaaggtcatcgtcctaggtcagcccaaggccaaccccactgtcactctgttcccgccctcctcactagtgcgactgagcgggctggcaaggcgcatagnnnnn

SEQ ID NO: 233267 - DNA, 492 bp, Homo sapiens
  misc_feature: GYAE6OF01BNHHI.39.86.H09.1.454.CMB.1.raw
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaactcatcatttatgaggtcagtaatcggccctcaggggtttctaatcgcttctctggctcaagtctggcaacacggcctccctgaccatctctgggctccaggctgaggacgaggctgattattactgcagctcatttgactaatcagtgagtcttatgttcgtcggaagtgggaccaggtcagtcgtctaggcagcccaacgg

SEQ ID NO: 233268 - DNA, 248 bp, Homo sapiens; identical to SEQ ID NO: 233246
  misc_feature: GYAE6OF01CNOTL.39.86.H09.1.454.CMB.1.raw
  modified_base (246)..(248): a, c, t, g, unknown or other
  misc_feature (246)..(248): n is a, c, g, or t

SEQ ID NO: 233269 - DNA, 631 bp, Homo sapiens
  misc_feature: GYAE6OF01DL1AU.39.86.H09.1.454.CMB.1.raw
  modified_base (280)..(280): a, c, t, g, unknown or other
  misc_feature (280)..(280): n is a, c, g, or t
tcagtcgcactagtcacgaccggtgctcgatttagtgctatagacttgggttgggggtctcaggaggcagcgctctcaggacatctccaccatggcctgggctctgctgctccctccaccctcctcactcacgggcacgagggtccgtcgggcccgagtacgtcgccctagactcaggctgcctccgtgtctgggtctctaggacaggtcgatcaccatctcctgcactggaaccagcagtgagttggggtatgactatgtctcctggaccagcaatacncagcacaccaccctaatcatctattagagtagtacagtacgtccggcctagtacggttactaacgtcgtcttctcgtcgctacgtagtcgtacgaccaaccgaccgtccctaccgtaccgtacctactcgtcgtcggtccgtaccgtacggtacgtacggacgggacggtacggtacgtagttaacgttaacgttacgtacgtacgacgtacttacttagttacgtactaacgtacgtacggtaggtacggttacgttacgttacggttacggttacgggtaagggtacgggtaaccggtaacggtacgtacgtaccgttacgtaacggtaccgtaccgaacccggaaccg

SEQ ID NO: 233270 - DNA, 279 bp, Homo sapiens
  misc_feature: GYAE6OF01BIX41.39.86.H09.1.454.CMB.1.raw
  modified_base (250)..(279): a, c, t, g, unknown or other
  misc_feature (250)..(279): n is a, c, g, or t
tcagtcgcactagtcacgaccggtgctcgatttagtgctatagacttagggtttgggggtttggtggtctccactcccgccttgacgaggctgattattactgcagactcatttgcaatcagtgaggcttatgtcttcggaagtgggaccaaggtcatcgtcctaggtcagcccaaggccaaccccactgtcactctgttcccaccctcctcactacgtgccgactgagcgggctggcaaggcgcatagnnnnnnnnnnnnnnnnnnnnnnnnnnnnnn

SEQ ID NO: 233271 - DNA, 496 bp, Homo sapiens
  misc_feature: GYAE6OF01B1P5R.39.86.H09.1.454.CMB.1.raw
  modified_base (299)..(299): a, c, t, g, unknown or other
  misc_feature (299)..(299): n is a, c, g, or t
  modified_base (356)..(356): a, c, t, g, unknown or other
  misc_feature (356)..(356): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggtatgactatgtctcctggtaccagcaatatccaggcacagcccccaaactcatcatttangagtcagtaatcggcctcaggggtttcaatcgcttctctggctcaagtctggcaacncggcctccctgaccatctctgggctccgaggctgaggacgaggctgatttattactgcagctcatttgctaatcagtgaggtcttatgttcgttcgggaagttgggaccaaggtcagtcgtcctaggtccagcccaacgg

SEQ ID NO: 233272 - DNA, 248 bp, Homo sapiens; identical to SEQ ID NO: 233246
  misc_feature: GYAE6OF01BWMSN.39.86.H09.1.454.CMB.1.raw
  modified_base (246)..(248): a, c, t, g, unknown or other
  misc_feature (246)..(248): n is a, c, g, or t

SEQ ID NO: 233273 - DNA, 248 bp, Homo sapiens; identical to SEQ ID NO: 233251
  misc_feature: GYAE6OF01C82ZC.39.86.H09.1.454.CMB.1.raw
  modified_base (246)..(248): a, c, t, g, unknown or other
  misc_feature (246)..(248): n is a, c, g, or t

SEQ ID NO: 233274 - DNA, 508 bp, Homo sapiens
  misc_feature: GYAE6OF01B5GHQ.39.86.H09.1.454.CMB.1.raw
  modified_base (420)..(420): a, c, t, g, unknown or other
  misc_feature (420)..(420): n is a, c, g, or t
tcagtcgcactagtcacgaccggtgctcgatttagtgctatagacttgggtttggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggtatgactatgtctcctggtaccagcaatatccaggcacacgacccccaaatcatcatttatgaggtcagtaactcggaccctgtagggtttctaatcgtcttctctggctcaagtctggcaacgacggcctcctgacctatctctgggctcgaggctgacggacgaggctgattatacngcagctcatttcgactatcagtgagtcttattgtacgttcgggaagtcgggaccaaggtcaagtcgtacctaggtcaggcccaaacgg

SEQ ID NO: 233275 - DNA, 250 bp, Homo sapiens; identical to SEQ ID NO: 233258
  misc_feature: GYAE6OF01AISGS.39.86.H09.1.454.CMB.1.raw
  modified_base (246)..(250): a, c, t, g, unknown or other
  misc_feature (246)..(250): n is a, c, g, or t

SEQ ID NO: 233276 - DNA, 529 bp, Homo sapiens
  misc_feature: GYAE6OF01BLBOG.39.86.H09.1.454.CMB.1.raw
  modified_base (428)..(428): a, c, t, g, unknown or other
  misc_feature (428)..(428): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggttatgactatgtctcctggtaccagcaatatccaggcacagcccccaaatcatcatttatgaggtcagtaatccggcctcgtagggtttctaatcgcttctctggctcaagtctggcaacgacggcctcctgaccatctcgtcgggcctccgaggctggacggacgaggctgatttattactgcngtctactatttgactaatcgagtgaggtctttatggttccgttagggaagtcgggaacccaaggtcctagtccggtaccgtaggtcacggcccgaaaccgg

SEQ ID NO: 233277 - DNA, 519 bp, Homo sapiens
  misc_feature: GYAE6OF01BTTWA.39.86.H09.1.454.CMB.1.raw
tcagtcgcactagtcacgaccggtgctcgatttagtgctatagacttgggtttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaactcatcatttatgaggtcagtaatcggccctcaggggtttctaatcgcttctctggctccaagtctggcaacacggcctccctgaccatctctgggcctccgaggctggacggacgaggctgatttattactgcagctctatttgactaatcagtgaggtcttagtgttcgttacggaagtcgggacctaaggtcaagttccgtaccgtaggtcaacgcccgaaaccgg

SEQ ID NO: 233278 - DNA, 615 bp, Homo sapiens
  misc_feature: GYAE6OF01A1XR3.39.86.H09.1.454.CMB.1.raw
  modified_base (227)..(227): a, c, t, g, unknown or other
  misc_feature (227)..(227): n is a, c, g, or t
  modified_base (265)..(265): a, c, t, g, unknown or other
  misc_feature (265)..(265): n is a, c, g, or t
  modified_base (270)..(270): a, c, t, g, unknown or other
  misc_feature (270)..(270): n is a, c, g, or t
  modified_base (290)..(290): a, c, t, g, unknown or other
  misc_feature (290)..(290): n is a, c, g, or t
  modified_base (327)..(327): a, c, t, g, unknown or other
  misc_feature (327)..(327): n is a, c, g, or t
  modified_base (374)..(374): a, c, t, g, unknown or other
  misc_feature (374)..(374): n is a, c, g, or t
  modified_base (416)..(416): a, c, t, g, unknown or other
  misc_feature (416)..(416): n is a, c, g, or t
  modified_base (437)..(437): a, c, t, g, unknown or other
  misc_feature (437)..(437): n is a, c, g, or t
tcagtcgcactagtcacgaccggtgctcgatttagtgctatagacgtttggggtttgggggctggggtctcaggaggcagcgctctcaggacatctccaccatggcctgggctctgctgctcctcaccctcctcactcgagggccacgtgggtccgtcggggccctaggtcctaggccctgactcgaggctgcctcgtgtctgggtctcgaggacagtccatcaccntcctcctgacactggaacctgcagtgtaggttgggtangactntgctcgtgaccagctaatcnccgaaggccacaccacccctaaatcaatgtatttagngaacggtctagtacgtccggtcctagtcggtttacacgtcctcttcncgtgtactactagcgcggacaaccgcgtccctacacgtcctntccgtcggcggcctaacgggnggtacgaggacggacgtagtctattacgtttactcgcgtactactcttattacgttagacttagtacggtaggtacgtacgtttacgttacggttcgggttaccgggtagggtaaccgggttaccgaacccttacggttaccgtacccggtaccggtaccgtaccgacccgaaccccg

SEQ ID NO: 233279 - DNA, 420 bp, Homo sapiens
  misc_feature: GYAE6OF01C8HRM.39.86.H09.1.454.CMB.1.raw
  modified_base (413)..(420): a, c, t, g, unknown or other
  misc_feature (413)..(420): n is a, c, g, or t
tcagtcgcactagtcacgaccggtgctcgatttagtgctatagacttgggtttgggggctgtgcctggatattgctggaaccagcagtgacgttggggttatgactatgtctcctggtaccagcaatatccaggcacagcccccaaactcatcatttatgaggtcagtaatcggccctcaggggtttctaatcgcttctctggctccaagtctggcaacacggcctccctgacccatctctgggctccaggctgaggacgaggctgattattactgcagctcatttgcaatcagtgagcttatgtcttcggaagtgggaccaaggtcatcgtctaggtcagcccaaggccaacccactgcactctgttcccacctctcactgtgcgactgagcgggctggcaaggcgcatagnnnnnnnn

SEQ ID NO: 233280 - DNA, 247 bp, Homo sapiens
  misc_feature: GYAE6OF01D1CF6.39.86.H09.1.454.CMB.1.raw
  modified_base (246)..(247): a, c, t, g, unknown or other
  misc_feature (246)..(247): n is a, c, g, or t
tcagtcgcactagtcacgaccggtgctcgatttagtgctatagacttgggtttgggggtttggtggtctccactcccgccttgacgaggctgattattactgcagctcatttgcaatcagtgaggcttatgtcttcggaagtgggaccaaggtcatcgtcctaggtcagcccaaggccaaccccactgtcactctgttcccaccctcctcactagtgcgactgagcgggctggcaaggcgcatagnn

SEQ ID NO: 233281 - DNA, 248 bp, Homo sapiens; identical to SEQ ID NO: 233246
  misc_feature: GYAE6OF01C8WNN.39.86.H09.1.454.CMB.1.raw
  modified_base (246)..(248): a, c, t, g, unknown or other
  misc_feature (246)..(248): n is a, c, g, or t

SEQ ID NO: 233282 - DNA, 513 bp, Homo sapiens
  misc_feature: GYAE6OF01DZ767.39.86.H09.1.454.CMB.1.raw
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaactcatcatttatgaggtcagtaatcggccctcaggggtttctaatcgcttctctggctccaagtctggcaacacggcctccctgaccatctctgggcctccgaggctggaggacgaggctgatttattactgcagctctatttgctaatcagttgaggtcttatgttcgttacgggaagtgggaaccaaggtcagtcgtacctaggtcagcccaaaccgg

SEQ ID NO: 233283 - DNA, 560 bp, Homo sapiens
  misc_feature: GYAE6OF01B1U84.39.86.H09.1.454.CMB.1.raw
  modified_base (387)..(387): a, c, t, g, unknown or other
  misc_feature (387)..(387): n is a, c, g, or t
tcagtcgcactagtcacgaccggtgctcgatttagtgctatagacttgggtttggggggggttcggtcaggagggcagcgctctcaggacatctccaccatggcctgggctctgctgctcctcaccctcctcactcagggcacagggtccgtgggcccagtctgccctgactcaggctgcctccgtgtctgggtctctaggacagtcgatcaccatctcctgcactggaaccagcagtgacgttgggggttatgactatgtctcctggtaccagcaatatccaggcacacgcccccaaactcatcatttatgaggtcagtaatccggccctcgaggggtttctaaatcgtcttctctggtctcaagtctggcaacacggcctccctnacccatctctgggcctccgaggctggaggacgaggctagatttatactgcagcttctatttgaccaatcagtgaggtactttagtgttccgttacggggaaagtcggggtaaacccaagggttctaacgttccggttacccgtaagggttcaaccgggccccctaaaaccggg

SEQ ID NO: 233284 - DNA, 249 bp, Homo sapiens; identical to SEQ ID NO: 233247
  misc_feature: GYAE6OF01EK4CW.39.86.H09.1.454.CMB.1.raw
  modified_base (246)..(249): a, c, t, g, unknown or other
  misc_feature (246)..(249): n is a, c, g, or t

SEQ ID NO: 233285 - DNA, 252 bp, Homo sapiens
  misc_feature: GYAE6OF01DK3TS.39.86.H09.1.454.CMB.1.raw
  modified_base (246)..(252): a, c, t, g, unknown or other
  misc_feature (246)..(252): n is a, c, g, or t
tcagtcgcactagtcacgaccggtgctcgatttagtgctatagacttggggtttgggggtttggtggtctccactcccgccttgacgaggctgattattactgcagctcatttgcaatcagtgaggcttatgtcttcggaagtgggaccaaggtcatcgtcctaggtcagcccaaggccaaccccatgtcactctgttcccaccctcctcactagtgcgactgagcgggctggcaaggcgcatagnnnnnnn

SEQ ID NO: 233286 - DNA, 547 bp, Homo sapiens
  misc_feature: GYAE6OF01BA3LW.39.86.H09.1.454.CMB.1.raw
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgccccccaaatcatcatttatgaggtcagtaatcggccctcgaggggtttctaatcgcttctctggctcaagtctggcaacgacgcctcctgaccatctcgtgggcctccgaggctggaggacgaggctgatttattactgcagtcttactatttcgactaatcgaggtgacgtcttaagtcgttacgttacgggtaaggttcggggaacctaagggtcctaagttccggttacccgttaagggtccacggtccccgtaaaccggg

SEQ ID NO: 233287 - DNA, 494 bp, Homo sapiens
  misc_feature: GYAE6OF01A87B4.39.86.H09.1.454.CMB.1.raw
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaactcatcatttatgagtcagtaatcggccctcaggggtttctaatcgcttctctggctccaagtctggcaacacggcctccctgaccatctctgggctccaggctgaggacgaggctgatttattactgcagctcatttgcaatcagtgaggtcttatgttcgttcggaagtgggaccaggtcagtcgtctaggcagcccgaacgg

SEQ ID NO: 233288 - DNA, 251 bp, Homo sapiens; identical to SEQ ID NO: 233265
  misc_feature: GYAE6OF01BTO5Q.39.86.H09.1.454.CMB.1.raw
  modified_base (246)..(251): a, c, t, g, unknown or other
  misc_feature (246)..(251): n is a, c, g, or t

SEQ ID NO: 233289 - DNA, 711 bp, Homo sapiens
  misc_feature: GYAE6OF01BSURO.39.86.H09.1.454.CMB.1.raw
  modified_base (162)..(162): a, c, t, g, unknown or other
  misc_feature (162)..(162): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgcccttancagcgtcgcctccgtcgtctggtcgtctaggacgagtcgactcaccactctcctcgcacctacggaaccgaacgcgacgtggtacggttgggggtttaggttgacgtaattgttcgtccctcggtaccgacgacgaataatccacggacgaccaacgacccccgaaaaccctacactactactttaattagaggtactacgtaaagttccggccccgttccgtaacgggggtttaccgttaactacggtcctttcttccttggtccgtaccctaagtcgtcggacaaaccaaccggcccgttcccctacggacccacttccttccgtcggggtccttccccagggcgttcggaaggggaccgacggtcgtgtaagtttaactttacctcggccaacgtccttccgttaagttttcggaccaaattcgaggtaggacggtctttaagttgttccgtttaccggggaaaggttacggggaacccgtaaaggttcacgtttaccggttcccgttaaacgggttccaacggtacccccgaagggtaacccccc

SEQ ID NO: 233290 - DNA, 249 bp, Homo sapiens
  misc_feature: GYAE6OF01EZULH.39.86.H09.1.454.CMB.1.raw
  modified_base (245)..(249): a, c, t, g, unknown or other
  misc_feature (245)..(249): n is a, c, g, or t
tcagtcgcactagtcacgaccggtgctcgatttagtgctatagacttgggtttgggggtttggtggtctccactcccgccttgacgaggctgattattactgcagctcatttgcaatcagtgaggcttatgtcttcggaagtgggaccaaggtcatcgtcctaggtcagcccaaggccaacccactgtcactctgttcccgccctcctcactagtgcgactgagcgggctggcaaggcgcatagnnnnn

SEQ ID NO: 233291 - DNA, 535 bp, Homo sapiens
  misc_feature: GYAE6OF01BWHQG.39.86.H09.1.454.CMB.1.raw
  modified_base (300)..(300): a, c, t, g, unknown or other
  misc_feature (300)..(300): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggtatgactatgtctctggtaccagacaatatccaggcacacgacccccaaatcatcatttangagtcagtaactcggcctgaggggtttctaagtcgtcttctctggctaccgaagtctggaccaacgaccggccctccctgacctatcctcgtcgggctccgaggctgaggacgaggcgtgtattatactgacagtctctattgactaagtcagtgtagtcttagtgttcgtacgggtaaggtcgggaacctaagggttcaagttccgtactaagggctaacgcccgtaaacccgg

SEQ ID NO: 233292 - DNA, 266 bp, Homo sapiens
  misc_feature: GYAE6OF01E5NLB.39.86.H09.1.454.CMB.1.raw
  modified_base (249)..(266): a, c, t, g, unknown or other
  misc_feature (249)..(266): n is a, c, g, or t
tcagtcgcactagtcacgaccggtgctcgatttagtgctatagacttgggtttagggggtttggtggtctccactcccgccttgacgaggctgattattactgccagctcatttgcgaatcagtgaggcttatgtcttcggaagtgggaccaaggtcatcgtcctaggtcagcccaaggccaaccccactgtcactctgttcccaccctcctcactagtgcgactgagcgggctggcaaggcgcatagnnnnnnnnnnnnnnnnnn

SEQ ID NO: 233293 - DNA, 247 bp, Homo sapiens
  misc_feature: GYAE6OF01DVAGP.39.86.H09.1.454.CMB.1.raw
  modified_base (245)..(247): a, c, t, g, unknown or other
  misc_feature (245)..(247): n is a, c, g, or t
tcagtcgcactagtcacgaccggtgctcgatttagtgctatagacttgggtttgggggtttggtggtctccactcccgccttgacgaggctgattattactgcagctcatttgcaatcagtgaggcttatgtcttcggaagtgggaccaaggtcatcgtcctaggtcagcccaaggccaacccactgtcactctgttcccaccctcctcactagtgcgactgagcgggctggcaaggcgcatagnnn

SEQ ID NO: 233294 - DNA, 250 bp, Homo sapiens; identical to SEQ ID NO: 233258
  misc_feature: GYAE6OF01CULVB.39.86.H09.1.454.CMB.1.raw
  modified_base (246)..(250): a, c, t, g, unknown or other
  misc_feature (246)..(250): n is a, c, g, or t

SEQ ID NO: 233295 - DNA, 516 bp, Homo sapiens
  misc_feature: GYAE6OF01AF39E.39.86.H09.1.454.CMB.1.raw
  modified_base (301)..(301): a, c, t, g, unknown or other
  misc_feature (301)..(301): n is a, c, g, or t
  modified_base (467)..(467): a, c, t, g, unknown or other
  misc_feature (467)..(467): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggttatgactatgtctcctggtaccagcaatatccaggcacacgacccccaaatcatcatttangagtcagtaatccggccctcgtaggggtttctaagtcgtcttctcgtcggctcaagtctggaccaacgacggccctccctgaccatctcgtcgggctccgaggcctaggacggacgaggctagtatttattactgctagtctctagtttgactaatcgagtgagtnttagtgtcgttaggagtcggacaggtcagtcgtactagcacgccgaacg

SEQ ID NO: 233296 - DNA, 498 bp, Homo sapiens
  misc_feature: GYAE6OF01BNDF8.39.86.H09.1.454.CMB.1.raw
  modified_base (300)..(300): a, c, t, g, unknown or other
  misc_feature (300)..(300): n is a, c, g, or t
  modified_base (425)..(425): a, c, t, g, unknown or other
  misc_feature (425)..(425): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggttatgactatgtctcctggtaccagcaatatccaggcacagcccccaaactcatcatttangaggtcagtaatcggcctcgaggggtttctaatcgcttctctggctccaagtctggcaacacggcctcctgaccatctcgtgggctccgaggtctggagacgagctagatttatactgcagctanatttgctaatcagtcgaggtcttagtgttcgtggagtcgggaccaggtcagtcgtactaggtcagcccgaacg

SEQ ID NO: 233297 - DNA, 290 bp, Homo sapiens
  misc_feature: GYAE6OF01DLPZC.39.86.H09.1.454.CMB.1.raw
  modified_base (245)..(245): a, c, t, g, unknown or other
  misc_feature (245)..(245): n is a, c, g, or t
  modified_base (251)..(290): a, c, t, g, unknown or other
  misc_feature (251)..(290): n is a, c, g, or t
tcagtcgcactagtcacgaccggtgctcgatttagtgctatagacttgggtttgggggttggtggtctccactcccgccttgacgaggctgtattattacttgctagctcatttgcaatcagtgaggcttatgtcttcgggaagtgggaccaaggtcatcgtcctaggtcagcccaaggccaaacccctactgtcactctgttcccgcctcctcactagtgcgactggagcggctggcaagggcncatagnnnnnnnnnnnnnnnnnnnnnnnnnnnnnnnnnnnnnnnn

SEQ ID NO: 233298 - DNA, 536 bp, Homo sapiens
  misc_feature: GYAE6OF01CH8T7.39.86.H09.1.454.CMB.1.raw
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgacccccaaactcatcatttatgagtcagtatcggcctcgagggtttctaatcgcttctctgctcagtctgcaacacgcctcctcgaccatctcgtgggcctccgaggctggacggacgagctgatttattacgtgcacgtctctatttgactaatcgtagtgtaggtctttagtgttcgttacgggtaaggttcgggaacctaagggtctacgttccggtaccgttaggtccaccgaccccgtaaaccgg

SEQ ID NO: 233299 - DNA, 622 bp, Homo sapiens
  misc_feature: GYAE6OF01D6MVE.39.86.H09.1.454.CMB.1.raw
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttggggttatgactatgtctccgtggtaccagacaatactccaggcaacaccgacccccaaactcatctaatttatggaggtcaagtaactccggtccctggtacggggtttactaagtccgtcttcctcgtcggtcctaccgaagttccgtggacccaaaccgaccggtccccttcccgtacgaaccctacttccgtcgtcgggcctccgaggctaggacggacgaggtctagtatttagttacgtgcacgtcttcgtatttcgactaagtcgaggtacggtagttcttagttcggttaccgttacgggtaacggttacggggaaccctaaagggttcctaacgttccggttacgtagggtcccaaccggaccccgtaaaccccggg

SEQ ID NO: 233300 - DNA, 251 bp, Homo sapiens; identical to SEQ ID NO: 233265
  misc_feature: GYAE6OF01A0HH7.39.86.H09.1.454.CMB.1.raw
  modified_base (246)..(251): a, c, t, g, unknown or other
  misc_feature (246)..(251): n is a, c, g, or t

SEQ ID NO: 233301 - DNA, 250 bp, Homo sapiens
  misc_feature: GYAE6OF01DOI1B.39.86.H09.1.454.CMB.1.raw
  modified_base (246)..(250): a, c, t, g, unknown or other
  misc_feature (246)..(250): n is a, c, g, or t
tcagtcgcactagtcacgaccggtgctcgatttagtgctatagacttgggtttgggggtttggtggtctccactcccgccttgacgaggctgattattactgcagctcatttgcaatcagtgaggcttatgtcttcggaagtgggaccaaggtcatcgtcctaggtcagcccaaggccaaccccactgtcactctgttcccgccctcctcactagtgcgactgagcgggctggcaaggcgcatagnnnnn

SEQ ID NO: 233302 - DNA, 557 bp, Homo sapiens
  misc_feature: GYAE6OF01B9CZX.39.86.H09.1.454.CMB.1.raw
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaactcatcatttatgaggtcagtaatcggccctcaggggtttctaagtcgcttctctggctccaagtctggcaacacggcctccctgaccatctctgggctccaggctgaggacgaggcctagatttattactgctagtcctctatttgactaattccgaggtgagggtctttagtgttaccgttcgggaaggttacggggtaaccgtaaacgggtctaacgttccggttacccgttaagggtcctaacggtccccgtaaacccggg

SEQ ID NO: 233303 - DNA, 248 bp, Homo sapiens
  misc_feature: GYAE6OF01CD3V2.39.86.H09.1.454.CMB.1.raw
  modified_base (244)..(248): a, c, t, g, unknown or other
  misc_feature (244)..(248): n is a, c, g, or t
tcagtcgcactagtcacgaccggtgctcgatttagtgctatagacttgggtttgggggtttggtggtctccactcccgccttgacgaggctgattattactgcagctcatttgcaatcagtgaggcttatgtcttcggaagtgggaccaaggtcatcgtctaggtcagcccaaggccaacccactgtcactctgttcccgccctcctcactagtgcgactgagcgggctggcaaggcgcatagnnnnn

SEQ ID NO: 233304 - DNA, 494 bp, Homo sapiens
  misc_feature: GYAE6OF01ACO65.39.86.H09.1.454.CMB.1.raw
  modified_base (320)..(320): a, c, t, g, unknown or other
  misc_feature (320)..(320): n is a, c, g, or t
  modified_base (419)..(419): a, c, t, g, unknown or other
  misc_feature (419)..(419): n is a, c, g, or t
  modified_base (484)..(484): a, c, t, g, unknown or other
  misc_feature (484)..(484): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaactcatcatttatgagtcagtaatcggccctnaggggtttcaatcgcttctctggctcaagtctggcacacggcctcctgaccatctctcgggctccgaggctggacggacgaggctgatttattactgcngctctatttgctaatcagtgagtcttagtgtcgttcggagtcgggacaggtcagtcgtcaggtcngccgtaacgg

SEQ ID NO: 233305 - DNA, 487 bp, Homo sapiens
  misc_feature: GYAE6OF01A47GW.39.86.H09.1.454.CMB.1.raw
tcagtcgcactagtcacgaccggtgctcgatttagtgctatagacttgggttggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaactcatcatttatgagtcagtaatcggccctcgaggggtttctaatcgcttctctggctccaagtctggcaacacggcctccctgacccatctctgggctcaggctgagacgaggctgattattactgcagctcatttgacaatcagtgagcttatgtcgttcggaagttgggacaaggtcatcgtcaggtcagcccaag

SEQ ID NO: 233306 - DNA, 248 bp, Homo sapiens
  misc_feature: GYAE6OF01BPSFY.39.86.H09.1.454.CMB.1.raw
  modified_base (245)..(248): a, c, t, g, unknown or other
  misc_feature (245)..(248): n is a, c, g, or t
tcagtcgcactagtcacgaccggtgctcgatttagtgctatagacttgggtttgggggtttggtggtctccactcccgccttgacgaggctgattattactgcagctcatttgcaatcagtgaggcttatgtcttcggaagtgggaccaaggtcatcgtcctaggtcagcccaaggccaacccactgtcactctgttcccaccctcctcactagtgcgactgagcgggctggcaaggcgcatagnnnn

SEQ ID NO: 233307 - DNA, 520 bp, Homo sapiens
  misc_feature: GYAE6OF01BYQI2.39.86.H09.1.454.CMB.1.raw
  modified_base (227)..(227): a, c, t, g, unknown or other
  misc_feature (227)..(227): n is a, c, g, or t
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccngcagtgacgttgggggttatgactatgtctcctggtaccagcaatatccaggcacagcccccaaactcatcatttatgagtcagtaatcggccctcaggggtttctaatcgcttctctggctccaagtctgcaacacggcctccctgaccatctctgggctccaggctgagacgaggctgatttattactcgcagtctctatttgactaatcagtgaggtcttatgttcgttcggtaagtcgggaaccaggtcagttccggtaccttaagggtccacggtccccgaaaccggg

SEQ ID NO: 233308 - DNA, 535 bp, Homo sapiens
  misc_feature: GYAE6OF01D6TX2.39.86.H09.1.454.CMB.1.raw
  modified_base (300)..(300): a, c, t, g, unknown or other
  misc_feature (300)..(300): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggttatgactatgtctcctggtaccagcaatatccaggcacacgccccaaactcatcatttangaggtcagtaatcggccctcgaggggtttctaagtcgacttctctggctccaagtctggcaacacggcctccctgaccatctctcgggctccaggctggaggacgaggtctagatttattactgcagctcgtatttcgactaatcgagtgaggtctttagtggttcgttacgggaagttggggaaccctaagggtccaacgttccggtacctaggtcaacggccccgtaaacggg

SEQ ID NO: 233309 - DNA, 436 bp, Homo sapiens
  misc_feature: GYAE6OF01BDOCU.39.86.H09.1.454.CMB.1.raw
  modified_base (424)..(436): a, c, t, g, unknown or other
  misc_feature (424)..(436): n is a, c, g, or t
tcagtcgcactagtcacgaccggtgctcgatttagtgctatagacttgggtttgggggctgtgcctggatattgctggaaccagcagtgacgttgggggttatgactatgtctcctggtaccagcaatatccaggcacagcccccaaactcatcatttatgaggtcagtaatcggccctcaggggtttctaatcgcttctctggctccaagtctggcaacacggcctccctgaccatctctgggctccaggctgaggacgaggctgattattactgcagctcatttgcaatcagtgaggtcttatgtcttcggaagtgggaccaaggtcatcgtctaggtcagcccaaggcccaacccatgtacacttctcgttccccgccctcctcactagtcgcgactgagcgggctggcaaggcgcatagnnnnnnnnnnnnn

SEQ ID NO: 233310 - DNA, 549 bp, Homo sapiens
  misc_feature: GYAE6OF01DES01.39.86.H09.1.454.CMB.1.raw
  modified_base (306)..(306): a, c, t, g, unknown or other
  misc_feature (306)..(306): n is a, c, g, or t
  modified_base (369)..(369): a, c, t, g, unknown or other
  misc_feature (369)..(369): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggtatgactatgtctcctggtaccagcaatatccaggcacacgcccccaaactcatcattttangaggtcagtaatccggccctcgtaggggtttctaatcgcttctctggctcaagtctggcaacncggcctcctgaccatctcgtgggcctccgaggctggaggacggaggctgtatttatactgcagctctatttcgactaatctagtgtaggtcttagtgttacgttacgggaaggttcgggaacctaagggttcctaacgttccggttacccgtaggtaccgaacggtccccgaaacccggg

SEQ ID NO: 233311 - DNA, 603 bp, Homo sapiens
  misc_feature: GYAE6OF01DICHL.39.86.H09.1.454.CMB.1.raw
  modified_base (295)..(295): a, c, t, g, unknown or other
  misc_feature (295)..(295): n is a, c, g, or t
tcagtcgcactagtcacgaccggtgctcgatttagtgctatagacttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggtatgactatgtctctggtaccagcaatatccaggcacacgccccaaatcatcatttangaggtcagtaactcgcctcgtagggtttctaacgtcgtcttctcgtggcctacaagtctcggacaacgacggcctccctagaccattccgtctcgggccttccgacggtcgtagaacgggacgaggtctaggtaatttattacgtgacacgtcttaccagtttcgactaaacgttcgtagtacggtaggtctttaagtcgttacggttacgggtaaacggttacgggaaccgtaaacgggttccgtaacgttacccggttaccgttaacgggttaccgaacggtcccccgaaaacgggtaaccccccc

SEQ ID NO: 233312 - DNA, 579 bp, Homo sapiens
  misc_feature: GYAE6OF01BLPDF.39.86.H09.1.454.CMB.1.raw
  modified_base (303)..(303): a, c, t, g, unknown or other
  misc_feature (303)..(303): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggtatgactatgtctcctggtaccagacaatctccgagcacaccgaccccaaatcactctatttangagtacaagtacgtccggacctcggtaggtttactaacgtcgtctttcgtcgtcgtcctacgtacgtcgtacgaccaaaccgccggtccctccgtacgacctatccgtcggtcgggtcctaccggaggtcgtagggacggacggtcgtatacgtaatttacgtacgtgacacgtcttacttagttcaatcgacgtagtcgtagtcttagtcgttacgtaggaggtacggacgtacgtactacgttccgtacggtacgcgtaccggacctaaacccg

SEQ ID NO: 233313 - DNA, 517 bp, Homo sapiens
  misc_feature: GYAE6OF01ELDJ8.39.86.H09.1.454.CMB.1.raw
  modified_base (361)..(361): a, c, t, g, unknown or other
  misc_feature (361)..(361): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggttatgactatgtctcctggtaccagcaatatccaggcacagcccccaaactcatcatttatgaggtcagtaatcggcctcgaggggtttctaatcgcttctctggctccaagtctggcaacncggcctccctgaccatctctcgggctccgaggctgaggacgaggctgattattactgcagctactatttcgactaatcagtgaggtctttagtgttcgttcgggaaggtgggaacctaaggtctacgtccgtacgtagtcgaccgaccgaacccgg

SEQ ID NO: 233314 - DNA, 514 bp, Homo sapiens
  misc_feature: GYAE6OF01DIW7G.39.86.H09.1.454.CMB.1.raw
  modified_base (244)..(244): a, c, t, g, unknown or other
  misc_feature (244)..(244): n is a, c, g, or t
  modified_base (302)..(302): a, c, t, g, unknown or other
  misc_feature (302)..(302): n is a, c, g, or t
tcagtcgcactagtcacgaccggtgctcgatttagtgctatagacttgggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttangactatgtctcctggtaccagcaatatccaggcacacgcccccaaactcatcatttangaggtcagtaatcggcctgagggtttctaatcgtcttctctggctccaagtctggaccaacgaccggcctccctgacctactcctcgtgggcctccgaggctggaggacgaggctgatttatactgcagctatatttgctaatcagtgagtcttatgttcttagggaagtgggaactaggtcagtcgtcctaggtcacgcccgaaggacccc

SEQ ID NO: 233315 - DNA, 494 bp, Homo sapiens
  misc_feature: GYAE6OF01CC9N5.39.86.H09.1.454.CMB.1.raw
  modified_base (299)..(299): a, c, t, g, unknown or other
  misc_feature (299)..(299): n is a, c, g, or t
  modified_base (310)..(310): a, c, t, g, unknown or other
  misc_feature (310)..(310): n is a, c, g, or t
  modified_base (452)..(452): a, c, t, g, unknown or other
  misc_feature (452)..(452): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggtatgactatgtctctggtaccagcaatatccaggcacacgacccccaaatcatcatttangagtcagtaancgccctgtagggttcaatcgcttctctggctacaagtctggacaacacggcctccctgaccatcctcgtcgggcctccgaggctaggacgacgagtctagtattacgtactgcagctacaatataacaagcagcaagcactntgtgtagtcggacggacggacagctagaccgtctggtcaccg

SEQ ID NO: 233316 - DNA, 510 bp, Homo sapiens
  misc_feature: GYAE6OF01DPUU1.39.86.H09.1.454.CMB.1.raw
  modified_base (325)..(325): a, c, t, g, unknown or other
  misc_feature (325)..(325): n is a, c, g, or t
  modified_base (371)..(371): a, c, t, g, unknown or other
  misc_feature (371)..(371): n is a, c, g, or t
  modified_base (381)..(381): a, c, t, g, unknown or other
  misc_feature (381)..(381): n is a, c, g, or t
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgacccccaaactcatcatttatgaggtcagtaatcgccctnggggtttctaatcgcttctctgctcaagtctgcaacacggcctccngaccatctcnggctcaggctgaggacgaggctagatttattactgcagctctattgcaatcagtgagtctttagtgttcgttacggaaggttcgggaacctaagggtctacgtcgtactacggtcacgtcccgaaacgg

SEQ ID NO: 233317 - DNA, 496 bp, Homo sapiens
  misc_feature: GYAE6OF01EOS3C.39.86.H09.1.454.CMB.1.raw
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgcccccaaatcatcatttatgaggtcagtaatcggcctcgaggggtttctaatcgcttctctggctccaagtctggcaacacggcctcctgaccatctctgggctccgaggctgaggacgaggctgatttattactgcagctctatttgctaatcagtgagcttatgttcgttaggagtgggaccaggtcagtcgtctagtcagccgaacg

SEQ ID NO: 233318 - DNA, 562 bp, Homo sapiens
  misc_feature: GYAE6OF01DHJMS.39.86.H09.1.454.CMB.1.raw
  modified_base (302)..(302): a, c, t, g, unknown or other
  misc_feature (302)..(302): n is a, c, g, or t
  modified_base (462)..(462): a, c, t, g, unknown or other
  misc_feature (462)..(462): n is a, c, g, or t
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggtatgactatgtctcctggtaccagcaatatccaggcacagcccccaaactcatcatttangagtcagtaatcggcctcaggggtttctaatcgcttctctggctccaagtctggcaacgacggcctccctgacccatcctcgtgggccttccgaaggctaggacgggacgaggtctggatttattactgcagtctctagtttgactaatcagtgacggtntttagtgttcgtttacgggaaggttcggggaaacccaaagggttcctaacgttcccggttacccgttagggtacccacggtacccccgtaaaacccgggg

SEQ ID NO: 233319 - DNA, 571 bp, Homo sapiens
  misc_feature: GYAE6OF01AEA9N.39.86.H09.1.454.CMB.1.raw
  modified_base (303)..(303): a, c, t, g, unknown or other
  misc_feature (303)..(303): n is a, c, g, or t
  modified_base (427)..(427): a, c, t, g, unknown or other
  misc_feature (427)..(427): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggttatgactatgtctcctggtaccagcaatatccaggcacacgaccccaatcatcatttangagtcagtactcggcctcgtagggtttctaatcgtcttctctggctcaagtctcggacaacgcgccctcctagccatctcgtcggtcctcgagcgtaggaggacgagtctgtaatttacttacncgactacgtaccttacgtatttgacctaataccgtaggtagtacggtctttaagtcggttaccgttacgggaaggttacgggaacctaacgggttcctacggttcccggtaccgtaagggtcccaacggaccccgtaaacccgg

SEQ ID NO: 233320 - DNA, 612 bp, Homo sapiens
  misc_feature: GYAE6OF01C386U.39.86.H09.1.454.CMB.1.raw
  modified_base (300)..(300): a, c, t, g, unknown or other
  misc_feature (300)..(300): n is a, c, g, or t
  modified_base (337)..(337): a, c, t, g, unknown or other
  misc_feature (337)..(337): n is a, c, g, or t
tcagtcgcactagtcacgaccggtgctcgatttagtgctatagacttgggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttatgactatgtctctggtaccagcaatatccaggcacacgacccccaaatcatcattangagtacagtatcgcctgtagggtttctaatcgcttcnctgctcagtctggcaacacggcctcctcgacctatcctctcgggcctcccgaggctaggacggacggacggtctaggtatttactttaaccgtgtaccgagtacttacgttattttggaacctaaacgttcgtaacggttggaacgggttaccttttaagtccggtttacgttaccggggtaaaggttacggggtaaacccggtaagggtaccgtaagttcccggttacccgttaacgggtccaacccggtaccccgaaaccgggtaaacccccc

SEQ ID NO: 233321 - DNA, 510 bp, Homo sapiens
  misc_feature: GYAE6OF01DDKUD.39.86.H09.1.454.CMB.1.raw
  modified_base (233)..(233): a, c, t, g, unknown or other
  misc_feature (233)..(233): n is a, c, g, or t
  modified_base (386)..(386): a, c, t, g, unknown or other
  misc_feature (386)..(386): n is a, c, g, or t
  modified_base (403)..(403): a, c, t, g, unknown or other
  misc_feature (403)..(403): n is a, c, g, or t
  modified_base (429)..(429): a, c, t, g, unknown or other
  misc_feature (429)..(429): n is a, c, g, or t
tcagtcgcactagtcacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcaggctgcctccgtgtcgtgggtctctaggacagtcgatcgaccatctcctgcactggaaccngcagtgacgttggggttatgactatgtctcctggtaccagcaatactccacggcacacgccccaaatcatcatttatgagtcaagtaatcggcctcgtagggtttactaatcgcttcgtctggctcgaagtctaggacaacgtcggcctcccngaccatctcgtggctcnggctggaggacgagctgatttatacngctagctctatttgactatcgtaagtgaggtcttagtgtcttagggagtacggacctaaggtcaagttcgtcaggtcaacg

SEQ ID NO: 233322 - DNA, 535 bp, Homo sapiens
  misc_feature: GYAE6OF01DXNPO.39.86.H09.1.454.CMB.1.raw
  modified_base (303)..(303): a, c, t, g, unknown or other
  misc_feature (303)..(303): n is a, c, g, or t
  modified_base (368)..(368): a, c, t, g, unknown or other
  misc_feature (368)..(368): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgcccccaaactcatctatttangaggtcaagtaactcggccctcgaggggtttctaagtcgtcttctctggctcaagtctggcaacncggcctcctgaccatcctcgtcgggcctccgagtcgtggacggacggacggctgtaactttagttactgcagtcctctagtttgactaatcgagtgagtcttagtgttcgttacggtaaggtcgggacctaaggtcacgttcgtacgttaggccagcccgaaaccgg

SEQ ID NO: 233323 - DNA, 498 bp, Homo sapiens
  misc_feature: GYAE6OF01DQYKY.39.86.H09.1.454.CMB.1.raw
  modified_base (303)..(303): a, c, t, g, unknown or other
  misc_feature (303)..(303): n is a, c, g, or t
  modified_base (371)..(371): a, c, t, g, unknown or other
  misc_feature (371)..(371): n is a, c, g, or t
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaatcatcatttangagtcagtaatcggcctgaggggtttctaagtcgcttctctggctcaagtctggcaacacggcctccngaccatctctgggctccaggctgaggacgaggctgattattactgcagctcagtttgctaatcagtgaggtcttatgttacgttcggaagtcgggaccaaggtcatcgtctaggcagcccgtaacgg

SEQ ID NO: 233324 - DNA, 252 bp, Homo sapiens; identical to SEQ ID NO: 233257
  misc_feature: GYAE6OF01BRCT4.39.86.H09.1.454.CMB.1.raw
  modified_base (246)..(252): a, c, t, g, unknown or other
  misc_feature (246)..(252): n is a, c, g, or t

SEQ ID NO: 233325 - DNA, 268 bp, Homo sapiens
  misc_feature: GYAE6OF01DSURE.39.86.H09.1.454.CMB.1.raw
  modified_base (249)..(268): a, c, t, g, unknown or other
  misc_feature (249)..(268): n is a, c, g, or t
tcagtcgcactagtcacgaccggtgctcgatttagtgctatagacttggggtttagggggggtttggtggtctccactcccgccttgacgaggctgtattattactgcagctcatttgcaatcagtgaggcttatgtcttcggaagtgggaccaaggtctatcgtctaggtcagcccaaggccaacccatgtcactctgttcccgccctctcactaggtgcgactgagcgggctggcaaggcgcatagnnnnnnnnnnnnnnnnnnnn

SEQ ID NO: 233326 - DNA, 498 bp, Homo sapiens
  misc_feature: GYAE6OF01CXTSQ.39.86.H09.1.454.CMB.1.raw
  modified_base (304)..(304): a, c, t, g, unknown or other
  misc_feature (304)..(304): n is a, c, g, or t
tcagtcgcactagtcacgaccggtgctcgatttagtgctatagacttgggtttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgacccccaaactcatcatttangaggtcagtaatcggccctgaggggtttctaatcgtcttctctggctccaagtctggcaacacggcctccctgaccatctcgtcgggctccgaggctggacggacgaggctgatttattactgcagctctatttgctaattcagtgagtctatgtcgtggagtgggaccagtcatcgtactaggcagccgaacg

SEQ ID NO: 233327 - DNA, 559 bp, Homo sapiens
  misc_feature: GYAE6OF01B6O8L.39.86.H09.1.454.CMB.1.raw
  modified_base (300)..(300): a, c, t, g, unknown or other
  misc_feature (300)..(300): n is a, c, g, or t
  modified_base (349)..(349): a, c, t, g, unknown or other
  misc_feature (349)..(349): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggtatgactatgtctctggtaccagcaatatccaggcacacgacccccaaatcatctatttangagtcagtatcgcctgaggtttcatcgcttctctgctcagtctgcaacnccggcctccctagaccatctcgtcgggtcctccgaggtcgtaggacgggacgaggtctaggtatttacgttactgacagtccttacgtattttcgacttaagttcgaggtgtacggttacttagttcggttacgttacgggaaggttcggggaaaccgtaagggttacctaacgttccgtaccgttaggtccgaacgccccgtaaaccgg

SEQ ID NO: 233328 - DNA, 504 bp, Homo sapiens
  misc_feature: GYAE6OF01DRFM7.39.86.H09.1.454.CMB.1.raw
tcagtcgcactagtcacgaccggtgctcgatttagtgctatagacttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaaatcatcatttatgaggtcagtaatcggccctcagggtttctaatcgcttctctggctccaagtctggcaacacggcctccctgaccatctctgggctccaggctgaggacgaggctgattattactgcagctcatttgcaatcagtgaggtcttagtgtcttacgggaagtgggactaaggtcagttccgtactaggtcaacgcccgaacggacccc

SEQ ID NO: 233329 - DNA, 492 bp, Homo sapiens
  misc_feature: GYAE6OF01DG9HI.39.86.H09.1.454.CMB.1.raw
  modified_base (300)..(300): a, c, t, g, unknown or other
  misc_feature (300)..(300): n is a, c, g, or t
  modified_base (442)..(442): a, c, t, g, unknown or other
  misc_feature (442)..(442): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgccccaaatcatgatttangagtcagtaatcggcctgagggtttctaatcgtcttctctggctcaagtctaggcaacacggcctccctgaccatctcgtgggctcaggctgaggcgaggctgatttatactgcagctacatactacaagcagcagcacttnttgtggtattcgggcggagggaccaagctacgaccgtacgtggtcaacgg

SEQ ID NO: 233330 - DNA, 644 bp, Homo sapiens
  misc_feature: GYAE6OF01B844B.39.86.H09.1.454.CMB.1.raw
  modified_base (329)..(329): a, c, t, g, unknown or other
  misc_feature (329)..(329): n is a, c, g, or t
tcagtcgcactagtcacgaccggtgctcgatttagtgctatagacttggggtttggggggggtctcaggaggcagcgctctcaggacatctccaccatggcctgggctctgctgctcctcaccctcctcactcgagggcacgagggtcctgggcccagtctcgccctgactcaggctgcctccgtgtcgtgggtctcgtaggacagtcgatcaccatctcctgcacgtcggaaccagcaggtggtacgggtttggggttatgacttatcgtctccgtaggtaccagctaatctccgaggccaacgaccgaccccaaatcatctatttangagtcagtactcggcctgtagggttactagtcgtcttctcgtgtcctactaagtcgtacggacaaccgccggtccctccctacgacctactccgttacgtcgggtcccttaccggaggtccgtaggacggacggtacggtctagtatttactacgtcgacgtagtccttattacgttcgactaacgtcgtaggttaggcgtttacttagttcggttaccggttacgggtaaggttaccgggaaccgttaacggtaccgttacggttacccgttaccggttaacgggtccaacccgggtaccccgtaaaccccggg

SEQ ID NO: 233331 - DNA, 519 bp, Homo sapiens
  misc_feature: GYAE6OF01AR8JQ.39.86.H09.1.454.CMB.1.raw
  modified_base (306)..(306): a, c, t, g, unknown or other
  misc_feature (306)..(306): n is a, c, g, or t
  modified_base (368)..(368): a, c, t, g, unknown or other
  misc_feature (368)..(368): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgcccccaaactcatcatttangaggtcagtaatcggccctcgtaggggtttctaatcgtcttctctggctcaagtctggcacncgcctcctgaccatctcgtcgggctccgaggtctggacggacgaggctgtattattactgcagtctctatttcgactaatcgagtgagtcttagtgtacgttcggaaggtcgggacaggtcacgttcgtaccgtaggccagcccgaaccgg

SEQ ID NO: 233332 - DNA, 518 bp, Homo sapiens
  misc_feature: GYAE6OF01BJ9O6.39.86.H09.1.454.CMB.1.raw
  modified_base (405)..(405): a, c, t, g, unknown or other
  misc_feature (405)..(405): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaactcatcatttatgaggtcagtaatcggccctcaggggtttctaatcgcttctctggctcaagtctggcaacacggcctcctgaccatctctgggctccaggctggaggacgnggctgattattactgcagctcatttgactatcagtgaggtcttagtgttcgttcggaagttcgggaccaaggttcaacgttccggttacctaggtccaggcccctaaaccggg

SEQ ID NO: 233333 - DNA, 543 bp, Homo sapiens
  misc_feature: GYAE6OF01B3L19.39.86.H09.1.454.CMB.1.raw
  modified_base (301)..(301): a, c, t, g, unknown or other
  misc_feature (301)..(301): n is a, c, g, or t
  modified_base (312)..(312): a, c, t, g, unknown or other
  misc_feature (312)..(312): n is a, c, g, or t
  modified_base (362)..(362): a, c, t, g, unknown or other
  misc_feature (362)..(362): n is a, c, g, or t
tcagtcgcactagtcacgaccggtgctcgatttagtgctatagacttgggtttgggggggtctcaggaggcagcgctctcaggacatctccaccatggcctgggctctgctgctcctcaccctcctcactcaggcacagggtcctgggcccagtctgccctgactcaggctgcctccgtgtctgggtctctaggacagtcgatcaccatctcctgcactggaaccagcagtgacgttggggtatgactatgtctcctggtaccagcaatatccaggcacagacccccaaatcatcatttangagtcagtaancgccctgtagggtttctaatcgtcttctctggcctcaagtctggcaaacncggtccctccctgacctagtctcgtcgggcctccgaggcctgacgggtacgaggcttagtaatttagtactgctaagtcctcaatttcgactaatcgagtgaggttcttagtgttacgttcgggaagtcgggtaacctaggtctaacgtccgttaccgtaggtaccacgcccgtaaacccg

SEQ ID NO: 233334 - DNA, 527 bp, Homo sapiens
  misc_feature: GYAE6OF01C81O0.39.86.H09.1.454.CMB.1.raw
  modified_base (266)..(266): a, c, t, g, unknown or other
  misc_feature (266)..(266): n is a, c, g, or t
  modified_base (296)..(296): a, c, t, g, unknown or other
  misc_feature (296)..(296): n is a, c, g, or t
  modified_base (351)..(351): a, c, t, g, unknown or other
  misc_feature (351)..(351): n is a, c, g, or t
  modified_base (509)..(509): a, c, t, g, unknown or other
  misc_feature (509)..(509): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctctgcactggaaccagcagtgacgttggggtatgactatgtctctggtaccagcaatntccaggcacacgccccaaatcatcatttangagtcagtaatcggcctgtaggggtttactaatcgcttctcgtggcctcaagtcnggtacaacgtaccggcctcccgtgaccatctcgtgggctccgaggcctggacgggacgaggtctagtatttacttactacagtctactatttcgactaatcgagtgagtcttagtcgtcgttacggaagtgggaaccaggtcattccgtactacgganacgacccgaaggtacccc

SEQ ID NO: 233335 - DNA, 515 bp, Homo sapiens
  misc_feature: GYAE6OF01BISDC.39.86.H09.1.454.CMB.1.raw
  modified_base (308)..(308): a, c, t, g, unknown or other
  misc_feature (308)..(308): n is a, c, g, or t
tcagtcgcactagtcacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggttatgactatgtctcctggtaccagcaatatccaggcacacgcccccaaactcatcatttangaggtcagtaatcggccctcgaggggtttctaatcgctttctctggctccaagtctggcaacacggcctccctgaccatctctgggcctccaggctggaggacgaggctgattattactgctagcctactatttgactaatcagtgaggtcttagtgttcttacgggaagttcgggaacctaaggtcagtccgtcctggtcaaccgg

SEQ ID NO: 233336 - DNA, 251 bp, Homo sapiens
  misc_feature: GYAE6OF01D7GOO.39.86.H09.1.454.CMB.1.raw
  modified_base (247)..(251): a, c, t, g, unknown or other
  misc_feature (247)..(251): n is a, c, g, or t
tcagtcgcactagtcacgaccggtgctcgatttagtgctatagacttgggtttggggggtttggtggtctccactcccgccttgacgaggctgattattactgcagctcatttgcaatcagtgaggcttatgtcttcggaagtgggaccaaggtcatcgtcctaggtcagcccaaggccaaccccactgtcactctgttcccgccctcctcactagtgcgactgagcgggctggcaaggcgcatagnnnnn

SEQ ID NO: 233337 - DNA, 488 bp, Homo sapiens
  misc_feature: GYAE6OF01AEFHT.39.86.H09.1.454.CMB.1.raw
  modified_base (222)..(222): a, c, t, g, unknown or other
  misc_feature (222)..(222): n is a, c, g, or t
  modified_base (298)..(298): a, c, t, g, unknown or other
  misc_feature (298)..(298): n is a, c, g, or t
  modified_base (355)..(355): a, c, t, g, unknown or other
  misc_feature (355)..(355): n is a, c, g, or t
  modified_base (391)..(391): a, c, t, g, unknown or other
  misc_feature (391)..(391): n is a, c, g, or t
  modified_base (423)..(423): a, c, t, g, unknown or other
  misc_feature (423)..(423): n is a, c, g, or t
  modified_base (430)..(430): a, c, t, g, unknown or other
  misc_feature (430)..(430): n is a, c, g, or t
  modified_base (439)..(439): a, c, t, g, unknown or other
  misc_feature (439)..(439): n is a, c, g, or t
tcagtcgcactagtcacgaccggtgctcgatttagtgctatagacttgggctggggtctcaggaggcagcgctctcaggacatctccaccatggcctgggctctgctgctcctcaccctctcactcagggcacagggtcctgggcccagtctgccctgactcaggctgcctccgtgtctgggtctctaggacagtcgatcaccatctcctgcactggaaccngcagtgacgttggggttatgactatgtctcctggtaccagcaatatccaggcacacgccccaaactcatcatttangaggtcagtaatcgcctcagggtttctaatcgcttctctggctcagtctggctaacncggcctcctgaccctatctctgggcttccgaggtcnggaggacgaggctggatttatactgcagtctnatttcgnaatcagtgngcttatgtcttgggaattgggaactaggctatcgctaggtcaggacccg

SEQ ID NO: 233338 - DNA, 518 bp, Homo sapiens
  misc_feature: GYAE6OF01B17DR.39.86.H09.1.454.CMB.1.raw
  modified_base (297)..(297): a, c, t, g, unknown or other
  misc_feature (297)..(297): n is a, c, g, or t
  modified_base (440)..(440): a, c, t, g, unknown or other
  misc_feature (440)..(440): n is a, c, g, or t
tcagtcgcactagtcacgaccggtgctcgatttagtgctatagacttgggttggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggtatgactatgtctctggtaccagcaatatccaggcacagcccccaaatcatcattttangaggtcagtaaactcggccctgaggggtttctaaatcgcttctctggctccaagttctggacaacacggtcctccctgaccatcctcgtcgggctccaggctgaggacgaggctgattagttactgcagctcatacttcaagnaagtaatactgtcctttcggacggagggtacccaaggtcgtacgacccgtacgtaggtacagacccaaggcctcccgg

SEQ ID NO: 233339 - DNA, 507 bp, Homo sapiens
  misc_feature: GYAE6OF01DLEV3.39.86.H09.1.454.CMB.1.raw
  modified_base (301)..(301): a, c, t, g, unknown or other
  misc_feature (301)..(301): n is a, c, g, or t
  modified_base (360)..(360): a, c, t, g, unknown or other
  misc_feature (360)..(360): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggggttatgactatgtctcctggtaccagcaatatccaggcacacgaccccaaactcatcatttangaggtcagtaatcggccctgagggtttctaatcgcttctctggctcaagtctggcaacncgcctcctgaccatctcgtggctccgagctgaggacgagctgatttactactgacagctctatttgactaatcagtgtagtcttagtgttcgttaggaggtcgggaacctaagggtcctagttcgtaccgtaggtccaggtaccccg

SEQ ID NO: 233340 - DNA, 596 bp, Homo sapiens
  misc_feature: GYAE6OF01BGFTX.39.86.H09.1.454.CMB.1.raw
  modified_base (303)..(303): a, c, t, g, unknown or other
  misc_feature (303)..(303): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttggggttatgactatgtctctggtaccagcaatactccaggcacacgacccccaaatcatctatttangagtcagtatccggcctcgtaggggtttctaatcgtcttctctcggctcaagtctggactaacgaccggtcctcccgtacgaccctatccttacgtcgggccttaccgacggtctacggacggtacggtacggtctagtatttacttacgtcgactagtccttactagtttcgactaagtcgtagtagacgtactttagtacgttaccgttacgggaaaggttcgggtaaacccgtaaggtccgtaacgttccggtaccgttacgggtaccgaaccggtaccccgaaacccgg

SEQ ID NO: 233341 - DNA, 248 bp, Homo sapiens; identical to SEQ ID NO: 233246
  misc_feature: GYAE6OF01ADRTL.39.86.H09.1.454.CMB.1.raw
  modified_base (246)..(248): a, c, t, g, unknown or other
  misc_feature (246)..(248): n is a, c, g, or t

SEQ ID NO: 233342 - DNA, 519 bp, Homo sapiens
  misc_feature: GYAE6OF01CF6PL.39.86.H09.1.454.CMB.1.raw
  modified_base (305)..(305): a, c, t, g, unknown or other
  misc_feature (305)..(305): n is a, c, g, or t
  modified_base (338)..(338): a, c, t, g, unknown or other
  misc_feature (338)..(338): n is a, c, g, or t
  modified_base (361)..(361): a, c, t, g, unknown or other
  misc_feature (361)..(361): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgcccccaaatcatcatttangagtcagtaatcggccctgagggtttcaatcgnttctctgctcaagtctggcaacncgcctccctgaccatctctcgggctccaggctgaggacgaggtctgtatttagtactgcagctcatttgactaatcagtgaggtcttagtgttcgttacggaaggtcgggtaccaaggttcacttccggtaccgtaggtaccacggccccgaaaccgg

SEQ ID NO: 233343 - DNA, 252 bp, Homo sapiens; identical to SEQ ID NO: 233257
  misc_feature: GYAE6OF01ARV9K.39.86.H09.1.454.CMB.1.raw
  modified_base (246)..(252): a, c, t, g, unknown or other
  misc_feature (246)..(252): n is a, c, g, or t

SEQ ID NO: 233344 - DNA, 254 bp, Homo sapiens
  misc_feature: GYAE6OF01ECG0K.39.86.H09.1.454.CMB.1.raw
  modified_base (247)..(254): a, c, t, g, unknown or other
  misc_feature (247)..(254): n is a, c, g, or t
tcagtcgcactagtcacgaccggtgctcgatttagtgctatagacttgggtttggggggtttggtggtctccactcccgccttgacgaggctgattattactgcagctcatttgcaatcagtgaggcttatgtcttcggaagtgggaccaaggtcatcgtcctaggtcagcccaaggccaaccccactgtcactctgttcccgccctcctcactagtgcgactgagcgggctggcaaggcgcatagnnnnnnnn

SEQ ID NO: 233345 - DNA, 525 bp, Homo sapiens
  misc_feature: GYAE6OF01BNSHO.39.86.H09.1.454.CMB.1.raw
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgcccccaaatcatcatttatgagtcagtaatcgcctcgtagggtttcaatcgcttctctggctcagtctgcacacggcctcctgaccatctcgtgggcctcgaggtctggacggacgaggctagtattacttactgcagtctactacgtttgactaatcgtagtgaggtcttagtcgttacgttcggaaggttcgggaacctaggttcacgttccggtccgttaggtccacgcccgtaaaccgg

SEQ ID NO: 233346 - DNA, 561 bp, Homo sapiens
  misc_feature: GYAE6OF01BECVB.39.86.H09.1.454.CMB.1.raw
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgcccccaaactcatcatttatgaggtcagtaatcggccctcgaggggtttctaatcgcttctctggctcagtctgcaacacggcctcctgacctatctcgtcgggcctccgaggctaggacgggacgaggtctaggtatttacttacgtgacagtccttactagttttacgctaaagttccaggttgacggtctttagtacggttcgttacgggaaggttggggaaccctaagggttcaacgttccgtaccgttagggtccacggccccgtaaacccggg

SEQ ID NO: 233347 - DNA, 248 bp, Homo sapiens
  misc_feature: GYAE6OF01BIXSH.39.86.H09.1.454.CMB.1.raw
  modified_base (246)..(248): a, c, t, g, unknown or other
  misc_feature (246)..(248): n is a, c, g, or t
tcagtcgcactagtcacgaccggtgctcgatttagtgctatagacttgggtttgggggtttggtggtctccactcccgccttgacgaggctgattattactgcagctcttatagaagaagtagcactctggtgttcggcggagggaccaagctgaccgtcctaagtcagcccaaggctgccccctcggtcactctgttcccaccctcctcactagtgcgactgagcgggctggcaaggcgcatagnnn

SEQ ID NO: 233348 - DNA, 269 bp, Homo sapiens
  misc_feature: GYAE6OF01A2D9B.39.86.H09.1.454.CMB.1.raw
  modified_base (249)..(269): a, c, t, g, unknown or other
  misc_feature (249)..(269): n is a, c, g, or t
tcagtcgcactagtcacgaccggtgctcgatttagtgctatagacttgggtttgggggtttggtggtctccactcccgccttgacgaggctgattattactggccagctcatttgcgaatcagtgaggcttatgtcttcggaagtgggaccaaggtcatcgtcctaggtcagcccaaggccaaccccactgtcactctgttcccaccctcctcactagtgcgactgagcgggctggcaaggcgcatagnnnnnnnnnnnnnnnnnnnnn

SEQ ID NO: 233349 - DNA, 248 bp, Homo sapiens
  misc_feature: GYAE6OF01DWH9F.39.86.H09.1.454.CMB.1.raw
  modified_base (245)..(248): a, c, t, g, unknown or other
  misc_feature (245)..(248): n is a, c, g, or t
tcagtcgcactagtcacgaccggtgctcgatttagtgctatagacttgggtttgggggtttggtggtctccactcccgccttgacgaggctgattattactgcagctcatttgcaatcagtgaggcttatgtcttcggaagtgggaccaaggtcatcgtcctaggtcagcccaaggccaacccactgtcactctgttcccgccctcctcactagtgcgactgagcgggctggcaaggcgcatagnnnn

SEQ ID NO: 233350 - DNA, 249 bp, Homo sapiens
  misc_feature: GYAE6OF01BIY8T.39.86.H09.1.454.CMB.1.raw
  modified_base (244)..(249): a, c, t, g, unknown or other
  misc_feature (244)..(249): n is a, c, g, or t
tcagtcgcactagtcacgaccggtgctcgatttagtgctatagacttgggtttgggggtttggtggtctccactcccgccttgacgaggctgattattactgcagctcatttgcaatcagtgaggcttatgtcttcggaagtggaccaaggtcatcgtcctaggtcagcccaaggccaacccactgtcactctgttcccaccctcctcactagtgcgactgagcgggctggcaaggcgcatagnnnnnn

SEQ ID NO: 233351 - DNA, 554 bp, Homo sapiens
  misc_feature: GYAE6OF01DN66Y.39.86.H09.1.454.CMB.1.raw
  modified_base (302)..(302): a, c, t, g, unknown or other
  misc_feature (302)..(302): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggtatgactatgtctcctggtaccagcaatatccaggcacacgacccccaaactcatcatttangaggtcaagtaatccggccctcgtagggtttctaatcgtcttctctggctcgaagtcgtgacaacgcggcctcctgacctatctcgtcgggctccgaggtctggaggacggaggtctagtatttaattactgcacgtctacctatttcgactaagttcaggtcgaggtctttagtcggttacgttacgggtaaggttcgggaaccgtaaggtcacgttccgtaccgtaggttaccacgtccccgtaaaccgg

SEQ ID NO: 233352 - DNA, 484 bp, Homo sapiens
  misc_feature: GYAE6OF01ED9JF.39.86.H09.1.454.CMB.1.raw
  modified_base (415)..(415): a, c, t, g, unknown or other
  misc_feature (415)..(415): n is a, c, g, or t
  modified_base (422)..(422): a, c, t, g, unknown or other
  misc_feature (422)..(422): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaactcatcatttatgaggtcagtaatcggccctcgaggggtttctaatcgcttctctgctcaagtctgcaacacggcctcctgaccatctctgggctccaggctgacggcgagctgattatacngcagctnatttgcatcagtgagtcttatgtcttggagtggacaggtcagtcgtactaggcagcccaacg

SEQ ID NO: 233353 - DNA, 543 bp, Homo sapiens
  misc_feature: GYAE6OF01DK1Z5.39.86.H09.1.454.CMB.1.raw
  modified_base (306)..(306): a, c, t, g, unknown or other
  misc_feature (306)..(306): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggtatgactatgtctcctggtaccagcaatatccaggcacacgacccccaaactcatcatttangagtcagtaatccggcctcgagggtttctaatcgcttctctggctcaagtctggcaacgacggtcctcctgacccatcctcgtacgggtctccgaggtcctggacgggacggaacggctagtaatttattacgtgcagctactatttgactaatctagtgaggtacttagtcgttcgttacgggaaggtgggtaccaaggtcacgttcgtaccgttaggtccacgcccgtaaaccgg

SEQ ID NO: 233354 - DNA, 541 bp, Homo sapiens
  misc_feature: GYAE6OF01D89KX.39.86.H09.1.454.CMB.1.raw
  modified_base (303)..(303): a, c, t, g, unknown or other
  misc_feature (303)..(303): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttggggttatgactatgtctcctggtaccagcaatatccaggcacacgacccccaaatcatctatttangaggtcaagtaactcggccctgtaggggtttctaagtcgtcttctcgtggtcctaccgaagtctggaccaaccgaccggtccctccctgaccctatcctcgtcgggcctccgaggctggacggacgagctgtatttacttacgtgacagtctactatttgactaagtcagtgagtcttagtgttcgtacggagtcgggaactaggtcacgttccgtacgtaggtcacgcccgaaccgg

SEQ ID NO: 233355 - DNA, 440 bp, Homo sapiens
  misc_feature: GYAE6OF01BUM8C.39.86.H09.1.454.CMB.1.raw
  modified_base (359)..(359): a, c, t, g, unknown or other
  misc_feature (359)..(359): n is a, c, g, or t
  modified_base (419)..(440): a, c, t, g, unknown or other
  misc_feature (419)..(440): n is a, c, g, or t
tcagtcgcactagtcacgaccggtgctcgatttagtgctatagacttgggtttgggggctgtgcctggatattgctggaaccagcagtgacgttgggggttatgactatgtctcctggtaccagcaatatccaggcacagcccccaaactcatcatttatgaggtcagtaatcggccctcaggggtttctaatcgcttctctggctccaagtctggcaacacggcctccctgaccatctctgggctccaggctgaggacgaggctgattattactgcagctcatttgcaatcagtgaggcttatgtcttcggaagtgggaccaaggtcatcgtcctaggtcagcccaaggccaaccccntgtcactctcgtcccgcctcctcactagtgcgactgagcgggctggcaaggcgcatagcnnnnnnnnnnnnnnnnnnnnnn

SEQ ID NO: 233356 - DNA, 560 bp, Homo sapiens
  misc_feature: GYAE6OF01CPU0Z.39.86.H09.1.454.CMB.1.raw
  modified_base (304)..(304): a, c, t, g, unknown or other
  misc_feature (304)..(304): n is a, c, g, or t
  modified_base (379)..(379): a, c, t, g, unknown or other
  misc_feature (379)..(379): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggttatgactatgtctcctggtaccagcaatatccaggcacacgaccccaaatcatcatttangagtcagtaatcggccctgtagggtttcaatcgtcttctctgctcaagtctggacacgaccgccctcctcgaccntccgtcgtcgggcctccgaggtcgtggacgggacggaggtctagtatttatactgctaagtcttactagtttcgactaatccgtagtagtacggttctttagtcggttcgtttacgggaaggttacgggaaccgtaaggtcacgttccgtaccgtaggtaccgacgtacccgtaaacccgg

SEQ ID NO: 233357 - DNA, 493 bp, Homo sapiens
  misc_feature: GYAE6OF01BIOOQ.39.86.H09.1.454.CMB.1.raw
  modified_base (485)..(485): a, c, t, g, unknown or other
  misc_feature (485)..(485): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgcccccaaactcatcatttatgaggtcagtaatcggcctcaggggtttctaatcgcttctctggctcagtctggcaacacggcctcctgaccatctctgggctccgaggctgacggacgaggctgtattattactgcagctctatttgctaatcagtgaggtcttatgtcgttcggagtggacaggtcatcgtctagtcngccgaacg

SEQ ID NO: 233358 - DNA, 495 bp, Homo sapiens
  misc_feature: GYAE6OF01BR7CX.39.86.H09.1.454.CMB.1.raw
  modified_base (160)..(160): a, c, t, g, unknown or other
  misc_feature (160)..(160): n is a, c, g, or t
  modified_base (279)..(279): a, c, t, g, unknown or other
  misc_feature (279)..(279): n is a, c, g, or t
  modified_base (362)..(362): a, c, t, g, unknown or other
  misc_feature (362)..(362): n is a, c, g, or t
  modified_base (457)..(459): a, c, t, g, unknown or other
  misc_feature (457)..(459): n is a, c, g, or t
  modified_base (465)..(465): a, c, t, g, unknown or other
  misc_feature (465)..(465): n is a, c, g, or t
  modified_base (469)..(470): a, c, t, g, unknown or other
  misc_feature (469)..(470): n is a, c, g, or t
  modified_base (472)..(480): a, c, t, g, unknown or other
  misc_feature (472)..(480): n is a, c, g, or t
  modified_base (482)..(491): a, c, t, g, unknown or other
  misc_feature (482)..(491): n is a, c, g, or t
  modified_base (493)..(495): a, c, t, g, unknown or other
  misc_feature (493)..(495): n is a, c, g, or t
tcagtcgcactagtcacgaccggtgctcgatttagtgctatagacttggggtttggggctgtgcctggatattgctggaaccagcagtgaccgttggggttatgacctatgtctcctggtaccagcaatatccaggcacagcccccaaatcatcatttangaggtcagtaatccggcctcaggggtttctaatcgcttctctggctccaagtctggcaacgacgcctcctgaccatcctctagggctccaggctgacggaccgaggctgaattattacngcagctcatttgcaatcagtgaggtcttatgtcgtggaagtggaccaggtcagtcgtcaggtcacgcccgaagcccaaacccngtcgtcacttcgttacgttccccgccttcctacgacgtacgtcgccgtaacgttcggaacggccggtactacgggacaacggtcgctaacgtggnnntcgcgngcgnntnnnnnnnnngnnnnnnnnnncnnn

SEQ ID NO: 233359 - DNA, 547 bp, Homo sapiens
  misc_feature: GYAE6OF01A3G3J.39.86.H09.1.454.CMB.1.raw
  modified_base (307)..(307): a, c, t, g, unknown or other
  misc_feature (307)..(307): n is a, c, g, or t
  modified_base (368)..(368): a, c, t, g, unknown or other
  misc_feature (368)..(368): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttggggttatgactatgtctcctggtaccagcaatatccaggcacacgacccccaaactcatcatttangagtcagtaatcggcctcgtagggtttctaatcgtcttctctggctccaagtctggcaacnccggtccctccctgacctatcctcgtcgggcctccgaggtctaggaggacgaggtctagtattattactgcagtcctacgtatttcgactaatcgagtggaggtcttagtcgttcgttacgggaaggtacgggacctaaggtcctagttccggtactaggtccaacggcccgaaaccgg

SEQ ID NO: 233360 - DNA, 251 bp, Homo sapiens; identical to SEQ ID NO: 233265
  misc_feature: GYAE6OF01ESET3.39.86.H09.1.454.CMB.1.raw
  modified_base (246)..(251): a, c, t, g, unknown or other
  misc_feature (246)..(251): n is a, c, g, or t

SEQ ID NO: 233361 - DNA, 503 bp, Homo sapiens
  misc_feature: GYAE6OF01D98DL.39.86.H09.1.454.CMB.1.raw
tcagtcgcactagtcacgaccggtgctcgatttagtgctatagacttgggtttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaactcatcatttatgagtcagtaatcggccctcaggggtttctaatcgcttctctggctccaagtctggcaacacggcctcctgaccatctctgggctccaggctgagacgaggctgattattactgcagctcatttgctaatcagtgaggtcttatgttcgttacgggaagttcgggactaaggtcagttcgtactaggtcagccccgaaacgg

SEQ ID NO: 233362 - DNA, 710 bp, Homo sapiens
  misc_feature: GYAE6OF01C5G7B.39.86.H09.1.454.CMB.1.raw
  modified_base (297)..(297): a, c, t, g, unknown or other
  misc_feature (297)..(297): n is a, c, g, or t
tcagtcgcactagtcacgaccggtgctcgatttagtgctatagacttgggctggggtctcaggaggcagcgctctcaggacatctccaccatggcctgggctctgctgctcctcaccctcctcactcaggcacagggtcctgggcccagtctgccctgactcagctgcctccgtgtctgggtctctaggacagtcgatcaccatctcctgcactggaaccagcagtgacggttggggttatgactatgtctctgtaccagcaatactccgagcacacgaccccaaatcatctattangtagtcagtaacgtccgcctagtacgggtttactaagttcgtcttctcgtcgctactaagttcgtcggactaaccgaccggtaccctccctagaaccctattccgtcgtcggtccttaccgagggtctacgggaacggtaccggaacggtcttagttaacgttttaacgtttaccgtacgtaccgtaacggttccttacgtttaaacgttttcgaaccttaaacgttcggtaaacggtttacgggtaaaccggttcctttttaaacggttccggtttaaccgggtttaaccggggtaaacggggtttacccggggtaaaacccgtttaaacgggtttccgttaaaacccggttttccccgggttaaccggtttaaacccgggtcccgtaaacccggggtaaaaccccccccgg

SEQ ID NO: 233363 - DNA, 565 bp, Homo sapiens
  misc_feature: GYAE6OF01CKRPK.39.86.H09.1.454.CMB.1.raw
  modified_base (307)..(307): a, c, t, g, unknown or other
  misc_feature (307)..(307): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttatgactatgtctcctggtaccagcaatatccaggcacacgcccccaaactcatcatttangaggtcaagtaatccggccctcgtaggggtttctaatcgtcttctctggctccaagtctggacaacacggccctccctcgacctatcctcgtcggggcctccgaggtcgtggacgggacgagggcctggtactttattactgcagccttctatttgactaatcgagtgaggtcttagtcgttacgttcgggaaggttcgggaacctaagggttcacgttccggtacccgttaggtacctacggccccgtaaacccggg

SEQ ID NO: 233364 - DNA, 585 bp, Homo sapiens
  misc_feature: GYAE6OF01DLNCD.39.86.H09.1.454.CMB.1.raw
  modified_base (306)..(306): a, c, t, g, unknown or other
  misc_feature (306)..(306): n is a, c, g, or t
tcagtcgcactagtcacgaccggtgctcgatttagtgctatagacttgggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttatgactatgtcctcctggtaccagacaatactccaggcacacgacccccaaatcatctatttangagtcagtaactcggccctcgtagggtttactaatcgtcttctcgtggctccaagtctggaccaacgaccggtccctccctgacctactcctcgtcgggcctccgaggcgtggacggacggaggtcctagtatttacgttactgacagtctactaatactaacagtactaagttaactacgttcgttccggtttacgggacgggtaacgggtaccaaggtaccgtcggtaccccgttacgtacggtaccacggacccgaacgcccgtcccggtcccccg

SEQ ID NO: 233365 - DNA, 503 bp, Homo sapiens
  misc_feature: GYAE6OF01A8OS6.39.86.H09.1.454.CMB.1.raw
  modified_base (493)..(493): a, c, t, g, unknown or other
  misc_feature (493)..(493): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaactcatcatttatgaggtcagtaatcggccctcaggggtttctaatcgcttctctggctccaagtctggcaacacggcctccctgacccatctctgggctccgaggctgaggacgaggctgatttattactgcagctcatttgactaatcagtgaggtctttagtgttcgttcggagtgggaccaaggtcattccgtctaggtcnggcccaacgg

SEQ ID NO: 233366 - DNA, 525 bp, Homo sapiens
  misc_feature: GYAE6OF01CJTGO.39.86.H09.1.454.CMB.1.raw
  modified_base (304)..(304): a, c, t, g, unknown or other
  misc_feature (304)..(304): n is a, c, g, or t
  modified_base (365)..(365): a, c, t, g, unknown or other
  misc_feature (365)..(365): n is a, c, g, or t
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaactcatcatttangagtcagtaatcggccctcaggggtttctaatcgtcttctctggctccaagtctggcaacncggccctcctgaccatctctcgggctccaggctggacggacgaggcctgatttattactgcagctctatttgacaatcagtgagtcttagtgttcgttcggaaggttcgggaaccctaaggtcagttccgtacccgtaggtccagtccccgaaacccggg

SEQ ID NO: 233367 - DNA, 527 bp, Homo sapiens
  misc_feature: GYAE6OF01EICOU.39.86.H09.1.454.CMB.1.raw
  modified_base (303)..(303): a, c, t, g, unknown or other
  misc_feature (303)..(303): n is a, c, g, or t
tcagtcgcactagtcacgaccggtgctcgatttagtgctatagacttgggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgacccccaaactcatctatttangagtcagtaatcggcctcgtagggtttctaatcgcttctctggctcagtctgcaacacgcctccctgaccatctcgtcggctccgaggctggaggacgaggtctgtatttagttactgcagtctactatttcgactaatcgagtgagtcttagtcgttcgttacggagttgggaactaggtcctagtaccgtccgtagtaccacgaccccgaacggtacccccg

SEQ ID NO: 233368 - DNA, 450 bp, Homo sapiens
  misc_feature: GYAE6OF01BINJM.39.86.H09.1.454.CMB.1.raw
  modified_base (431)..(431): a, c, t, g, unknown or other
  misc_feature (431)..(431): n is a, c, g, or t
  modified_base (437)..(450): a, c, t, g, unknown or other
  misc_feature (437)..(450): n is a, c, g, or t
tcagtcgcactagtcacgaccggtgctcgatttagtgctatagacttgggtttgggggctgtgcctggatattgctggaaccagcagtgacgttgggggttatgactatgtctcctggtaccagcaatatccaggcacagcccccaaactcatcatttatgaggtcagtaatcggccctcaggggtttctaatcgcttctctggctccaagtctggcaacacggcctccctgacccatcctctgggctccaggctgaggacgaggctgattattactgcagctcatttgcaatcagtgaggcttatgtcttcggaagtgggaccaaggtcatcgtctaggtcagcccaaggcccaacccatcgtccacttcctcgttcccccacccttcctacctactagtcgccgacgtgacgcgggctggcgaacggcncatagnnnnnnnnnnnnnn

SEQ ID NO: 233369 - DNA, 481 bp, Homo sapiens
  misc_feature: GYAE6OF01CAFJP.39.86.H09.1.454.CMB.1.raw
  modified_base (450)..(450): a, c, t, g, unknown or other
  misc_feature (450)..(450): n is a, c, g, or t
  modified_base (454)..(481): a, c, t, g, unknown or other
  misc_feature (454)..(481): n is a, c, g, or t
tcagtcgcactagtcacgaccggtgctcgatttagtgctatagacttgggtttgggggctgtgcctggatattgctggaaccagcagtgacgttgggggttatgactatgtctcctggtaccagcaatatccaggcacagcccccaaactcatcatttatgaggtcagtaatcggccctcaggggtttctaatcgcttctctggctccaagtctggcaacacggcctccctgaccatctctggggccccaggctgaggacgaggctgattattactgcagctctactttgcgaaatcagtgaggcctttataggttcttcgggaaggtgggaccgaaggtcatcgttcctaggtcgacgcccgaaggccaacccccactgtcacctctgttccccgccctcctcactagtcgcgactgacgcgggtctgggcaacggcacgacttagcgnacgnnnnnnnnnnnnnnnnnnnnnnnnnnnn

SEQ ID NO: 233370 - DNA, 280 bp, Homo sapiens
  misc_feature: GYAE6OF01DP70C.39.86.H09.1.454.CMB.1.raw
  modified_base (252)..(280): a, c, t, g, unknown or other
  misc_feature (252)..(280): n is a, c, g, or t
tcagtcgcactagtcacgaccggtgctcgatttagtgctatagacttgggtttgggggtttggtggtctccactcccgccttgacgaggctgattattactgcagctcatttgcaatcagtgaggcttatggtcttcgggaaggtgggaccaaggtcatcgtcctagggtcaggccccaaggccaaccccatgtcactctcgttcccgccctcctcactagtgcgactgagcgggctggcaaggcgcatagnnnnnnnnnnnnnnnnnnnnnnnnnnnnn

SEQ ID NO: 233371 - DNA, 249 bp, Homo sapiens; identical to SEQ ID NO: 233250
  misc_feature: GYAE6OF01AYREH.39.86.H09.1.454.CMB.1.raw
  modified_base (246)..(249): a, c, t, g, unknown or other
  misc_feature (246)..(249): n is a, c, g, or t

SEQ ID NO: 233372 - DNA, 283 bp, Homo sapiens
  misc_feature: GYAE6OF01D97KR.39.86.H09.1.454.CMB.1.raw
  modified_base (252)..(283): a, c, t, g, unknown or other
  misc_feature (252)..(283): n is a, c, g, or t
tcagtcgcactagtcacgaccggtgctcgatttagtgctatagacttggggtttgggggggtttggtcggtctcccactcccgccttgacgaggctgattattactgcagctcatttgcaatcagtgaggcttatggtcttcggaagtgggaccaaggtcatcgtcctaggtcagcccaaggccaacccatgtcactctgttcccaccctcctcgactagtgcgactgaggcgggctggcaaggcgcatagnnnnnnnnnnnnnnnnnnnnnnnnnnnnnnnn

SEQ ID NO: 233373 - DNA, 428 bp, Homo sapiens
  misc_feature: GYAE6OF01BCST8.39.86.H09.1.454.CMB.1.raw
  modified_base (420)..(428): a, c, t, g, unknown or other
  misc_feature (420)..(428): n is a, c, g, or t
tcagtcgcactagtcacgaccggtgctcgatttagtgctatagacttgggtttgggggctgtgcctggatattgctggaaccagcagtgacgttgggggttatgactatgtctcctggtaccagcaatatccaggcacagcccccaaactcatcatttatgaggtcagtaatcggccctcaggggtttctaatcgcttctctggctccaagtctggcaacacggcctccctgaccatctctgggctccaggctgaggacgaggctgattattactgcagctcatttgcaatcagtgaggcttatgtcttcggaagtgggaccaaggtcatcgtctaggtcagcccaaggcccaaccccatgtcactctgttccccgccctcctcactagtgcgactgagcgggctggcaaggcgcatagnnnnnnnnn

SEQ ID NO: 233374 - DNA, 249 bp, Homo sapiens
  misc_feature: GYAE6OF01AI40L.39.86.H09.1.454.CMB.1.raw
  modified_base (247)..(249): a, c, t, g, unknown or other
  misc_feature (247)..(249): n is a, c, g, or t
tcagtcgcactagtcacgaccggtgctcgatttagtgctatagacttgggtttggggggtttggtggtctccactcccgccttgacgaggctgattattactgcagctcatttgcaatcagtgaggcttatgtcttcggaagtgggaccaaggtcatcgtcctaggtcagcccaaggccaaccccactgtcactctgttcccgccctcctcactagtgcgactgagcgggctggcaaggcgcatagnnn

SEQ ID NO: 233375 - DNA, 538 bp, Homo sapiens
  misc_feature: GYAE6OF01BKW8T.39.86.H09.1.454.CMB.1.raw
  modified_base (243)..(243): a, c, t, g, unknown or other
  misc_feature (243)..(243): n is a, c, g, or t
  modified_base (301)..(301): a, c, t, g, unknown or other
  misc_feature (301)..(301): n is a, c, g, or t
  modified_base (340)..(340): a, c, t, g, unknown or other
  misc_feature (340)..(340): n is a, c, g, or t
  modified_base (375)..(375): a, c, t, g, unknown or other
  misc_feature (375)..(375): n is a, c, g, or t
tcagtcgcactagtcacgaccggtgctcgatttagtgctatagacttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctccctgcactggaaccagcagtgacgttgggggttangactatgtctcctggtaccagcaatatccaggcacacgacccccaaatcatcatttangagtcagtaatcggcctgtagggtttcaatcgcttcgtntggctccaagtctggacaacacggcctcctgaccntcctcgtcgggctccgaggtctaggacgggacgaggcctaggtatttattacgtgctaagccttacagtttcgactaagtcaaggtgagtcttagtgttaccgttaggaagtgggaacctaggtccaagtccgtacgtaacggtcacgcccgtaaaggccccc

SEQ ID NO: 233376 - DNA, 543 bp, Homo sapiens
  misc_feature: GYAE6OF01BCBI2.39.86.H09.1.454.CMB.1.raw
  modified_base (270)..(270): a, c, t, g, unknown or other
  misc_feature (270)..(270): n is a, c, g, or t
  modified_base (302)..(302): a, c, t, g, unknown or other
  misc_feature (302)..(302): n is a, c, g, or t
  modified_base (356)..(356): a, c, t, g, unknown or other
  misc_feature (356)..(356): n is a, c, g, or t
tcagtcgcactagtcacgaccggtgctcgatttagtgctatagacttgggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttatgactatgtctcctggtaccagcaatntccgaggcacacgcccccaaatcatcatttangagtcagtaactcggcctgtagggtttcatcgcttctctgctcagtctgcaacncgcctccctgacctatctcgtgggctccgaggtcgtaggacggacgaggtcgtagtatttattacgtgctagtctactagtttcgactaattcgagttgacggttctttagtcgttacgttacggaggttcgggaacgtagggtactagtccgtacgttaggaccgacgtacccgaacggtaccccc

SEQ ID NO: 233377 - DNA, 251 bp, Homo sapiens
  misc_feature: GYAE6OF01C0HF4.39.86.H09.1.454.CMB.1.raw
  modified_base (246)..(251): a, c, t, g, unknown or other
  misc_feature (246)..(251): n is a, c, g, or t
tcagtcgcactagtcacgaccggtgctcgatttagtgctatagacttgggtttgggggtttggtggtctccactcccgccttgacgaggctgattattactgcagctcatttgcaatcagtgaggcttatgtcttcggaagtgggaccaaggtcatcgtcctaggtcagcccaaggccaaccccactgtcactctgttcccgccctcctcactagtgcgactgagcgggctggcaaggcgcatagnnnnnn

SEQ ID NO: 233378 - DNA, 250 bp, Homo sapiens
  misc_feature: GYAE6OF01C854O.39.86.H09.1.454.CMB.1.raw
  modified_base (247)..(250): a, c, t, g, unknown or other
  misc_feature (247)..(250): n is a, c, g, or t
tcagtcgcactagtcacgaccggtgctcgatttagtgctatagacttgggtttggggggtttggtggtctccactcccgccttgacgaggctgattattactgcagctcatttgcaatcagtgaggcttatgtcttcggaagtgggaccaaggtcatcgtcctaggtaagcccaaggccaaccccactgtcactctgttcccgccctcctcactagtgcgactgagcgggctggcaaggcgcatagnnnn

SEQ ID NO: 233379 - DNA, 575 bp, Homo sapiens
  misc_feature: GYAE6OF01DBJYO.39.86.H09.1.454.CMB.1.raw
  modified_base (310)..(310): a, c, t, g, unknown or other
  misc_feature (310)..(310): n is a, c, g, or t
  modified_base (323)..(323): a, c, t, g, unknown or other
  misc_feature (323)..(323): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatcctcctgcactggaaccagcagtgacggttgggggtatgactatgtctcctggtaccagcaatatccaggcacaccgacccccaaactcatctatttangaggtcaagtacnccggcctgtagggtttctaatcgtcttctcgtgtcctacagtctaggacctaacgaccggccctccctacgaccctacttcgtcgtcgggtcctccgaggtccgtaggacgggaacgtacgggtactggtaattttaacgttactgacgtaagtccttactagtttcgactaagtcgtagtggtacggtcttagtcgtcgttacggaaggtcgggaacctaggtcagttcgtactagcacgcccgtaaccgg

SEQ ID NO: 233380 - DNA, 506 bp, Homo sapiens
  misc_feature: GYAE6OF01AQU60.39.86.H09.1.454.CMB.1.raw
  modified_base (323)..(323): a, c, t, g, unknown or other
  misc_feature (323)..(323): n is a, c, g, or t
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaatcatcatttatgaggtcagtaatcggccctnaggggtttctaatcgcttctctggctcaagtctggcaacacggcctcctgaccatctctgggctccaggctgaggacgaggctgattatactgcagctcatttgctaatcagtgaggtcttagtgtcttcgggaagttcgggacctaagggtccagttcgtaccgtaggtcagcccgaaacgg

SEQ ID NO: 233381 - DNA, 620 bp, Homo sapiens
  misc_feature: GYAE6OF01B1U2B.39.86.H09.1.454.CMB.1.raw
  modified_base (311)..(311): a, c, t, g, unknown or other
  misc_feature (311)..(311): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcaggcacagggtcctgggcccagtctgccctgactcaggctgcctccgtgtctgggtctctaggacagtcgatcaccatctcctgcactggaaccagcagtgacggttgggggttatggactatgtctctggtaccagacaatactccaggcaacaccgacccccaaatcatctatttangagtcaagtactcgccctgtagggtttctaatcgtcttctctgctcaagtcgtaggaccaaccgaccggtccctcccgtgaccctatcctcgtcgggcctaccgaggctaggacgggacgacggtcgttagtatttaacgttacgtcgtacgacgtccttacgtagttttacggacctaagttaccgtaggtcggtaacggttctttagttacggttaccgttaaccgggtaagggttaccgggtaaccgaacggttaccacgttacccggttacgtaacggtcccgaaccgtaccccggtaaacccgg

SEQ ID NO: 233382 - DNA, 251 bp, Homo sapiens; identical to SEQ ID NO: 233377
  misc_feature: GYAE6OF01BFP9M.39.86.H09.1.454.CMB.1.raw
  modified_base (246)..(251): a, c, t, g, unknown or other
  misc_feature (246)..(251): n is a, c, g, or t

SEQ ID NO: 233383 - DNA, 608 bp, Homo sapiens
  misc_feature: GYAE6OF01A962A.39.86.H09.1.454.CMB.1.raw
  modified_base (300)..(300): a, c, t, g, unknown or other
  misc_feature (300)..(300): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggttatgactatgtctctggtaccagcaatatccaggcacacgacccccaaatcatcatttangagtcagtaatcggccctcgtaggggtttctaatccgtcttctctcggtctaccgaagtctcggactaaaccgaccggtcccttcccgtagtaccctattccgtccgtggggtcccttaccgagggtccttagggaacgggaacccggtaggtccgttaggtaacttttactttaacgtcggacctacgtctactagtttcgactaatcgaggtagaggtacctttagtgttaccgtacgggtaaggtcgggaacctaagggtcaacgttccggtaccttaagggtccaacggccccgtaaacccggg

SEQ ID NO: 233384 - DNA, 251 bp, Homo sapiens; identical to SEQ ID NO: 233336
  misc_feature: GYAE6OF01CO6GH.39.86.H09.1.454.CMB.1.raw
  modified_base (247)..(251): a, c, t, g, unknown or other
  misc_feature (247)..(251): n is a, c, g, or t

SEQ ID NO: 233385 - DNA, 538 bp, Homo sapiens
  misc_feature: GYAE6OF01ACA9F.39.86.H09.1.454.CMB.1.raw
  modified_base (270)..(270): a, c, t, g, unknown or other
  misc_feature (270)..(270): n is a, c, g, or t
  modified_base (301)..(301): a, c, t, g, unknown or other
  misc_feature (301)..(301): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatntccaggcacacgcccccaaatcatcatttangagtcagtaactcggcctcgtagggtttctaatcgtcttctctcggctcgaagtcgtcggacaacgaccggtcctccctgacccattcgtcgtgggcctccgaggctaggacggacgaggtctagtatttacttacgtcgactagtacttcgtatttcgactaagtcgtagtgacgtcttagtgttacgtcggagtcgggaccaggtcacgttccgtactaggcagcccgtaaccgg

SEQ ID NO: 233386 - DNA, 542 bp, Homo sapiens
  misc_feature: GYAE6OF01BWKVM.39.86.H09.1.454.CMB.1.raw
  modified_base (303)..(303): a, c, t, g, unknown or other
  misc_feature (303)..(303): n is a, c, g, or t
tcagtcgcactagtcacgaccggtgctcgatttagtgctatagacttgggtttgggggggtctcaggaggcagcgctctcaggacatctccaccatggcctgggctctgctgctcctcaccctcctcactcaggcacagggtcctgggcccagtctgccctgactcaggctgcctccgtgtctgggtctctaggacagtcgatcaccatctcctgcactggaaccagcagtgacgttggggtatgactatgtctctggtaccagacaatatccaggcaacacgacccccaaatcatcatttangagtcagtaactcggccctcgtaggggtttctaagtcgtcttctctggctaccgaagtctggacaacgacggtcctccctagacctatcctcgtcgggctccgacggctgacggacgaggcttgatttataagtgcaagtctactatttcgctaatcagtgagtcttagtcgttcgttacggaaggttcgggaacctaggtcacgttccgtacgtaaggtccaacgcccgtaaacccgg

SEQ ID NO: 233387 - DNA, 519 bp, Homo sapiens
  misc_feature: GYAE6OF01BZARE.39.86.H09.1.454.CMB.1.raw
  modified_base (303)..(303): a, c, t, g, unknown or other
  misc_feature (303)..(303): n is a, c, g, or t
  modified_base (364)..(364): a, c, t, g, unknown or other
  misc_feature (364)..(364): n is a, c, g, or t
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaatcatcatttangaggtcagtaatcggccctcgaggggtttctaatcgcttctctggctcaagtctggcaacncgcctcctgaccatctctgggctccgaggctgacggacgaggctgattattactgcagctcatttgctaatcagtgaggtctttagtgttcgttcgggaagtcgggacctaagggtccagttccggttacctaggtccagtccccgtaaaccggg

SEQ ID NO: 233388 - DNA, 619 bp, Homo sapiens
  misc_feature: GYAE6OF01BESTQ.39.86.H09.1.454.CMB.1.raw
  modified_base (301)..(301): a, c, t, g, unknown or other
  misc_feature (301)..(301): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggttatgactatgtctcctggtaccagcaatatccaggcacacgcccccaaatcatctatttangaggtcagtactccggcctcgtaggggtttctaagtcgtcttctctggtctaccaagtctaggaccaaccgaccggtccccttcccgtacgaccctacgttccgtaccgttcggggacccttacccggagggtccgttagggaacgggtaccggtacggtcttaggtaactttaagtttaccgtgtactacgtccttacgtagttttcgactaaagtccgtaaggttaacggtctttagttcggttacgttacgggaaggtcgggaaccgtaaggtctagttccgtaccgtaggtccaacggcccgtaacggaccccc

SEQ ID NO: 233389 - DNA, 511 bp, Homo sapiens
  misc_feature: GYAE6OF01EPT7N.39.86.H09.1.454.CMB.1.raw
  modified_base (369)..(369): a, c, t, g, unknown or other
  misc_feature (369)..(369): n is a, c, g, or t
  modified_base (400)..(400): a, c, t, g, unknown or other
  misc_feature (400)..(400): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctgtaccagcaatatccaggcacagcccccaaatcatcatttatgagtcagtaatcggcctcgaggggtttcaatcgcttctctggctcaagtctggcacacggcctccngaccatctctgggcctcgaggctgaggacgnggctgattatactgctagctctagtttgctaatcgagttgaggtctttagtgttcgttcgggaaggtcgggaacctaggtcactcggttcctaggtcagcccgtaaaccgg

SEQ ID NO: 233390 - DNA, 253 bp, Homo sapiens
  misc_feature: GYAE6OF01C282R.39.86.H09.1.454.CMB.1.raw
  modified_base (246)..(253): a, c, t, g, unknown or other
  misc_feature (246)..(253): n is a, c, g, or t
tcagtcgcactagtcacgaccggtgctcgatttagtgctatagacttgggtttgggggtttggtggtctccactcccgccttgacgaggctgattattactgcagctcatttgcaatcagtgaggcttatgtcttcggaagtgggaccaaggtcatcgtcctaggtcagcccaaggccaaccccactgtcactctgttcccaccctcctcactagtgcgactgagcgggctggcaaggcgcatagnnnnnnnn

SEQ ID NO: 233391 - DNA, 517 bp, Homo sapiens
  misc_feature: GYAE6OF01B1RSZ.39.86.H09.1.454.CMB.1.raw
  modified_base (303)..(303): a, c, t, g, unknown or other
  misc_feature (303)..(303): n is a, c, g, or t
  modified_base (403)..(403): a, c, t, g, unknown or other
  misc_feature (403)..(403): n is a, c, g, or t
  modified_base (423)..(423): a, c, t, g, unknown or other
  misc_feature (423)..(423): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggtatgactatgtctctggtaccagcaatatccaggcacacgcccccaaatcatcatttangaggtcagtaatcggcctcgtaggggtttctaagtcgcttctctggctcaagtctgacacacgcctcctgaccatctcgtgggctcgaggctggagacgnggctagattatctgcagctntatttgactaatcagtgtaggtcttagtgttcgttacggaagtcgggtaaccaggtctaacgttccgtacctaggtccaggtcccgaaacccgg

SEQ ID NO: 233392 - DNA, 545 bp, Homo sapiens
  misc_feature: GYAE6OF01CKK0R.39.86.H09.1.454.CMB.1.raw
  modified_base (298)..(298): a, c, t, g, unknown or other
  misc_feature (298)..(298): n is a, c, g, or t
  modified_base (463)..(463): a, c, t, g, unknown or other
  misc_feature (463)..(463): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctctgcactggaaccagcagtgacggttggggtatgactatgtctctggtaccagcaatatccaggcacacgccccaaactcatcatttangagtcagtaactcggccctgtaggggtttctaagtcgtcttctctggctaccaagtctggcaacgacggcctccctgaccactctcgtgggcctccgagcgtgacggacgaggctgtaacttacgtactcgcgacgtctctagtttcgactaatacgtagtaggngttacttagtgttcgttacggtaggttacggaccgtaaggtctacgttccggtacctaggtacaccggaccgtaaaccccgg

SEQ ID NO: 233393 - DNA, 424 bp, Homo sapiens
  misc_feature: GYAE6OF01DUE9B.39.86.H09.1.454.CMB.1.raw
  modified_base (357)..(357): a, c, t, g, unknown or other
  misc_feature (357)..(357): n is a, c, g, or t
  modified_base (401)..(401): a, c, t, g, unknown or other
  misc_feature (401)..(401): n is a, c, g, or t
  modified_base (411)..(411): a, c, t, g, unknown or other
  misc_feature (411)..(411): n is a, c, g, or t
  modified_base (416)..(424): a, c, t, g, unknown or other
  misc_feature (416)..(424): n is a, c, g, or t
tcagtcgcactagtcacgaccggtgctcgatttagtgctatagacttgggtttgggggctgtgcctggatattgctggaaccagcagtgacgttgggggttatgactatgtctcctggtaccagcaatatccaggcacagcccccaaactcatcatttatgaggtcagtaatcggccctcaggggtttctaatcgcttctctggctccaagtctggcaacacggcctccctgaccatctctgggctccaggctgaggacgaggctgattattactgcagctcatttgcaatcagtgaggcttatgtcttggaagtgggaccaaggtcatcgtctaggtcagcccaaggcccaacccntgcactctcgttcccaccctctcactagtcgcgactgagcgggntggcaaggcnatagnnnnnnnnn

SEQ ID NO: 233394 - DNA, 579 bp, Homo sapiens
  misc_feature: GYAE6OF01A3SYI.39.86.H09.1.454.CMB.1.raw
  modified_base (304)..(304): a, c, t, g, unknown or other
  misc_feature (304)..(304): n is a, c, g, or t
  modified_base (451)..(451): a, c, t, g, unknown or other
  misc_feature (451)..(451): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttatgactatgtctcctggtaccagcaatactccaggcacacgacccccaaatcatcatttanagagtcagttaactccggcctcgtaggggtttacaagtcgtcttctctggctccaagtctggcaacgccggtcctccctagacctatctcgtgggccctaccgaggctaggacggcgaggctagatttacgtactgactagtccttntacgtttcgactaagtcgtagttcggagttcttagtggttaccgttacgggaaggttacggggaacctaagggttcctaacggttcccggttaccgtaagggtccaaccggtaccccgtaaacccggg

SEQ ID NO: 233395 - DNA, 720 bp, Homo sapiens
  misc_feature: GYAE6OF01DJH54.39.86.H09.1.454.CMB.1.raw
  modified_base (318)..(318): a, c, t, g, unknown or other
  misc_feature (318)..(318): n is a, c, g, or t
  modified_base (330)..(330): a, c, t, g, unknown or other
  misc_feature (330)..(330): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctcgccctgactcaggctgcctccgtgtctgggtctctaggacagtcgatcaccatctcctgcactggaaccagcagtggtacggttgggggttatggacttatgtcttccgtggtaccagacaatactccgaggcacaccgacccccaatcatctatttangagtacagtacnccggcctagtagggtttactaagtcgtcttctcgtgtcctacgaagtcgtacggaccaaccgtaccggtccccttacccgtacgaccctacgttccgttaccggttcggggaccccttaccggacgggtccgttacgggaaccgggtaaccggtacgggtacgttacggttaacttttacgttaacgtcggaccgtacggtaccttacgttacgttttacgaccttaaacgttaccgtagggttacggtacgttacgtttaacgttaccggttaccgggtttaacggggtaaggttaccggggtaaacccgttaaacgggttaccgtaaccgttacccgggttacccggttaaccgggtaccctaacccgggaaccccgtaaaccccggg

SEQ ID NO: 233396 - DNA, 617 bp, Homo sapiens
  misc_feature: GYAE6OF01B85EM.39.86.H09.1.454.CMB.1.raw
tcagtcgcactagtcacgaccggtgctcgatttagtgctatagacttgggtttggggggggtctcaggaggcagcgctctcaggacatctccaccatggcctgggctctgctgctcctcaccctcctcactcaggcacagggtcctgggcccagtctgccctgactcaggctgcctccgtgtctgggtctctaggacagtcgatcaccatctcctgcactggaaccagcagtgtacggttgggggtatgactatgtctctggtaccagacaatactccaggccaacgacgaccccctaaaatcaattcctaattttatggaacgtacaagttaacgtccggtacccttaggtacggggttttactaactcgtcttctcgtcggtcctacgaagtctaggacctaaccgacggtccctcccgtagacctagtcctcgtcgggtactccgaggctaggacggacgaggtctagtatttactacgtcgactacgtccttacgtatttgaacctaactcgtagtaggtagttctttagtcgtttacggtaacgggtaggtaacggtacgtaacggtctaacgttcgttaccgtaggaccgtaccggaaccccgtaacccgg

SEQ ID NO: 233397 - DNA, 445 bp, Homo sapiens
  misc_feature: GYAE6OF01AGHSR.39.86.H09.1.454.CMB.1.raw
  modified_base (426)..(445): a, c, t, g, unknown or other
  misc_feature (426)..(445): n is a, c, g, or t
tcagtcgcactagtcacgaccggtgctcgatttagtgctatagacttgggtttgggggctgtgcctggatattgctggaaccagcagtgacgttgggggttatgactatgtctcctggtaccagcaatatccaggcacagcccccaaactcatcatttatgaggtcagtaatcggccctcaggggtttctaatcgcttctctggctccaagtctggcaacacggcctccctgaccatctctgggctccaggctgaggacgaggctgattattactgcagctcatttgcaatcagtgaggctttatgtcttcggaagtgggaccaaggtcagtcgtctaggtcagcccaaggcccaacccatgtcactctcgttccccaccctcctcactagtcgcgtactgacgcgggtctggcaaggcgcatagnnnnnnnnnnnnnnnnnnnn

SEQ ID NO: 233398 - DNA, 665 bp, Homo sapiens
  misc_feature: GYAE6OF01DTIX0.39.86.H09.1.454.CMB.1.raw
  modified_base (224)..(224): a, c, t, g, unknown or other
  misc_feature (224)..(224): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccngcagtgacggttgggggtatgactagtgtctcctaggtaccagacaatactaccgaggcaaccaccgacccccctaaactccattacctaattttagtagtaggtacaagtaactccggccctaggtacggggtttactaacgttcgtctttcgtcgtcgcctaccaagtctacgaccaccgaccggtccctaccctcgacctatccgtcgtcgggactccgacggtcgtacggaacggaccggtagtccgttagtaacttttaacgttactacgactacgtaccgttaccttagtttaccggacttaagttccgaggttcggtaacgttcgtttaacgtcggtttaccggttacgggtaaaggttaccggggtaaccgtaaacggttctaccggttccgttaccggttaacggtccgaccggtaccccggtaaaccccgg

SEQ ID NO: 233399 - DNA, 517 bp, Homo sapiens
  misc_feature: GYAE6OF01CDNAB.39.86.H09.1.454.CMB.1.raw
  modified_base (363)..(363): a, c, t, g, unknown or other
  misc_feature (363)..(363): n is a, c, g, or t
  modified_base (418)..(418): a, c, t, g, unknown or other
  misc_feature (418)..(418): n is a, c, g, or t
tcagtcgcactagtcacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggttatgactatgtctcctggtaccagcaatatccaggcacagaccccaaactcatcatttatgagtcagtaatcgcctcagggtttctaatcgcttctctggctcaagtctggcaacncggcctcctgaccatctctgggctcaggctgacggacgagctgtaattacttacngcagtctactatttcgactatcagtgacgggtctttagtcggttcttacgggaaggttcggaacctaaggttcaacttcgtaccgttaggtcgaaccgg

SEQ ID NO: 233400 - DNA, 543 bp, Homo sapiens
  misc_feature: GYAE6OF01ACJKZ.39.86.H09.1.454.CMB.1.raw
  modified_base (268)..(268): a, c, t, g, unknown or other
  misc_feature (268)..(268): n is a, c, g, or t
  modified_base (300)..(300): a, c, t, g, unknown or other
  misc_feature (300)..(300): n is a, c, g, or t
  modified_base (342)..(342): a, c, t, g, unknown or other
  misc_feature (342)..(342): n is a, c, g, or t
  modified_base (407)..(407): a, c, t, g, unknown or other
  misc_feature (407)..(407): n is a, c, g, or t
tcagtcgcactagtcacgaccggtgctcgatttagtgctatagacttgggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggtatgactatgtctctggtaccagcaatntccaggcacacgcccccaaatcatctatttangaggttcagtaactcggcctcgtagggtttacaatcgcttcnctgctccagtctggcaacgaccggcctccctgacctatctcgtcggctcgaggctaggaggacgngtctagtatttatactgcagtctctagttgacaatcgagtgacgtagttatgttccgttaacggaacggttagggaaccgtaggtcctagttcccggtaccttagggtaccaaccgtcccgtaaccggtaaccccc

SEQ ID NO: 233401 - DNA, 513 bp, Homo sapiens
  misc_feature: GYAE6OF01CSK94.39.86.H09.1.454.CMB.1.raw
  modified_base (301)..(301): a, c, t, g, unknown or other
  misc_feature (301)..(301): n is a, c, g, or t
  modified_base (428)..(428): a, c, t, g, unknown or other
  misc_feature (428)..(428): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctccgtggtaccagcaatatccaggcacacgccccaaatcatcatttangagtcaagtaatccggccctgtacgggtttctaatcgtcttctctggctctaagtctggcaacgcggccctcctcgaccatctctgggctccgagctgagacgaggtctgattattctgcagtcttntagtttgactaatcgagtgagtcttagtgtcgttggaagtcgggaacctaggtcacgttcgtaccgtaggtcacgcccgaaccgg

SEQ ID NO: 233402 - DNA, 610 bp, Homo sapiens
  misc_feature: GYAE6OF01BXI4F.39.86.H09.1.454.CMB.1.raw
  modified_base (228)..(228): a, c, t, g, unknown or other
  misc_feature (228)..(228): n is a, c, g, or t
  modified_base (309)..(309): a, c, t, g, unknown or other
  misc_feature (309)..(309): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccngcagtgacggttggggtatgactatgtctctggtaccagcaatactccaggcacaccgacccccaaactcaatctatttanggtagtcagtaactccggccctcgtaggggtttctaagtcgtctttcctcgtcggtccttaccgaacgtcgtcggaccaaccgtaccggtcccttccctacgaccctacgtcctcgtcgggccctccgacgggtcgtagggacgggtaccggaggtcctagttaactttacgtttacgtgtacgaacgtccttactatttcgacttaactcgtaggtcgtagtctttagtgttacgtacgggtaggtacgggaccgtaaggtcacgttccgtaccgtaggtaccaccggacccgaacccgg

SEQ ID NO: 233403 - DNA, 592 bp, Homo sapiens
  misc_feature: GYAE6OF01D3E2C.39.86.H09.1.454.CMB.1.raw
  modified_base (309)..(309): a, c, t, g, unknown or other
  misc_feature (309)..(309): n is a, c, g, or t
  modified_base (464)..(464): a, c, t, g, unknown or other
  misc_feature (464)..(464): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcaggcacagggtcctgggcccagtctgccctgactcaggctgcctccgtgtctgggtctctaggacagtcgatcaccatctcctgcactaggaaccagcaggtgtacggttgggggttatgactatgtctccgtggtaccagcaatactccaggcacacgtacccccaaatcatctatttangagtcagtaatcggcctcgtagggtttctaagtcgtcttcgcgttcggcctactaagttcgtacggactaaaccgccggtcccctaccgtagaccctacgttcgtcgtcgggctccgacggtctaggagggacgaggtctagtacttaattcgtncgtacgtcttactagtttgacctaagtccgtaggtagtacggttactttagtcgttacggttacgggaaggtaccggtaaaccgtaggtctacgtccgttacgtagtaccgacgccccgtaaacccgg

SEQ ID NO: 233404 - DNA, 809 bp, Homo sapiens
  misc_feature: GYAE6OF01B4KZ1.39.86.H09.1.454.CMB.1.raw
  modified_base (307)..(307): a, c, t, g, unknown or other
  misc_feature (307)..(307): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcaggcacagggtcctgggcccagtctgccctgactcaggctgcctccgtgtctgggtctctaggacagtcgatcaccatctcctgcactggaaccagcagtggacggttgggggttatgactatgtctcctggtaccagcaatatccaggccacacgacccccaaatcaactctatttanagtaggtacagttaacgtccggccctgtaacggggtttactaagtccgtcttcgttcgtcggtcctaccgtaaagttcctacgggaccaaaccgtaccggtccccttacccgtacggtaaccctaacgtttcccgtaccggttcggggtcccttacccggtaacgggtaccgttaacgggaacggggaaccggtacgggtacccgtttagtaaaccgtttttaacgtttaacccgttacgggtaaccgttccgggtacctttaaccggttaaaccgtttttcgggaaaccctttaaacggttacccggtaaagggtttacccgggttaagggtttaccgttttaaacggtttccgggttaaccggtttttaaccgggggtaaacgggttaccggggggtaaaaccccggttaaacgggttaaccccgtaaccgttttacccgggttaacccggtttaacgggtaaccccgtaaacccggtaaccccgggtaaaacccccggg

SEQ ID NO: 233405 - DNA, 249 bp, Homo sapiens
  misc_feature: GYAE6OF01CXLL0.39.86.H09.1.454.CMB.1.raw
  modified_base (242)..(242): a, c, t, g, unknown or other
  misc_feature (242)..(242): n is a, c, g, or t
  modified_base (247)..(249): a, c, t, g, unknown or other
  misc_feature (247)..(249): n is a, c, g, or t
tcagtcgcactagtcacgaccggtgctcgatttagtgctatagacttgggtttggggggtttggtggtctccactcccgccttgacgaggctgattattactgcagctcatttgcaatcagcgaggcttatgtcttcggaagtgggaccaaggtcatcgtcctaggtcagcccaaggccaaccccactgtcactctgttccccaccctcctcactagtgcgactgagcgggctggcaaggcnatagnnn

SEQ ID NO: 233406 - DNA, 596 bp, Homo sapiens
  misc_feature: GYAE6OF01B7M9B.39.86.H09.1.454.CMB.1.raw
  modified_base (300)..(300): a, c, t, g, unknown or other
  misc_feature (300)..(300): n is a, c, g, or t
tcagtcgcactagtcacgaccggtgctcgatttagtgctatagacttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctctgcactggaaccagcagtgacggttgggggttatgactatgtctctggtaccagctaatatccaggcacacgaccccaaatcatctatttangagtcaagtactcgcctgagggtttctaagtcgacttctcgtcgtctaccgaagtcgtaggaccaacgaccgtcctccctagaccatcctcgtcggctcgacggctacggaggacgtaaggcttacgtatttaacgttactgacctaagtccttacgtatttcgactaagtcgtacggtagacgtactttacgtcgttacgttaccgggtaaaggtcgggaaaccctaagggttaccctaacgtttccgtaacccgttaggtaacccaccggtaaccccgaacgggtaaacccccc

SEQ ID NO: 233407 - DNA, 556 bp, Homo sapiens
  misc_feature: GYAE6OF01EZHKN.39.86.H09.1.454.CMB.1.raw
  modified_base (271)..(271): a, c, t, g, unknown or other
  misc_feature (271)..(271): n is a, c, g, or t
  modified_base (302)..(302): a, c, t, g, unknown or other
  misc_feature (302)..(302): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttatgactatgtctcctggtaccagcaatntccaggcacacgcccccaaatcatcatttangagtcagtaactccggcctgtagggtttctaagtcgtcttctctcggctccaagtctggaccaacgaccggccctccctgaccctactctcgtcgggcctccgacggtctaggaggaccgtaggctaggtaatttattacgtgctagtcctctatttgactaagtcgagtcggagttctttagtcgttcgttacgggtaaggtcgggaaccgtaaggtcacgttccgtacgtacggtcaacgtcccgaacccgg

SEQ ID NO: 233408 - DNA, 579 bp, Homo sapiens
  misc_feature: GYAE6OF01BL006.39.86.H09.1.454.CMB.1.raw
  modified_base (301)..(301): a, c, t, g, unknown or other
  misc_feature (301)..(301): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgccccaaactcatcatttangagtcagtaactcggccctcgaggggtttctaagtcgtcttctctggctccaagtctggacaacgccggcctccctgacctactctcgtgggccctccgaggtctaggacgggacggagggtctagtaactttattactgcagtcttacgtatttcgactaacgtcgtaggtaggtacggtactttagttcggttacgttacgggtaaggttacggggacccgtaagggtacctaacgttccgtaccgttaggtccgacggtaccccgtaaacccggg

SEQ ID NO: 233409 - DNA, 534 bp, Homo sapiens
  misc_feature: GYAE6OF01EAKOT.39.86.H09.1.454.CMB.1.raw
  modified_base (240)..(240): a, c, t, g, unknown or other
  misc_feature (240)..(240): n is a, c, g, or t
  modified_base (268)..(268): a, c, t, g, unknown or other
  misc_feature (268)..(268): n is a, c, g, or t
  modified_base (366)..(366): a, c, t, g, unknown or other
  misc_feature (366)..(366): n is a, c, g, or t
  modified_base (487)..(487): a, c, t, g, unknown or other
  misc_feature (487)..(487): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggtccagtctggcctgacacagcctgccctccgtgtctgagactcctggacagtcgatcaccatctcctgcactggaaccagcagtgacgttggtncttataattatgtctcctggttccaacngcattcaggcagcgaccccgaaatcttaatttatgtagttctttcgtcgccctcgtagggtttctagtcgtcttctccggctcaagtctcggacaacncggccctcctgaccatctctacgctccaggctaggacggacgacggctagacttattagtcgactagctctaatactacgtagtaatcaagttggtactcgacgtggtacttggttcgggnggacgggacctaaggttcgaccgtcgtagtccacgcccgaggtcccg

SEQ ID NO: 233410 - DNA, 554 bp, Homo sapiens
  misc_feature: GYAE6OF01AY9O4.39.86.H09.1.454.CMB.1.raw
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggttatgactatgtctctggtaccagcaatatccaggcacacgcccccaaatcatcatttatgagtcagtaatccggtccctgtaggggtttctaagtcgtcttctctggtctcaagtctgacaacgcggtcctccgtgaccatcctacgtcgggtcctcgacggtctaggaacgacggtacggcttagatttacgttacgtgtacagtccttactagtttcgactaagtcgagtcgtagtcttagtcgttacgttacggaggtcgggacctaaggtctaacgttcgtacgtaggtcacgtacccgtaaccgg

SEQ ID NO: 233411 - DNA, 574 bp, Homo sapiens
  misc_feature: GYAE6OF01B3NOD.39.86.H09.1.454.CMB.1.raw
  modified_base (306)..(306): a, c, t, g, unknown or other
  misc_feature (306)..(306): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttggggttatgactatgtctcctggtaccagcaatatccaggcacacgacccccaaatcatcatttangagtcagtaactccggcctcgaggggtttctaagtcgtcttctctcggcctccaagtctggacaacgaccggcctccctgacctatctcgtcgggcctccgaggctaggacggacgaggctgtatttacgtactgactacgcttcgtatttcgactaagtcgagtggacggtcttagtcgttacgttacgggtaaggtacgggtaacccgtaagggttcctacgttcccggttaccgttagggtaccaccggtccccgtaaacccggg

SEQ ID NO: 233412 - DNA, 545 bp, Homo sapiens
  misc_feature: GYAE6OF01BEM56.39.86.H09.1.454.CMB.1.raw
  modified_base (303)..(303): a, c, t, g, unknown or other
  misc_feature (303)..(303): n is a, c, g, or t
tcagtcgcactagtcacgaccggtgctcgatttagtgctatagacttgggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttatgactatgtctccgtggtaccagcaatatccaggcacacgacccccaaatcatcatttangaggtcagtaatcggcctcgtagggtttctaatcgtcttctcgtggctccaagtctggaccaacgccggtccctccctagaccctattcctcgtcgggcctccgaggctggacggacgaggtctagtatttattacgtgcagcctatatttgactaatcaggtgagtcttagtcgtcgttacggaaggtggaaccgtaggtctagttccgtaccgtaggtaccacgtacccgacggtacccc

SEQ ID NO: 233413 - DNA, 686 bp, Homo sapiens
  misc_feature: GYAE6OF01COINW.39.86.H09.1.454.CMB.1.raw
  modified_base (303)..(303): a, c, t, g, unknown or other
  misc_feature (303)..(303): n is a, c, g, or t
tcagtcgcactagtcacgaccggtgctcgatttagtgctatagacttgggtttgggggtctcaggaggcagcgctctcaggacatctccaccatggcctgggctctgctgctcctcaccctcctcactcagggcacagggtcctgggcccagtctgccctgactcaggctcgcctccgtgtctgggtctctaggacagtcgatcaccatctctgcactggaaccagcagtgacggttggggtatgactatgtctccgtggtaccagcaatactcgaggccacacgaccccaatcatctattangagtcagtactcggcctgtacggttactaatcgtcttcgtcgtcggtctaccgtaagttcctaggaccaaccgtaccggtccctaccgtacgtaaccctacgttccgtccggtcgggtaccctacccggtaggtaccgttagggaacgggtacggtacggtactacgttaactttacgttacgtcgaccgtaacgtaccgtttacgtacgtttacgaacgttaacgttacgtaggttaacggtacggttacgtttacggttcggttaccggttaacggggtaacgggttacgggtaacccgttaaacgggtacccgttaacggtttacccggttaaccggttaacgggttacccgaaacccggtacccccggtaaaaccccgg

SEQ ID NO: 233414 - DNA, 596 bp, Homo sapiens
  misc_feature: GYAE6OF01BVJWJ.39.86.H09.1.454.CMB.1.raw
  modified_base (307)..(307): a, c, t, g, unknown or other
  misc_feature (307)..(307): n is a, c, g, or t
  modified_base (339)..(339): a, c, t, g, unknown or other
  misc_feature (339)..(339): n is a, c, g, or t
  modified_base (376)..(376): a, c, t, g, unknown or other
  misc_feature (376)..(376): n is a, c, g, or t
tcagtcgcactagtcacgaccggtgctcgatttagtgctatagacttgggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttatgactatgtctcctggtaccagactaatactccgaggcacgacgacccccaaatcatcatttangagtcagtactccgcctggtaggttacagtcncttctcgtgctcagtctgacaacgcgcctcctcgacntcctcgtcggctcgagcgtaggacggacgaggtcgttagtattacttacgtgctagtccttacttattcgtacgtaacttcgaaggttacggtacgttagtttacgtcggtttaccggttacggggtaacggttacgggtaaccgtaacggttccgtaacgttcccggttaccggttacggtaaccgaacccggtaccccgaaacccggtaacccccccg

SEQ ID NO: 233415 - DNA, 564 bp, Homo sapiens
  misc_feature: GYAE6OF01A97JL.39.86.H09.1.454.CMB.1.raw
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttggggttatgactatgtctcctggtaccagcaatatccaggcacacgccccaaactcatctatttatgagtcagtatcggccctcgtaggggtttctaagtcgtcttctctggctcgaagtctggctaacgccggtcctcctagacctactctcgtgggtcctaccgaggctaggacggtacgaggctagtatttactacgtgacacgcttactatttcgactaatcgtagtggtaagtcttagtcgttcgttacgggtaaggttacgggtaaccgtaagggtctacgttccggtaccgttaaggtccgaccggaccccgtaaacccgg

SEQ ID NO: 233416 - DNA, 249 bp, Homo sapiens
  misc_feature: GYAE6OF01EYYVA.39.86.H09.1.454.CMB.1.raw
  modified_base (247)..(249): a, c, t, g, unknown or other
  misc_feature (247)..(249): n is a, c, g, or t
tcagtcgcactagtcacgaccggtgctcgatttagtgctatagacttgggtttggggggtttggtggtctccactcccgccttgacgaggctgattattactgcagctcatttgcaatcagtgaggcttatgtcttcggaagtgggaccaaggtcatcgtcctaggtcagcccaaggccaaccccactgtcactctgttcccaccctcctcactagtgcgactgagcgggctggcaaggcgcatagnnn

SEQ ID NO: 233417 - DNA, 263 bp, Homo sapiens
  misc_feature: GYAE6OF01E1FP2.39.86.H09.1.454.CMB.1.raw
  modified_base (185)..(185): a, c, t, g, unknown or other
  misc_feature (185)..(185): n is a, c, g, or t
  modified_base (239)..(239): a, c, t, g, unknown or other
  misc_feature (239)..(239): n is a, c, g, or t
  modified_base (245)..(263): a, c, t, g, unknown or other
  misc_feature (245)..(263): n is a, c, g, or t
tcagtcgcactagtcacgaccggtgctcgatttagtgctatagacttgggtttgggggtttggtggtctccactcccgccttgacgaggctgattattactgcagctcatttgcaatcagtgaggcttatgtcttcggaagtgggaccaaggtcatcgtcctaggtcagcccaaggccaaccccnctgtcactctgttcccaccctcctcactagtcgactgagcgggctggcaaggcncatagnnnnnnnnnnnnnnnnnnn

SEQ ID NO: 233418 - DNA, 706 bp, Homo sapiens
  misc_feature: GYAE6OF01AO5LL.39.86.H09.1.454.CMB.1.raw
  modified_base (311)..(311): a, c, t, g, unknown or other
  misc_feature (311)..(311): n is a, c, g, or t
  modified_base (317)..(317): a, c, t, g, unknown or other
  misc_feature (317)..(317): n is a, c, g, or t
tcagtcgcactagtcacgaccggtgctcgatttagtgctatagacttgggggggggtctcaggaggcagcgctctcaggacatctccaccatggcctgggctctgctgctcctcaccctcctcactcagggcacagggtcctgggcccagtctgccctgactcaggctgcctccgtgtctgggtctcgtaggacagtcgatccaccatctcctgcactggaaccagcagtgtacggttgggggttatgactatgtctcctggtaccagacaatatccgaggccacacgacccccaaactcactctatttangaggtnagtactccggcctgtagggtttactaacgtcgtcttctcgtcgctaccgaagttcgtaggaccaaccgaccggtcccttcccgtacgacctactccgtcgtcggtcctaccgaggtcgtacgggacgggacggtacggtaccgttaggttaactttacgttacgtcggtaccgtacgtccttacgttacgtttacgaaccttaacgttacgtaacgggttacggtaacggttactttaacggttaccgggtttaccgggttaacggggtaaacgggttacccgggggaaaccgttaacgggttacccgttaaagtttacccgggttaacccggttaacgggtacccgtaaccccgggtaaccccggtaaaccgggtaaacccccccccg

SEQ ID NO: 233419 - DNA, 252 bp, Homo sapiens
  misc_feature: GYAE6OF01ENIWY.39.86.H09.1.454.CMB.1.raw
  modified_base (245)..(252): a, c, t, g, unknown or other
  misc_feature (245)..(252): n is a, c, g, or t
tcagtcgcactagtcacgaccggtgctcgatttagtgctatagacttgggtttgggggtttggtggtctccactcccgccttgacgaggctgattattactgcagctcatttgcaatcagtgaggcttatgtcttcggaagtgggaccaaggtcatcgtcctaggtcagcccaaggccaaccccactgtcactctgttcccacctcctcactagtgcgactgagcgggctggcaaggcgcatagnnnnnnnn

SEQ ID NO: 233420 - DNA, 742 bp, Homo sapiens
  misc_feature: GYAE6OF01BZTYA.39.86.H09.1.454.CMB.1.raw
tcagtcgcactagtcacgaccggtgctcgatttagtgctatagacttgggtttggggggggtctcaggaggcagcgctctcaggacatctccaccatggcctgggctctgctgctcctcaccctcctcactcaggcacagggtcctgggcccagtctcgccctgactcaggctgcctccgtgtctgggtctctaggacagtcgatcaccatctcctgcacgtcggaaccagcaggtggtacggttggggttatgactatgtcctcgtggtaccagacaatactccgaggaccacaccgaaccccctaaactcaacttacctaattttacgtggtaacggtactaagttaacgtcccggtacccgttaggttaacggggtttacctaaacgtccgttcttccgtcgtcggaccttaccgtaaggtccgtacggacctaaccgaccggtcccttacccgtcgtaaccctacttccgttaccgttcgggtccctaccggtacggtacgtacggaacgggaaccggtagggtctacgttaatttaacgttacgttacgacgttaccgtacttacgttacgttacgaacctaagttaccgtaggttacggtacggttacgttttacgttacggtttaccggttaacgggttaaagggttacccgggaaaccggttacgggttacccttaacgttacccggttacggttaccggtaccctaaacccgggaacccccgtaaaaccccgg

SEQ ID NO: 233421 - DNA, 791 bp, Homo sapiens
  misc_feature: GYAE6OF01ERNPG.39.86.H09.1.454.CMB.1.raw
tcagtcgcactagtcacgaccggtgctcgatttagtgctatagacttggggggggggtctcaggaggcagcgctctcaggacatctccaccatggcctgggctctgctgctcctcaccctcatcactcagggcacagggtcctgggcccagtctgccctgactcaggctgcctccgtgtctgggtctctaggacagtcgatcaccatcctcctgcactggaaccagcagtgtacggttgggggttatgactatcgtctccgtaggtaccagactaatactaccgaggccaacaccgacccccctaaaactccaattacctaatttacgtaggtacggtactaacggttaacgtccgggtaccccttacggttaacgggggttttacctaacgttccgtccttttccgtccgttacggtcccttacccgtaaacggttccgtacgggaaccctaaacccgtacccgggtcccccttaccccgtacgtaacccccttaacgttcccgttaccggtcccggggtaccccgttacccggtaagggtcccggttagggaaccgggtacgggtaacggtccgtttaacggttaacgttttaactttaccggtcgaccgtaacgtccttacgttaagtttacgaacttagtaccgtaggttacggtacggttactttacgttcggttaccgggttacgggtaaagggttacccgggtaaccgttaaacgggttccgtaaccggtttcccggttaccggttaacggtacccgggaacccgtaccccgggtaaaccccgg

SEQ ID NO: 233422 - DNA, 624 bp, Homo sapiens
  misc_feature: GYAE6OF01DG4K3.39.86.H09.1.454.CMB.1.raw
  modified_base (334)..(334): a, c, t, g, unknown or other
  misc_feature (334)..(334): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcgaggcacgacgggtccgtcgggcccagtctcgccctgactcgaggctcgcctccgtgtcgtgggtctcgtaggacagtcgatcacctactctcctcgcacgtacggaaccagcgtaggtcgggtacgggttggggttatcgtaactgtcgtctcgtacggtacagtacaatctacgagaccacgaccaccccaatcatctattagngtacgtacaagtacgtccggtaccttaggtacggtttactaacgtcgtcttcgtcgtcgactacgtagtcgtacggacaacgccgcctccgacgacctcgtccgtcgtcggccctacgacggtcgtaggacggacggtagtacgtagtaacttacgtacgtcgacgtactcttacgtacgttcaactagtacgtaggtacgtagttacgttagttcgttaacggtacgggagtacgggtaactacggtactaccggttacgtacgtacggacgaccgtacccgaaacccg

SEQ ID NO: 233423 - DNA, 547 bp, Homo sapiens
  misc_feature: GYAE6OF01CKE71.39.86.H09.1.454.CMB.1.raw
  modified_base (381)..(381): a, c, t, g, unknown or other
  misc_feature (381)..(381): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttatgactatgtctcctggtaccagcaatatccaggcacacgacccccaaactcatcatttatgaggtcagtaatcggccctgaggggtttctaatcgcttctctggctccaagtctggcaacgacgccctccctnaccctatcctcgtcgggctccgaggctggacggacgaggctagtatttacttactcgcagctactatataacaagcagcagctacgttcgttggtggttagttccgggacgggtacgggaaccgaaggtcctaacggtacccggttaccgtgggtcctaacccggg

SEQ ID NO: 233424 - DNA, 505 bp, Homo sapiens
  misc_feature: GYAE6OF01E2917.39.86.H09.1.454.CMB.1.raw
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaaactcatcatttatgaggtcagtaatcggccctgaggggtttctaatcgcttctctggctcaagtctggcaacacggcctccctgaccatctctgggctccgaggctgaggacgaggctgattatactgcagctcatttgctaatcagtgaggtcttagtgttcgttcggaagtcgggaccaaggtcagtcgtactaggtccagcccgaaacgg

SEQ ID NO: 233425 - DNA, 554 bp, Homo sapiens
  misc_feature: GYAE6OF01CD6MT.39.86.H09.1.454.CMB.1.raw
  modified_base (300)..(300): a, c, t, g, unknown or other
  misc_feature (300)..(300): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttggggtatgactatgtctctggtaccagcaatatccaggcacacgacccccaatcatctatttangagtcagtaatcggccctcgtaggggtttctaagtcgtcttctctcggctccgaagtctaggacaaccgacggtcctcccgtcgacctactcttacgtcgggtcctcgaggtctaggacggacgaggcgtagtaactttactactgcagtctctatttgactaagtctagtgagttcttagtgttcgttagggaagttacgggaactaacggtcgtagttccggtaccgttacggtcacggcccgtaaacccgg

SEQ ID NO: 233426 - DNA, 555 bp, Homo sapiens
  misc_feature: GYAE6OF01BH8AN.39.86.H09.1.454.CMB.1.raw
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgcccccaaactcatcatttatgagtcagtaatcggcctcgaggggtttctaatcgcttctctggctcaagtctggacaacaccggcctccctgaccatctctcgggctccgaggctggacggacgaggctagtatttattactgctagtccttctatttcgactaaagtcaggtggacggtctttagtggttacgttacgggtaaggtcgggtaaccaagggttcctaacgttccggttacccgttaaggtccgaccggaccccgtaaaccggg

SEQ ID NO: 233427 - DNA, 556 bp, Homo sapiens
  misc_feature: GYAE6OF01BDDYM.39.86.H09.1.454.CMB.1.raw
  modified_base (224)..(224): a, c, t, g, unknown or other
  misc_feature (224)..(224): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccngcagtgacggttgggggttatgactatgtctcctggtaccagcaatatccaggcacacgacccccaaatcatctatttatgagtcagtaactcggccctgtaggggtttctaatcgtcttctctcggctaccgaagtctggaccaacgccggtccctcccgtcgacctattcctcgtcgggcctccgacggctggaggacgaggctagtatttattactgcagcttctatttcgactaatcgaggtagaggtacttagtgttaccgttagggtaaggtcgggaacctaaggtcaacgttccgttacgtaggtccacggaccccgaaacccgg

SEQ ID NO: 233428 - DNA, 534 bp, Homo sapiens
  misc_feature: GYAE6OF01CQ9PK.39.86.H09.1.454.CMB.1.raw
  modified_base (362)..(362): a, c, t, g, unknown or other
  misc_feature (362)..(362): n is a, c, g, or t
tcagtcgcactagtcacgaccggtgctcgatttagtgctatagacttgggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttatgactatgtctcctggtaccagcaatatccaggcacacgcccccaaaactcatcatttatgagtcagtaatcggccctcgagggtttctaatcgcttctctgctcaagtctggacaacncggcctcctgaccatctcgtgggcctcgaggctggaggacgaggtctgtatttagttactgcagtctactatttcgactaatcgagtgacggttcttagtgttcgttacgggaaggtcgggaacctaaggtccagttccgtaccgtaggtccaacgcccgaacggaaccccc

SEQ ID NO: 233429 - DNA, 681 bp, Homo sapiens
  misc_feature: GYAE6OF01DLUSP.39.86.H09.1.454.CMB.1.raw
  modified_base (161)..(161): a, c, t, g, unknown or other
  misc_feature (161)..(161): n is a, c, g, or t
  modified_base (211)..(211): a, c, t, g, unknown or other
  misc_feature (211)..(211): n is a, c, g, or t
  modified_base (217)..(217): a, c, t, g, unknown or other
  misc_feature (217)..(217): n is a, c, g, or t
  modified_base (225)..(225): a, c, t, g, unknown or other
  misc_feature (225)..(225): n is a, c, g, or t
  modified_base (238)..(238): a, c, t, g, unknown or other
  misc_feature (238)..(238): n is a, c, g, or t
  modified_base (289)..(289): a, c, t, g, unknown or other
  misc_feature (289)..(289): n is a, c, g, or t
  modified_base (312)..(312): a, c, t, g, unknown or other
  misc_feature (312)..(312): n is a, c, g, or t
tcagtcgcactagtcacgaccggtgctcgatttagtgctatagacttgggttgggggtctcaggaggcagcgctctcaggacatctccaccagtcggcctgggctctgctcgctcctccaccctcctcactcgagggcacgcggtccgtcggccagtctcnccctgactcgagctcgtcctcgtgtcgttggtctacgacgactgactacnccactntcctcgtnactacgacgacgngacgtggttacggtagggttggtatcgtactgtccgttccacgtacgaacncgaactacgtccgacgacgaccncgtacccaccctaatctaactcgttaatcgaaggtcacgtaactcggtcccgtactaggggtcttaactcgtcgttacttccgtggtctaccgaagtactcgggactaccaacggcccgtaccctgtaccaacgtcgttccgtcggtacgtacctacgggacgtcggtaggtacccggagtacgtagttacttacgtttacgtcgtacgacgtactcgttagtttcgtaactaacgttactacggtacgttacggttcgttagtttacggtaaccggttacgggtacggtaaggttaccggtacgtaaccggttcctaccgggttacccgtaacggtaacccctacgggaaccccctgggtaaaccccc

SEQ ID NO: 233430 - DNA, 511 bp, Homo sapiens
  misc_feature: GYAE6OF01CJ2ZK.39.86.H09.1.454.CMB.1.raw
  modified_base (303)..(303): a, c, t, g, unknown or other
  misc_feature (303)..(303): n is a, c, g, or t
  modified_base (340)..(340): a, c, t, g, unknown or other
  misc_feature (340)..(340): n is a, c, g, or t
  modified_base (365)..(365): a, c, t, g, unknown or other
  misc_feature (365)..(365): n is a, c, g, or t
tcagtcgcactagtcacgaccggtgctcgatttagtgctatagacttgggggggggtctcaggaggcagcgctctcaggacatctccaccatggcctgggctctgctgctcctcaccctcctcactcagggcacagggtcctgggcccagtctgccctgactcaggctgcctccgtgtcgtgggtctcgtaggacagtcgatcaccatcctcctgcactggaaccagcagtgacggttggggttatgactatgtctcctggtaccagcaatatccaggcacacgcccccaaatcatcatttangagtcagtaatccggcctgagggtttctatcgcttcnctgctcagtctgacacgcgcctccnaccatctcgtcggctcgagctaggacggcgaggtctagtattattaatgacagtctactatttgactaatcgagtggagtcttagtgtcgttagggagtgggaactaggtctattccgtacgtaggcacggcccgaacggtacccc

SEQ ID NO: 233431 - DNA, 552 bp, Homo sapiens
  misc_feature: GYAE6OF01D3JMZ.39.86.H09.1.454.CMB.1.raw
  modified_base (435)..(435): a, c, t, g, unknown or other
  misc_feature (435)..(435): n is a, c, g, or t
tcagtcgcactagtcacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgcccccaaactcatcatttatgaggtcagtaactccggccctcgtagggtttctaatcgcttctctggctccaagtctggccaacgaccgccctccctcgaccatctcgtgggccctcgaggctggaggacgaggctagtattattacngctagcttactatttcgactaatcgagtggacgtctttagtcgttacgttacgggaaggttcgggaaccgttaacggtctacgttccgtacgtaaggtccgacgccccgtaaaccgg

SEQ ID NO: 233432 - DNA, 526 bp, Homo sapiens
  misc_feature: GYAE6OF01BQA6H.39.86.H09.1.454.CMB.1.raw
  modified_base (303)..(303): a, c, t, g, unknown or other
  misc_feature (303)..(303): n is a, c, g, or t
  modified_base (358)..(358): a, c, t, g, unknown or other
  misc_feature (358)..(358): n is a, c, g, or t
  modified_base (464)..(464): a, c, t, g, unknown or other
  misc_feature (464)..(464): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgacccccaaactcatcatttangaggtcagtaatcggcctcgtaggggtttctaatcgtcttctctggctcaagtcnggcaacacggccctcctcgacctactctcgtggcctaccgaggctaggaggacgaggctagactttattactgcagctctatttgactatcagtgagtctttttangttacgtcggtaaggtcgggaaccaggtcacgtccgtacgtaggtccacgtacccgaaccgg

SEQ ID NO: 233433 - DNA, 539 bp, Homo sapiens
  misc_feature: GYAE6OF01DCDO7.39.86.H09.1.454.CMB.1.raw
  modified_base (242)..(242): a, c, t, g, unknown or other
  misc_feature (242)..(242): n is a, c, g, or t
  modified_base (269)..(269): a, c, t, g, unknown or other
  misc_feature (269)..(269): n is a, c, g, or t
  modified_base (478)..(478): a, c, t, g, unknown or other
  misc_feature (478)..(478): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggngcttataatatgtctcctggttccaanagcattcaggcagccgcccgaaatcttaatttatgagttcttcgcggtcctcgtagggtttctagtcgtcttcgtccggctcaagtctcggcaacgacggcctcctgaccatctctagactccgaggtctaggacggtacgaggctagtactattagttagctagcttacattatactagaacgttacaatggttactcctagtcggtnttcgggttcggcgggaaggtccaaggttcgaccgttcgtaggccacgcccgaaggtccccg

SEQ ID NO: 233434 - DNA, 533 bp, Homo sapiens
  misc_feature: GYAE6OF01AQBY7.39.86.H09.1.454.CMB.1.raw
  modified_base (420)..(420): a, c, t, g, unknown or other
  misc_feature (420)..(420): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatactccaggcacacgcccccaaactcatcatttatgaggtcagtaatcggccctcgaggggtttctaatcgtcttctctggctccgaagtctggcaacacggcctcctgaccatctcgtcggcctccgaggctggacggacgaggctgattnttactgcacgtctcgtatttcgactaagtcctagtgacgtcttagtgttcgttacgggaagtcgggtaaccgaggttccacgttcgtaccgtaggtcacgcccgtaaacccgg

SEQ ID NO: 233435 - DNA, 541 bp, Homo sapiens
  misc_feature: GYAE6OF01AU5JD.39.86.H09.1.454.CMB.1.raw
  modified_base (303)..(303): a, c, t, g, unknown or other
  misc_feature (303)..(303): n is a, c, g, or t
tcagtcgcactagtcacgaccggtgctcgatttagtgctatagacttgggtttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgcccccaaactcatcatttangaggtcagtaatcggccctcgaggggtttctaatcgcttctctggctcaagtctggcacacgcctcctgaccatctgtgggcctccgaggctgaggacgaggctgattatactgcagctctatttcgactaattcgagttggaggtccttagtgttccggtttacggaaggttcggggaaccctaagggttcaacgttccggtacccgttagggtccaaccggtaccccgaaaccggg

SEQ ID NO: 233436 - DNA, 528 bp, Homo sapiens
  misc_feature: GYAE6OF01BM3HE.39.86.H09.1.454.CMB.1.raw
  modified_base (244)..(244): a, c, t, g, unknown or other
  misc_feature (244)..(244): n is a, c, g, or t
  modified_base (436)..(436): a, c, t, g, unknown or other
  misc_feature (436)..(436): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttangactatgtctcctggtaccagcaatatccaggcacacgacccccaaatcatcatttatgagtcagtaatcggccctgtaggggttctaatcgtcttctctggctcaagtctgcaacacggcctccctgaccatctcgtcggcctcaggctagagggacgaggctagtatttaattactgcgagctctatttnactaatcaggtgtaggtcttagtgttccgttacgggtaaggtgggaacctaaggtctagttccgttaccgtaggtccgacgacccgaaccgg

SEQ ID NO: 233437 - DNA, 622 bp, Homo sapiens
  misc_feature: GYAE6OF01DECFJ.39.86.H09.1.454.CMB.1.raw
  modified_base (311)..(311): a, c, t, g, unknown or other
  misc_feature (311)..(311): n is a, c, g, or t
tcagtcgcactagtcacgaccggtgctcgatttagtgctatagacgttgggttgggggtctcaggaggcagcgctctcaggactatctcctaccatggcctgggctctgctgctcctcaccctcctcactcagggtcacagggtcctgggcccagtctgccctgactcgaggctgcctccgtgtctgggtctctaggacagtcgatcaccagtcctcctgcactggaaccagcagtgacgttggggtatgactatgtactcctggtaccagcaatactccaggcacacgaccccaatcgatctatttacgngaggtcagtactcggcctgtaggttcaatcgtcttcgtctggctacgtaagtcgtcggacctaacgtaccggtcccttccgtacgaccctagttcctacgtcgggacccttcgaggaccttggaacgggaacggtaggtacgtagttaactttacgttacgtagtaccgagtctacgttacgttttgactaatcgtagtacggtacgttactttaagtcggtaccgttaagggaaggttacgggaacccgttaaggttaccgtaacgttcccgttaccggtaggtacgaacccggtcccggtaaaacccgg

SEQ ID NO: 233438 - DNA, 528 bp, Homo sapiens
  misc_feature: GYAE6OF01B33MO.39.86.H09.1.454.CMB.1.raw
  modified_base (424)..(424): a, c, t, g, unknown or other
  misc_feature (424)..(424): n is a, c, g, or t
  modified_base (428)..(428): a, c, t, g, unknown or other
  misc_feature (428)..(428): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatggactatgtctcctggtaccagcaatatccaggcacagcccccaaactcatcatttatgaggtcagtaactcggccctctaggggtttctaatcgtcttctctggctccaagtctggcaacacggcctcctgaccatctctgggctccgaggctgaggacgaggctgatttattactgcngctnatttgactaatcagtgaggtcttagtgttacgtttcgggaagttcgggaacctaagggttccagttccggttctaagggtccaacggccccgtaaaccgg

SEQ ID NO: 233439 - DNA, 255 bp, Homo sapiens
  misc_feature: GYAE6OF01A1V4T.39.86.H09.1.454.CMB.1.raw
  modified_base (247)..(255): a, c, t, g, unknown or other
  misc_feature (247)..(255): n is a, c, g, or t
tcagtcgcactagtcacgaccggtgctcgatttagtgctatagacttgggtttgggggtttggtggtctccactcccgccttgacgaggctgattattactgcagctcatttgcaatcagtgaggcttatgtcttcggaagtgggaccaaggtcatcgtcctaggtcagcccaaggccaaccccactgtcactctcgttcccaccctcctcactagtgcgactgagcgggctggcaaggcgcatagnnnnnnnnn

SEQ ID NO: 233440 - DNA, 250 bp, Homo sapiens
  misc_feature: GYAE6OF01AK45H.39.86.H09.1.454.CMB.1.raw
  modified_base (245)..(250): a, c, t, g, unknown or other
  misc_feature (245)..(250): n is a, c, g, or t
tcagtcgcactagtcacgaccggtgctcgatttagtgctatagacttgggtttgggggtttggtggtctccactcccgccttgacgaggctgattattactgcagctcatttgcaatcagtgaggcttatgtcttcggaagtgggaccaaggtcatcgtcctaggtcagcccaaggccaaccccatgtcactctgttcccaccctcctcactagtgcgactgagcgggctggcaaggcgcatagnnnnnn

SEQ ID NO: 233441 - DNA, 594 bp, Homo sapiens
  misc_feature: GYAE6OF01B4QIC.39.86.H09.1.454.CMB.1.raw
  modified_base (125)..(125): a, c, t, g, unknown or other
  misc_feature (125)..(125): n is a, c, g, or t
  modified_base (249)..(249): a, c, t, g, unknown or other
  misc_feature (249)..(249): n is a, c, g, or t
  modified_base (293)..(293): a, c, t, g, unknown or other
  misc_feature (293)..(293): n is a, c, g, or t
  modified_base (330)..(330): a, c, t, g, unknown or other
  misc_feature (330)..(330): n is a, c, g, or t
  modified_base (337)..(337): a, c, t, g, unknown or other
  misc_feature (337)..(337): n is a, c, g, or t
  modified_base (371)..(371): a, c, t, g, unknown or other
  misc_feature (371)..(371): n is a, c, g, or t
tcagtcgcactagtcacgaccggtgctcgatttagtgctatagacgtttgggggtttggggggggtctcacggaggcagcgcctctcaggacatctccaccatggcctgggctctgctgcctccncaccctcctcactcagggcacgtacgggtcctcgggcccagtctgtaccctgactcgaggctgcctccgtgtcgtgggtctcgtaggacagtcgatccgaccgatctcctgcacgtcggaaccngcagtgtacggttggggttatggactagtcgtctcctggtaccngcaatctccgaggcacgcgccccaatcatctaattanagagtanagtagcgacctgtagggtttacacgtcgtcttcncgtcgtcctactagtctgaccaaccgcgtcctaccgtacgacctattcgtacggtcgactaccgagctaggacggacgacggtctagtatttcgtacgtcgcgtacgtctacgttagttgacgtacgtcgtagagtcgttacttaggtacgttacgtcgggtagtccgggaaagtacggttctaccggttccgtacgtacgggccaacgcccgtaaaccccgg

SEQ ID NO: 233442 - DNA, 709 bp, Homo sapiens
  misc_feature: GYAE6OF01CLFM8.39.86.H09.1.454.CMB.1.raw
  modified_base (230)..(230): a, c, t, g, unknown or other
  misc_feature (230)..(230): n is a, c, g, or t
tcagtcgcactagtcacgaccggtgctcgatttagtgctatagacttgggctggggtctcaggaggcagcgctctcaggacatctccaccatggcctgggctctgctgctcctcaccctctcactcagggcacagggtcctgggcccagtctcgccctgactcaggctcgcctccgtgtcgtgggtctcgtaggacagtcgatcacctatctcctgcacgtacggaaccngcaggtggtacggttggggttatgtaacttatgtctccgtaggtaccagtacaactactaccgaggaccaacgaaccgacccccaaaactcaacttacttaatttacgtacgtaaggtacaaggttaacgtccggtacccttacggtaaggtttacctaacgtccgtcgttctcgtcggtctacccgtaagtccgtacggaccaaaccgtccggtacccttacccgtacgtaccctaacgttcctttccggaccggttcctaccggaagggtcgtacgggaacgggtaccggacggtactaaggtttaactttaacgttaaccgtcgtaccgtaaccggttcctttaaacgttacgttttacgaacttaaacggtacgtaagggtaacgtacggttactttacgtacggttaccggtttaagggaacggttacggtaaccgaggttctacgttaccgtaccgtagccgaccgtaacccg

SEQ ID NO: 233443 - DNA, 792 bp, Homo sapiens
  misc_feature: GYAE6OF01D3SED.39.86.H09.1.454.CMB.1.raw
tcagtcgcactagtcacgaccggtgctcgatttagtgctatagacttgggttgggggtctcaggaggcagcgctctcaggacatctccaccatggcctgggctctgctgctcctcaccctcctcactcagggcacgagggtcctgggcccagtctgccctgactcaggctcgcctcgtgtctgggtctcgtaggacagtcgactcaccatcctcctgcactggaaccagcgtagtggtacggttggggttatgacttatcgtacctcgtacggtaaccagactaatacgtccaaggaccaaccaccgaacccccaaaatccaattactaattttagaggtagtactaagtaacgtccggaccttacggtaggggtttacctaacgttcgttcttcgtcgtacggtcctaccgaagtccgtacggaccaaaccgtccggtcccttacccgacgtaaccctacgttccgtcggtcggtaccctaccggaacggtcgtaacgggacgggacgtacggtacgttagtaactttaacgttacgtacggacctacggtaccttacgttaacgttttacgaaaccgttaagttacggtacgggttacggtaacggtttaccgttttaaacggttcggtttaaccgggtttaaaccgggggttaaacggggttaacccgggggttaaaacccgttaaaccgggggttaacccgttaaaccggtttaccccgggtttaacccggttaaacccgggttaaccccgtaaacccgggtaaacccccggtaaaaacccccccggg

SEQ ID NO: 233444 - DNA, 525 bp, Homo sapiens
  misc_feature: GYAE6OF01AD7QF.39.86.H09.1.454.CMB.1.raw
  modified_base (306)..(306): a, c, t, g, unknown or other
  misc_feature (306)..(306): n is a, c, g, or t
  modified_base (406)..(406): a, c, t, g, unknown or other
  misc_feature (406)..(406): n is a, c, g, or t
  modified_base (419)..(419): a, c, t, g, unknown or other
  misc_feature (419)..(419): n is a, c, g, or t
  modified_base (422)..(422): a, c, t, g, unknown or other
  misc_feature (422)..(422): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttggggttatggactatgtctcctggtaccagcaatatccaggcacagacccccaaatcatcatttangagtcagtaatcggccctgaggggtttctaatcgcttctctggctcaagtctggcacacggcctcctgaccatctctgggctccgaggctaggaggacgngctgatttatacngcngctcatttgactaatcgagtgaggtctttagtgttacgttcgggaaggttacgggacctaaggtcacgttcggtaccgtaggtccacggccccgtaaacccgg

SEQ ID NO: 233445 - DNA, 725 bp, Homo sapiens
  misc_feature: GYAE6OF01CUA05.39.86.H09.1.454.CMB.1.raw
  modified_base (322)..(322): a, c, t, g, unknown or other
  misc_feature (322)..(322): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtcctgggtctctaggacagtcgatcaccatctcctgcactggaaccagcaggtgtacggttggggttatcgactagtcgtctcgtggtaccagactaatctcgaggccaacaccgacccctaaactcatctaattttagngacgtacaagtacgtccgtacccgtagtacggggtttactaagtccgttaccttcgtacgtcggtcctaccgtaacgttccgtaggaaccctaaccgtaccggtccccttacccgtacgtacctacgttccgtccggtacgggtccctacggacggtacgtaggaacgggtacggtacggtcgtacggttaactttacgtacgtacggacgtcgtacttacgttagttacgtaactaacgttacgtaggttacgggtaacggtttacgttaccgttacgggtttaccgggttaaacggggtaacgggttaccgggtaaacccgttaacgggttaccgttaccggtttacccgggttaccgttaacggggtaacccgtaaccggtaaccccggttaaacccggg

SEQ ID NO: 233446 - DNA, 609 bp, Homo sapiens
  misc_feature: GYAE6OF01DCJ6T.39.86.H09.1.454.CMB.1.raw
  modified_base (313)..(313): a, c, t, g, unknown or other
  misc_feature (313)..(313): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcaggcacagggtcctgggcccagtctgtcctgactcaggctgcctccgtgtctgggtctctaggacagtcgatcaccatctcctgcacgtggaaccagcagtggtacggttgggggttatgactatgtctccgtggtaccagcaatactccaggccacacgacccccaaatcatctatttangagtcagtaagtcgaccctgtacgggttactaagtcgtcttcgtacgtcggtctaccgtaagtccgtacggacctaaccgtaccggtcccttacccgtcgaaccctactccgttcgtcggggtccctaccgaacggtccgtaggtacggaacggtacggtccgtagtaactttaacgttacgtagacctcgtcttacgtacgttacgaactaagtcgtagtagtagtcttagtcgttacgtacggtaggtacggaccgtagtcgtacgtcgtacgtaggtcacgtcccgtaacccg

SEQ ID NO: 233447 - DNA, 590 bp, Homo sapiens
  misc_feature: GYAE6OF01DN4PJ.39.86.H09.1.454.CMB.1.raw
  modified_base (272)..(272): a, c, t, g, unknown or other
  misc_feature (272)..(272): n is a, c, g, or t
  modified_base (304)..(304): a, c, t, g, unknown or other
  misc_feature (304)..(304): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttatgactatgtctccgtggtaccagcaatntccaggcacacgacccccaaatcatcatttangagtcaagtatccggcctcgaggggtttctaagtcgtcttctcgtggtcctaccgtaagtccgtagggaccaaaccgaccggcccttacccgtacgaaccctacttccgtcgtcggggtccctccgaggtcgtaggaacggacggtacggctaggtaatttacttacgtgctaagtctacgtatttcgactaatcgagtggtacgtctttagtggttcgttacgggaaggttcgggaaacctagggttcaggttccgtaccgttaggtccacgcccgtaaacccgg

SEQ ID NO: 233448 - DNA, 248 bp, Homo sapiens
  misc_feature: GYAE6OF01EQN3Z.39.86.H09.1.454.CMB.1.raw
  modified_base (247)..(248): a, c, t, g, unknown or other
  misc_feature (247)..(248): n is a, c, g, or t
tcagtcgcactagtcacgaccggtgctcgatttagtgctatagacttgggtttggggggtttggtggtctccactcccgccttgacgaggctgattattactgcagctcatttgcaatcagtgaggcttatgtcttcggaagtgggaccaaggtcatcgtcctaggtcagcccaaggccaaccccactgtcactctgttcccgccctcctcactagtgcgactgagcgggctggcaaggcgcatagnn

SEQ ID NO: 233449 - DNA, 679 bp, Homo sapiens
  misc_feature: GYAE6OF01EAH3R.39.86.H09.1.454.CMB.1.raw
  modified_base (294)..(294): a, c, t, g, unknown or other
  misc_feature (294)..(294): n is a, c, g, or t
tcagtcgcactagtcacgaccggtgctcgatttagtgctatagacttgggtttggggggggtctcaggaggcaggcgctctcaggacatctaccaccatggcctgggctctgctgctcctcaccctcctcactcagggcacagggtcctgggcccaggtctggcctgacacagcctgcctcgtgtctgacgactcctggacagtcgtatcaccattcctcctgcacgtcggaaccagcaggtgaccgttggtcgtcttaattaacttactcgttacgttcctcggttaccaacncgtcatttcacggccaacggcccgaccccgtaaacttcctttaaagtttcgtacggtacggttccgttttccggccgggtccccttcggttacggggtttcctacggttccgtacctttctccgtcggtccttaccgtaagttccgtcgggacctaaaccggtccgggtcctcccgtaggaccctacttccgtcgtcgggccttacgaggtcgtaggacggacgacggtctagtatttacttctgctagtctcgtagtttcgactaatcgtaggtacgtaggtctttagttcggtttacgttaggggtaacggttacgggaacccgtaggtacctacgttaccgttcccggtaaggtaccgaaccggtcccgaaacggtaccccc

SEQ ID NO: 233450 - DNA, 252 bp, Homo sapiens
  misc_feature: GYAE6OF01C5FNX.39.86.H09.1.454.CMB.1.raw
  modified_base (242)..(242): a, c, t, g, unknown or other
  misc_feature (242)..(242): n is a, c, g, or t
  modified_base (248)..(252): a, c, t, g, unknown or other
  misc_feature (248)..(252): n is a, c, g, or t
tcagtcgcactagtcacgaccggtgctcgatttagtgctatagacttgggtttggggggtttggtggtctccactcccgccttgacgaggctgattattactgcagctcatttgcaatcagtgaggcttatgtcttcggaagtgggaccaaggtcatcgtcctaggtcagcccaaggccaaccccatgtcactctgttccccaccctcctcactagtcgcgactgagcgggctggcaaggcncatagnnnnn

SEQ ID NO: 233451 - DNA, 536 bp, Homo sapiens
  misc_feature: GYAE6OF01CH2HC.39.86.H09.1.454.CMB.1.raw
  modified_base (305)..(305): a, c, t, g, unknown or other
  misc_feature (305)..(305): n is a, c, g, or t
  modified_base (365)..(365): a, c, t, g, unknown or other
  misc_feature (365)..(365): n is a, c, g, or t
  modified_base (396)..(396): a, c, t, g, unknown or other
  misc_feature (396)..(396): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatactccaggcacacgacccccaaactcatctatttangagtcagtaagtcggccctgacgggtttctaatcgtcttctctggctcaagtctgcaacncggcctccctagaccatctcgtggcctccgnggctggacggacgaggtctgtaatttacgttacgtgcagtcttactatttcgactaatcgagtgtaggtcttagtcgttcgttacgggaaggtcggaacgtaagtctacgtccgtacgtaggaccacgacccgtaaccgg

SEQ ID NO: 233452 - DNA, 254 bp, Homo sapiens
  misc_feature: GYAE6OF01ACCB9.39.86.H09.1.454.CMB.1.raw
  modified_base (246)..(254): a, c, t, g, unknown or other
  misc_feature (246)..(254): n is a, c, g, or t
tcagtcgcactagtcacgaccggtgctcgatttagtgctatagacttgggtttggggggtttggtggtctccactcccgccttgacgaggctgattattactgcagctcatttgcaatcagtgaggcttatgtcttcggaagtgggaccaaggtcatcgtcctaggtcagcccaaggccaaccccatgtcactctgttcccaccctcctcactagtgcgactgagcgggctggcaaggcgcatagnnnnnnnnn

SEQ ID NO: 233453 - DNA, 579 bp, Homo sapiens
  misc_feature: GYAE6OF01A51UE.39.86.H09.1.454.CMB.1.raw
  modified_base (304)..(304): a, c, t, g, unknown or other
  misc_feature (304)..(304): n is a, c, g, or t
tcagtcgcactagtcacgaccggtgctcgatttagtgctatagacttgggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttatgactatgtctcctggtaccagcaatatccaggcacacgacccccaaactcatctatttangagtcagtaatcggcctgagggtttctaatcgcttctctcggctcgaagtctcgggaccaacgaccggtccctcccgtagaccctatccttcgtcgggtcctcccgaggtctggaacggacggaggcttggtaatttacgttacgcgcagtctctagtttcgactaatcgaggtacgaggtctttagtgttaccgttacgggaaggttcgggaaccgtaggttacctacgttccggtaccttagggtaccaccggaccccgaacgggtaaccccc

SEQ ID NO: 233454 - DNA, 618 bp, Homo sapiens
  misc_feature: GYAE6OF01CP7AO.39.86.H09.1.454.CMB.1.raw
  modified_base (304)..(304): a, c, t, g, unknown or other
  misc_feature (304)..(304): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatcctccttcactggaagcagcagtgacgttggtggttataactatgtctctggtaccaacagcaccagacaaacgccccaaactcatgatttangaggtcagtaactcggccctgtagggtttctaagtcgtcttctcgtcggtctcctaagtctaggaccaaacgccggtcccttccctacgacctacttccgtcgtcgggtccttaccgaggtccgtaggaacggacgagggcgttagtaatttacgttaacgtgctaagcttacgaagtacttaacgaacgacagtaccgacgacctaacgttacgttggttacggttacggtttccggggacgggtaacgggaaccgtaaacggtcgtacgtacccggttaccgtagggtaccaaccgggtacccgtaaccggg

SEQ ID NO: 233455 - DNA, 594 bp, Homo sapiens
  misc_feature: GYAE6OF01CN9KN.39.86.H09.1.454.CMB.1.raw
  modified_base (272)..(272): a, c, t, g, unknown or other
  misc_feature (272)..(272): n is a, c, g, or t
  modified_base (483)..(483): a, c, t, g, unknown or other
  misc_feature (483)..(483): n is a, c, g, or t
tcagtcgcactagtcacgaccggtgctcgatttagtgctatagacttgggctggggtctcaggaggcagcgctctcaggacatctccaccatggcctgggctctgctgctcctcaccctctcactcagggcacagggtcctgggcccagtctgccctgactcaggctgcctccgtgtctgggtctctaggacagtcgatcaccatctcctgcactggaaccagcagtgacggttggggttatgactagtgtcctcgtggtaccagcaatacnccagcacaccgccccaaactcatctatttactgacgtcagtaacgtcgtacctcgtacggtttactaatcgtcttctctcggctacctagtcctaggaccaaccgaccgtccctacccgtcgacctactcctacgtgggtccttccgaggtcctgacggtacggagtcgtagttactttaagttcgtgtacctagtccttacgtacgtttnaactaagtcgtaaggtggtaacgtcttagttcgttaccggttaggtaaacgggtcggaaaccgttaggtcctaacgttccgtacggttacggtccgtaacccggaaccccg

SEQ ID NO: 233456 - DNA, 671 bp, Homo sapiens
  misc_feature: GYAE6OF01CG5QI.39.86.H09.1.454.CMB.1.raw
  modified_base (310)..(310): a, c, t, g, unknown or other
  misc_feature (310)..(310): n is a, c, g, or t
tcagtcgcactagtcacgaccggtgctcgatttagtgctatagacttggggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttatgactatgtctcctggtaccagcaatatccaggccacacgacccccaactcatctatttangagtcaagtaactccggccctgtacggggtttctaagttcgtcttctcgtggcctaccgtaagtcgtggacctaaccgaccggcccttccctacgaccctatccgtcgtcgggcctccgacggtcgtaggaacgggacggacggtccgttagtaactttaacgttaccgtagacgtaacgtccttacgttagttttcgacttaaacgttccgtaggttcgggacggttacctttaagttcgggtttaccgtttaacggggaagggttacggggaaacccgttaaacggggttcctaacggtttccccgggttaaccgttaccggggttaccctaaccgggtacccccggtaaaaccccggg

SEQ ID NO: 233457 - DNA, 525 bp, Homo sapiens
  misc_feature: GYAE6OF01BI30X.39.86.H09.1.454.CMB.1.raw
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgcccccaaactcatcatttatgaggtcagtaatcggccctcaggggtttctaatcgcttctctggctccaagtctggcaacacggcctccctcgacctactctctcgggctccgaaggctgacggacgaggctagatttattactgcagctctatttgactatcagtgaggtcttagtgttcgttacgggaagtgggaaccaaggttcaagttcgtactaggtcacgcccgtaaacccgg

SEQ ID NO: 233458 - DNA, 571 bp, Homo sapiens
  misc_feature: GYAE6OF01ALTGM.39.86.H09.1.454.CMB.1.raw
  modified_base (306)..(306): a, c, t, g, unknown or other
  misc_feature (306)..(306): n is a, c, g, or t
  modified_base (485)..(485): a, c, t, g, unknown or other
  misc_feature (485)..(485): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctggcccagtctgccctgactcaggctgcctccgtgtctgggtctctaggacagtcgatcaccatctcctgcactggaaccagcagtgacggttgggggttatgactatgtcctccgtggtaccagcaatactccaggcacacgcccccaaactcatctatttangaggtcagtaactcgccctgtacgggtttctaagtcgtcttctcgtcgcctaccaagtctcggaccaaccgtccggcccttcccgtgaaccctacttcctacgtcgggaccctccgagtccgtaggacgggacgacggtctagttaatttacgtactcgactagtcctcgtagttcganacttcgagtgacgtcttagtgtacgttaggaaggtcgggaaaccctaggtactacgttccgtacgttagcgacgcccgtaacccgg

SEQ ID NO: 233459 - DNA, 619 bp, Homo sapiens
  misc_feature: GYAE6OF01C0E4F.39.86.H09.1.454.CMB.1.raw
  modified_base (310)..(310): a, c, t, g, unknown or other
  misc_feature (310)..(310): n is a, c, g, or t
  modified_base (502)..(502): a, c, t, g, unknown or other
  misc_feature (502)..(502): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctccgtggtaccagacaatactccaggcacaccgacccccaatcatctatttanagaggtcagtaactccggccctagtagggtttctaactcgtcttctcgtggtactaccgtaacgtcgtagacctaaccgacccggcccttcccgtacgaccctacgttccgtacgtcggggtccctaccgacgggtccgttaggaacggaccggtaggtctagtaagtttactcgtagacacgtcttacgtntttagactaatacgtaggtgtacgttacttagtgttacgttacgggaaggttacgggaaacctaagggttacctagttacccgtacgttaggtaccaaccggtccccggaaacccgg

SEQ ID NO: 233460 - DNA, 560 bp, Homo sapiens
  misc_feature: GYAE6OF01BAJBW.39.86.H09.1.454.CMB.1.raw
  modified_base (293)..(293): a, c, t, g, unknown or other
  misc_feature (293)..(293): n is a, c, g, or t
  modified_base (301)..(301): a, c, t, g, unknown or other
  misc_feature (301)..(301): n is a, c, g, or t
  modified_base (457)..(457): a, c, t, g, unknown or other
  misc_feature (457)..(457): n is a, c, g, or t
  modified_base (484)..(484): a, c, t, g, unknown or other
  misc_feature (484)..(484): n is a, c, g, or t
tcagtcgcactagtcacgaccggtgctcgatttagtgctatagacttgggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtggacggttgggggttatgactatgtctcctggtaccagcaatatccaggcacacgccccaaaccntcatttangaggtcagtaactcggccctgtagggtttctaagtcgtcttctctggcctaccgtaagttctcgggacaacgaccggtccctccctgaccctatcctcgtgggcctccgaggtcctggacgggacgagggtctaggtactttatacgtgcagtctntattcgacatcaagtcgagtctttagngttcgtacgggaaggtcgggaccgtaaggttccgacgttcgtcgtaacgcgaccgacccggtacgcccctaacccg

SEQ ID NO: 233461 - DNA, 745 bp, Homo sapiens
  misc_feature: GYAE6OF01CVHCO.39.86.H09.1.454.CMB.1.raw
  modified_base (224)..(224): a, c, t, g, unknown or other
  misc_feature (224)..(224): n is a, c, g, or t
  modified_base (302)..(302): a, c, t, g, unknown or other
  misc_feature (302)..(302): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccngcagtgacggtttgggggtatgactatgtctcctggtaccagcaatatccaggcacacgaccccaaatcatcatttangagtcagtaactccggccctgtaggggtttctaagtcgtactttctctcggtctaccgtaagttccgtacggaccaaccgtaccgggtcccttcccgtacgaaccctacgttaccgttcgtacggggccttacccgaacgggtaccgttagggacgggaaccgggtagggtaccgtaggttaacgttttaacgtttaaccgtcggtaccgtaaacggtccttacgtttaacgttttcggaaccttaaacggttacccgtaagggttcgggtaaacgggtttccttttaaaggtttccggtttaccggtttaaccgggggtaaagggttaccggggggtaaaaccccgttaaacggggttacccgtaaacggtttccccgggtttaaacccggttacggggtttaacccgaacccgggtaacccccggtaaaaaccccccgggg

SEQ ID NO: 233462 - DNA, 503 bp, Homo sapiens
  misc_feature: GYAE6OF01AJ3US.39.86.H09.1.454.CMB.1.raw
  modified_base (359)..(359): a, c, t, g, unknown or other
  misc_feature (359)..(359): n is a, c, g, or t
  modified_base (385)..(385): a, c, t, g, unknown or other
  misc_feature (385)..(385): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgcccccaaatcatcatttatgaggtcagtaatcggccctcgaggggtttctaatcgcttctctgctcagtctggcacncgcctcctgccatctctgggctccgnggctggagacgaggctgattattactgcagctctatttgcaatcagtgaggtcttagtgttacgttcggaaggtcgggaccaagggttcagtccgtcctaggtccacgcccgaaccgg

SEQ ID NO: 233463 - DNA, 247 bp, Homo sapiens; identical to SEQ ID NO: 233280
  misc_feature: GYAE6OF01ANRSB.39.86.H09.1.454.CMB.1.raw
  modified_base (246)..(247): a, c, t, g, unknown or other
  misc_feature (246)..(247): n is a, c, g, or t

SEQ ID NO: 233464 - DNA, 498 bp, Homo sapiens
  misc_feature: GYAE6OF01A6WOV.39.86.H09.1.454.CMB.1.raw
  modified_base (374)..(374): a, c, t, g, unknown or other
  misc_feature (374)..(374): n is a, c, g, or t
  modified_base (448)..(448): a, c, t, g, unknown or other
  misc_feature (448)..(448): n is a, c, g, or t
tcagtcgcactagtcacgaccggtgctcgatttagtgctatagacttgggtttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatggactatgtctcctggtaccagcaatatccaggcacagcccccaaactcatcatttatgaggtcagtaatcggccctcaggggtttctaatcgcttctctggctccaagtctggcaacacggcctcccngaccatctctgggctccgaggctgacgacgagctgattattactgcagctctatttgcaatcagtgaggcttangttcgttcggaagtcgggacaaggtcatcgtactaggtcagccctaacgg

SEQ ID NO: 233465 - DNA, 267 bp, Homo sapiens
  misc_feature: GYAE6OF01AGBCL.39.86.H09.1.454.CMB.1.raw
  modified_base (243)..(243): a, c, t, g, unknown or other
  misc_feature (243)..(243): n is a, c, g, or t
  modified_base (249)..(267): a, c, t, g, unknown or other
  misc_feature (249)..(267): n is a, c, g, or t
tcagtcgcactagtcacgaccggtgctcgatttagtgctatagacttgggtttgggggtttggtggtctccactcccgccttgacgacggctgattattactcgcagctcatttgcaatcagtgtaggcttatgtcttcggaagtgggaccaaggtcatcgtcctaggtcagcccaaggccaaccccactgtcactctgttcccaccctcctcactagtgcgactgagcgggctggcaaggcncatagnnnnnnnnnnnnnnnnnnn

SEQ ID NO: 233466 - DNA, 633 bp, Homo sapiens
  misc_feature: GYAE6OF01DFCKL.39.86.H09.1.454.CMB.1.raw
  modified_base (443)..(443): a, c, t, g, unknown or other
  misc_feature (443)..(443): n is a, c, g, or t
tcagtcgcactagtcacgaccggtgctcgatttagtgctatagacttgggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcgtgtaccagcaatatcaggcaccacgacccccaaatcatctatttatgagtcagtaactcggaccctgtagggtttactaatcgtctttcgtctcggtcctacgaacgttccgtgggacctaaccgaccggtcccctaccctacgacctactccgtaccgtgggccttccgaggtctaggacgggacgngtccgtagtactttagttactgactacgcttactagtttacgactaagttcacggttaggtacggttacttacgttcggttaccgttaacggggtaacgggttacgggaacccgttaaagggtccttaaccggttccggtttaccgtacgggttaccgaaacccgacccccgtaaacgggtaaccccccc

SEQ ID NO: 233467 - DNA, 253 bp, Homo sapiens
  misc_feature: GYAE6OF01DA9SX.39.86.H09.1.454.CMB.1.raw
  modified_base (241)..(241): a, c, t, g, unknown or other
  misc_feature (241)..(241): n is a, c, g, or t
  modified_base (247)..(253): a, c, t, g, unknown or other
  misc_feature (247)..(253): n is a, c, g, or t
tcagtcgcactagtcacgaccggtgctcgatttagtgctatagacttgggtttggggggtttggtggtctccactcccgccttgacgaggctgattattactgcagctcatttgcaatcagtgaggcttatgtcttcggaagtgggaccaaggtcatcgtcctaggtcagcccaaggccaaccccactgtcactctgttcccgccctcctcactagtgcgactgagcgggctggcaaggcncatagnnnnnnn

SEQ ID NO: 233468 - DNA, 460 bp, Homo sapiens
  misc_feature: GYAE6OF01CNIPE.39.86.H09.1.454.CMB.1.raw
  modified_base (368)..(368): a, c, t, g, unknown or other
  misc_feature (368)..(368): n is a, c, g, or t
  modified_base (388)..(388): a, c, t, g, unknown or other
  misc_feature (388)..(388): n is a, c, g, or t
  modified_base (429)..(429): a, c, t, g, unknown or other
  misc_feature (429)..(429): n is a, c, g, or t
  modified_base (437)..(460): a, c, t, g, unknown or other
  misc_feature (437)..(460): n is a, c, g, or t
tcagtcgcactagtcacgaccggtgctcgatttagtgctatagacttgggtttgggggctgtgcctggatattgctggaaccagcagtgacgttgggggttatgactatgtctcctggtaccagcaatatccaggcacagcccccaaactcatcatttatgaggtcagtaatcggcctcaggggtttcaatcgcttctctggctccaagtctggcaacacggcctccctgaccatctctgggctccaggctgaggacgaggctgattattactgcagctctatttggactaatcagtgagctttatgtcgttacgggaagtgggaccagggtcagtcgtctaggtccacggcccaaggcccaaccccntacgtcactctcgttccccncctctcactacgtcgcgtactgagcgggactcggacaggcncagtacgnnnnnnnnnnnnnnnnnnnnnnnn

SEQ ID NO: 233469 - DNA, 651 bp, Homo sapiens
  misc_feature: GYAE6OF01DOB81.39.86.H09.1.454.CMB.1.raw
  modified_base (270)..(270): a, c, t, g, unknown or other
  misc_feature (270)..(270): n is a, c, g, or t
  modified_base (307)..(307): a, c, t, g, unknown or other
  misc_feature (307)..(307): n is a, c, g, or t
tcagtcgcactagtcacgaccggtgctcgatttagtgctatagacttgggtttgggggtctcaagaggcagcgctctcaggacatctccaccatggcctgggctctgctgctcctcaccctcctcactcgagggcacagggtcctgggcccagtctgccctgactcaggctgcctcgtgtctgggtctctaggcagtcgatcaccatcctcctgcacgtggaaccagcagtggtacggttgggggttatgactatcgtctcgtggtaccngacaatatccaggcacacgacccaatcatctatttangagtcaagtaactcggacctagtacgggttactaacgtcgtcttcgttctcggtctaccgtaagtcgtcggacaaccgaccgtccctaccgtacgaccctacttccgtacgtcgggtcctaccggaggaccgttaggaaccgggaacggtacggtaccgttacgtaactttaacgtttacgtcggtactacgtaccgttacttacggtttacgaacgttaacgtacgtaggtacgtacggttcttaagtccgttacgggtacggtaacgggtaccgggtaaacctaacgggtaccttacggtacccgttacggtaacggccgtaacccgaccggtaaaccccgg

SEQ ID NO: 233470 - DNA, 701 bp, Homo sapiens
  misc_feature: GYAE6OF01ASSTX.39.86.H09.1.454.CMB.1.raw
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgcccccaaactcatctatttatgaggtcaagttaactccggccctcgtacggggtttactaagttccgtcttctcgtcggccttaccgaagttcgtacggacctaaccgacccgggtcccttacccctacgaccctacttccgtcgttcgggtcccttaccgacgggtccgtagggaacgggtacggacgggtaccttaggtaacttttaacgtttaaccgtgtaccgtacgtaccttaccttagttttcggaacctaagttccgtaaggttcggtacggttcttttaacggttcgtttaccggtttaccggggttaagggttaccggggtaaacccgttaaacgggttaccgttaaccgttcccggtttacccggttaacgggtcccgtaacccgggtaacccccggtaaaaccccggg

SEQ ID NO: 233471 - DNA, 529 bp, Homo sapiens
  misc_feature: GYAE6OF01E2H37.39.86.H09.1.454.CMB.1.raw
  modified_base (357)..(357): a, c, t, g, unknown or other
  misc_feature (357)..(357): n is a, c, g, or t
  modified_base (366)..(366): a, c, t, g, unknown or other
  misc_feature (366)..(366): n is a, c, g, or t
  modified_base (413)..(413): a, c, t, g, unknown or other
  misc_feature (413)..(413): n is a, c, g, or t
tcagtcgcactagtcacgaccggtgctcgatttagtgctatagacttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgcccccaaactcatcatttatgaggtcagtaatcggccctcagggtttctaatcgcttctctgctcaagtctggcacncgcctcccngaccatctctggctcaggctgaggacgaggctagtattatactgacngctctatttgactaatctaggtcgaggtctttagtgtacgttacgggaagttgggaaccctaagggtccaagttcccggttaccgtaggtaccaacgtccccgaagggtaaccccc

SEQ ID NO: 233472 - DNA, 552 bp, Homo sapiens
  misc_feature: GYAE6OF01EE196.39.86.H09.1.454.CMB.1.raw
  modified_base (307)..(307): a, c, t, g, unknown or other
  misc_feature (307)..(307): n is a, c, g, or t
  modified_base (369)..(369): a, c, t, g, unknown or other
  misc_feature (369)..(369): n is a, c, g, or t
  modified_base (377)..(377): a, c, t, g, unknown or other
  misc_feature (377)..(377): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttggggttatgactatgtctcctggtaccagcaatatccaggcacacgacccccaaactcatcatttangagtcagtaactccggccctcgtaggggtttctaatcgtcttctcgtgctcagtctggcacncgcctccngaccatcctgtcgggcctccgaggctggacggacggaggcctagtactttacttactgcgagtcctactagtttcgaactatacgtagtaggacgtacttagtcgttacgttacgggtaagtcgggtaaccgtaggtacacgtccgttacgtaggtacaccggccgtaaacccgg

SEQ ID NO: 233473 - DNA, 552 bp, Homo sapiens
  misc_feature: GYAE6OF01A89A7.39.86.H09.1.454.CMB.1.raw
  modified_base (160)..(160): a, c, t, g, unknown or other
  misc_feature (160)..(160): n is a, c, g, or t
  modified_base (288)..(288): a, c, t, g, unknown or other
  misc_feature (288)..(288): n is a, c, g, or t
  modified_base (526)..(552): a, c, t, g, unknown or other
  misc_feature (526)..(552): n is a, c, g, or t
tcagtcgcactagtcacgaccggtgctcgatttagtgctatagacttgggtttgggggctgtgcctggatattgctggaaccagcagtgacgttgggggttatgactatgtctcctggtaccagcaatatccaggcacagcccccaaactcatcatttangaggtcagtaatccggccctcaggggtttctaatcgcttctctggcctccaagtctggcaacaccggcctccctgaccatcctcgtgggcctccgagctgaggacgaggctgatttatactgcagctntatttgacaatcaggtgaggtctttagtcgttcgttacggaaggtcgggacctaaggtcaagtccgtaccgtaggtccacgaccccgaaggacccccaaccctactcgtaccaccttcccgttccgttacccccgccccttaccgtacaacgtttacggtcgacccgtacgttcgggaacgggtccgggtcgtacgggaccgaaaggggtcccgactaaggttacgcactgctgacgnnnnnnnnnnnnnnnnnnnnnnnnnnn

SEQ ID NO: 233474 - DNA, 251 bp, Homo sapiens
  misc_feature: GYAE6OF01A2HGK.39.86.H09.1.454.CMB.1.raw
  modified_base (246)..(251): a, c, t, g, unknown or other
  misc_feature (246)..(251): n is a, c, g, or t
tcagtcgcactagtcacgaccggtgctcgatttagtgctatagacttgggtttggggggtttggtggtctccactcccgccttgacgaggctgattattactgcagctcatttgcaatcagtgaggcttatgtcttcggaagtgggaccaaggtcatcgtcctaggtcagcccaaggccaacccactgtcactctgttcccgccctcctcactagtgcgactgagcgggctggcaaggcgcatagnnnnnn
